United States Patent 7,041,814 (NUCLEIC ACID AND AMINO ACID SEQUENCES RELATING TO ENTEROBACTER CLOACAE FOR DIAGNOSTICS AND THERAPEUTICS) - sequence listing, part 3

SEQ ID NO: 5182 - DNA, 228 bp, Enterobacter cloacae
gccaggatagcagatacctcccttgttccgtctttcatccgcaactcgcaaagcgagtttcgtgtgagccaggtgaatatcaacagcgttaaacaaactattaatatgcacaaaacaatgggttggttcggcattttcatggccttcttctcctgtcaacgcaaagcagaagtgtcaccatcggtgcgaaacagagatgtcatgctttggttcagagaatgcgtttga

SEQ ID NO: 5183 - DNA, 225 bp, Enterobacter cloacae
ttcacctctgatatggccacttgcgaaatgggaatggtaactgttattactatgtgtttacttgctgttcttgttacgcagccccttaaacacattactttcaaatatgatttcctgctgggtttaaatatgtgtctttctatagtgcggcaacctatttttacaccaactcatgaattaaataagaatcataaattaaatgagaggtttaattctcttgcttaa

SEQ ID NO: 5184 - DNA, 201 bp, Enterobacter cloacae
atctgcgcccttgtaagcttctgggcggaactgcttaaacctgacataccttcccggccttatataaaacaatccgccagcagctcgactggcggacaatgtttgactggaaacagcaaggacatactatttgctgacaagtttgatattggtttcactcattcgaagtcgaaactcctgaaaaccctgctctaccgctaa

SEQ ID NO: 5185 - DNA, 624 bp, Enterobacter cloacae
atttgtttaataaggctgagtatgatgaataaagaacaactaatcgacaaactggaacgcgtggtatgtggtcagtactcctacgaaatgcaggagcttgcgtattcggccctctgctgcattaaaggcaccccggacgactgcgctaagttccctgttacgcgtccgctgcctgacaccttagtggacgtatgggacgagatcgggcaataccttggcacaggcaaagccattgaaactcgcagttgcggcgtttcgcttctgcttcatggacactgctacgattcaaatcatgtgctgtactggcgcaatgctggcgcacttccagcagcttgcgatacgccactggctggtgggtctcgcaaactgttcacctgctcagcctgtggagtggacggtctggatgaaccacctgaaaccagttgccactgctgcacagagggggcccactggattgagagcaggctcttcacctccgggcaggcagaccctgaagaatttagacccgtggcggtcgtgaaagagtgtgcaggctcaacgccggatgatcggctcatctggagcgtgattgaacagctcaacggcgaactggcggaaggcgataaactatttaagcaacgctga

SEQ ID NO: 5186 - DNA, 297 bp, Enterobacter cloacae
tctgggaagcctgccgtgatgccattcttaacggagacaaagggtaaacggcaggtatcgcctgtcatttttacccttgtgaggaaaatcctgatgaaccatgagagccgaactgtatacctgaacacggccattgaggccctgttgaaagctgaggcggctctgaacgagctggcattagcctatgtactcaaaccaggtgaaaaggcaagcgcatgccatccccgaaccggtacgctttccacagcttcccaggtaagaaaacttcgccgtgttctagaaaaaaacaagttatga

SEQ ID NO: 5187 - DNA, 924 bp, Enterobacter cloacae
ctgagtcagccgagaagaatttccccacttattcgcaccttccttaagagtagtgacgatttttcccgtgaactgtcatttctttttcaccggtctataaagattagaaattcaggtttcgcgatatttggtgcgggcctgctgataatgatttttggtctttgcttgtggttgctgtcattacacctctcaccttcagttctggactttgatattgatgtgcccttgtcattcttcaattcatctgaaggtgaagataagttagtggtttcggattttggcgatgcatttggaggcttcctaactacatattctaagttgctattagggattatggggctattagtagtttcttcaactgcctttaaaattttaaagggggaggaaataggtgagatattcccgatgcttctaattgctggcgcttttcttatcggcttgtcagtttttacatctgctttaggttcggaagagactgatgccacttcagcttcgactgtaaaggttatcaagaaatatgtaaaacatgaaaaatacgataaacttgtcgcatatttaaatgatagtaattggccctcaggcgaagaggtatctgtaaactatttaaaggcgcaactacatataaaactcggcaagccagatgtgaagttaacacagaatgttgttagggcgtatatgtctggtgtattacagtcaaatattcccgtgaaagttcgttatgcattggaaaagacagctttagataaatccgtctcaccacttgcgattcgttatgagcaaaaacgtatgtctaaatcacataccttttcaaaagcgtcggttaattgtcttaaagtaggtagtcccgtcgcattcgttggcgttttgttcgctcttcttggtataaaaatcaggcggcgagtcagattcttagaatcaaattga

SEQ ID NO: 5188 - DNA, 237 bp, Enterobacter cloacae
ggatacatgatgtgtaactttactcctgttcaaattattgctgattatatactgaggtttcttaaaaataatactgatgccaagctttatgaggcaatgcagcgtcttgaaaagaaaattggtcagtttgtcgctgatggggttgatgaacatcaattacgctcttcattaagcaaagtctgtcgatctcgttccagggcggctcttaaagaggagtgtgaacaactcattccataa

SEQ ID NO: 5189 - DNA, 306 bp, Enterobacter cloacae
ggccgggaaggtatgtcaggtttaagcagttccgcccagaagcttacaagggcgcagatttacgtgttaagacggatggcatccggcacgatctatgatatctctggcaatttcagacgggccagagaacggcgtacgtttatggggaatcctgatgatgtgacgtgcaggagctctccggtcctgttccggctgggcctcgtggagttatgccagccagtaaggcatctggagccaggtttatactatcggctcaagttgagctcctcagggcatgaagctcttaaggcgaacgcacacctctaa

SEQ ID NO: 5190 - DNA, 279 bp, Enterobacter cloacae
gaaacagaacccgacacatcgctgctctctgggaaagccggtcagcagatggagcgccaggaactaaatccgctggttttaataatgattgaggagaacaagatgaaagataacaagacacgtcctgtagactcgtatgctcatgctgatttcatggagtccgtcttcagcaacctcagggctttctgtgatgcggaatgccagcggctaactgccggttatcccccaactgtcaaaccagaacagcaaagcactgacggccagctgtcggcggcataa

SEQ ID NO: 5191 - DNA, 195 bp, Enterobacter cloacae
atcattacctgccagttcgttcaaatttccgcttccttaagcccgggccaaaagcccggctcaatccaaaaactgaacgtaccggtttacctctatatctcctcaatcccctgcgacttacaagagacccgcaccggtttagccattcctgtcctgccactctctcatcactggcccagacaaccggaaaagtaa

SEQ ID NO: 5192 - DNA, 369 bp, Enterobacter cloacae
tgggctacgcattcagtctccacctctctaactataaaggttcttttcatgtccaatagcttcgataagccgcaaacgctcccggtacataattctgatgccgaacccttttttccgaaaaaccttggtccatttatcgagcaggtatccggaagggatctggcaatgctcacagaatcagagaaggaaaaacttgcgcacctgatcagaactgggcgtaaatatggagtttctgtcgctatcgttcctgatacagattctgctgagcttcatgaattactgtctaatgccgattccattgaaaggcagttttccatctatgaacgcatccagacgaagattgcgttcacgcggtgtcaggaagcataa

SEQ ID NO: 5193 - DNA, 354 bp, Enterobacter cloacae
gccactttgttatatttgtttcatgttaacagaggaggcgatatgcaaattgaaaaggtgatgtcattacttgaagtgctttcaagctggcttgaagataacatcaatatggattctgaaattatctttgataatgacgaagataataccaactcagaaattctgtatcctgctgtagaaaaggctaatgccgttttgcgcaaaatggcatctttatcttcagattctgttcatgcaattcgacagcgcttgcagcttgccgtagaaggcaaagctgaattgtccctcaaggatgtgggagagcttctgctggcaacaaagtatctgatgttgtccactgaagagggagagtaa

SEQ ID NO: 5194 - DNA, 189 bp, Enterobacter cloacae
aaaggtgacttgatgaaaccatttggacttgccggaaaaccccggcccgaaccttgcggctgctgctggtatacccgtgaggactgcccttacgtcagcgcaaaacagatctatcgccgcaggcagcgcaaggcagaacgccagcgtcagcgcagcaccattgtgatggccgtttctgaatttcgctga

SEQ ID NO: 5195 - DNA, 192 bp, Enterobacter cloacae
aaaaaccgctatgcaggaaaaagagtaatacccccttttagcacccacaatttcaccgtccatctgcctttaaccttgcctgttattaacggaatcctttctgactgggcggatcccacgcataacctgaactgttggctaaccgtcttacagccaaattccctcctttatctggcaggagtgcgtccgtga

SEQ ID NO: 5196 - DNA, 522 bp, Enterobacter cloacae
tgttgtccactgaagagggagagtaagcctgtgaccactctcgtatttgaaatggcagatatcaataaactgatcgaagaaattcgcaccgcaaaaacgttttcggtcaccccagatcagatctatgacccggcatgctatccggggggagccctccttaacgctgagggacagactgaagaagaggcgcgtaaagctggtagggttttctttccctcatcctcaaaaattgccagcacacatctggtgccaaaagtgcttctcgcgcacagtcatggtgtatacctgatcactaatgctgagcttgagggctctcccgcatcccgcgatactgtggcttacgcccaggggatgaatccaaaactggatgaggactgggattacgcttgtgatgccgctttgggtgggtctgattgtagctataccattcccgttgagtggctggagttagcggtagagcagggttttcaggagtttcgacttcgaatgagtgaaaccaatatcaaacttgtcagcaaatag

SEQ ID NO: 5197 - DNA, 231 bp, Enterobacter cloacae
gaattctccctgaatggaaggcaaccgatgaaaatgttttttaccccttatgttcgtatcgttttctatttttgcgcattgatttttattgtttacagtttcagtgattttttccagggcgtccctgacagcaccttcttcagtgcggtcatcacgctacttgttatcggaaccattgttgcccggcatctggatcgcaaaaaatctctcaaatatacttcacagatttaa

SEQ ID NO: 5198 - DNA, 243 bp, Enterobacter cloacae
tttaataaggaccggttcatgcataaccacgaaattcagaccattgctatatttagtgcccagtataaaaacatcgaagatgctgaaaatgcaggtgctttatattcagtagatattgaatatccgatgacactaaatgatttatcgcggctttgcgactctattgccgaagcagtaggtgtgcctggcggcgtcaaataccagttcgtgtcccagccggaagcgcatgaaaccagcttctga

SEQ ID NO: 5199 - DNA, 237 bp, Enterobacter cloacae
ccagtaaccaaactgcctaaaagcaggtgcaaagccatgaaacaaacaaagtcttctatgtcacgtattgtgcagctgtacgacgggagccgatacggaaactgcgagcaggctgataacgaaggagagctttttacggtggtgttgaataagccttcgcagatcgatgacatccgtaaaatcgtagacacaaccgccgaagtacttggcaaagctttgccagtactcctcttttaa

SEQ ID NO: 5200 - DNA, 327 bp, Enterobacter cloacae
tctggagagtcaatcatgatcacatctctaatgaatttccgcgatttaaccggagaggcagtcatccaggcgcggcaatgcgttattaatgctgagatcgaagcggcccgggaaaaggtaattcatgctcgttcgttattcaaagcgggtatacataatgttgtaaacggtagttctggcattaaggctgcggcagcacattttctggtgataaaacgtttacagactgacactcggtatctggacgcggttatcactgataacctttgcatgttttctcctgagggttatctgtatctgtttatgcaacaacgttatttcctataa

SEQ ID NO: 5201 - DNA, 291 bp, Enterobacter cloacae
ggatataatatgaaaatcagccagctggaatccgggatgcaggtttggtctgtaacccgtaccaaaatgggaaataccaccatttcaacggtcattgtccaccccgttgtcattattgaaattcatgataaccatgtgattgctcgctggaacggcaatgcaccacgtcggtttggagaaacggctatcaggggctggaagaaggagaagccactgcttgtccgtgagcctttcggaaatgttcgtctggccacccgggctgaaaaaaccgctatgcaggaaaaagagtaa

SEQ ID NO: 5202 - DNA, 618 bp, Enterobacter cloacae
caggagtggggtatgactgaattaaataaaagcccgtccggtttttccggagctgatgtcagtaaagaacaggctgccataagggcacttgtagaaagagtagtgaccaactatcgcagccggacagcacctgatcgggttcaaaaggcttcggtagcgtttaatgggggattaatcctgaccctgatgctggccttgacgctattgggctaccttgtggcggaattgctcagggggtatgttgcggatagttcaccctatgtgcccggtctaagttattcgcaattttcgatgcttatggtcgttgagctgtgtctatgctttcttgcatggtttttggttgtcacaggggactatccccggccgtggatatttcaggtagtcccgatggagcagtactggttctttgacgaagtggatgacgacgatcttgcccggctttcctgtaacccttacatcaagcgctggctacttgatgaaatgtccggtattcatcgactgacctacacgaggctgcatgatcgactggagcgcatctgtaatattgcatcccatctcgaatacagccgtattcaggcacataagatttccctaatcaacggaagcagtgcctcctga

SEQ ID NO: 5203 - DNA, 351 bp, Enterobacter cloacae
ttcgccaaactacggggcatttctttaatggcggagctttacatcactatttctgtcattttcaaatccgccggatacagcaataattgcaccgaacagcggtttgaactgcaatgcatccgtagggtatgcgacaataataaggctcttcccgtactcttaaaaatggaagagtttaaaacccatactgctgggatgagcgaagcacggtacattatgccagcgtataagggccgtcataacttgtttttttctagaacacggcgaagttttcttacctgggaagctgtggaaagcgtaccggttcggggatggcatgcgcttgccttttcacctggtttgagtacatag

SEQ ID NO: 5204 - DNA, 537 bp, Enterobacter cloacae
  unsure (526)
aaaaaatgtcgaacctggtattgttgtgttgtagcgcagttaaacaaccaaccaaaagagagaacaaaaatgtccgcaatcgaaactgaagtaaaaaacaacagcaacgaaataagccttcgtggttacctggaacgcactggtaacggtgcccgtaaaggtaacggccttatcattgacccttcggttgttgtacaacaggaaggctttaacacccgcacggccggtatgggcgagctctactattcaatgcctcacgttgtggaacacctgaacagcctggccgatgcctacatggaagacccgttcagcgtgacgcctatcgttgttcagatggttaatggcgtacctgtactgcgtcagggggcttgccgtatccgttccatcgctattgcaaaccgccagctggaagcagaagggcgtgaacgcattactcgtattcgctgcgaacaatttcgcggtagcgcttcaaaagcagaactcttcaccctgaccggcaactccaacctggcgctgtctgtcgtanctgaagcgctt

SEQ ID NO: 5205 - DNA, 204 bp, Enterobacter cloacae
gcgggggctgataaaatggaagatgcgattaacgtcccgattacctattacgattctaacggctgtctaattgttggtcacaatctggttggaaaaatccaccctcaattatttgataagctggttcgtcgttcaaacgatggttcaacccgttgccagcaggcaaaaatcaccagttacttagaagggcttttaaatggctaa

SEQ ID NO: 5206 - DNA, 276 bp, Enterobacter cloacae
agaggtaaccgaataatgagtattccaatgaaagggctgtcaaagcgtggctggtataatagtctgactgattcagtcgaatacaaatacttcaacggtcaaacagaaattagtgaatcagcctataagctacttgcttcaggtaataagcctaaaccaactgtgaagccagctaaagcggtcaccacgtataaggtgaagcctaagccaacgattgaacagcaaagagatgcagccttgaaagaggctattaaacagatggtaagcgggggctga

SEQ ID NO: 5207 - DNA, 298 bp, Enterobacter cloacae
gttgggggccgtcccggtgaggcagggagttgttgttggcggggttgcaccacaaccgttaacccaccgtttaaccaaaaacctgggtaattcagttcgaaaacccgaatttgctgatcgttggggtcggccaaccgggttttattcgggggcgagtggatcaaagagggcgcattggtcgtggacgtgggtattaaccgcctggaaaacggcaaagtggttggcgacgtggtgtatgaagatgccgcagcgcgcgcatcctatattactccggtcccgggcggcgttggcccgatga

SEQ ID NO: 5208 - DNA, 921 bp, Enterobacter cloacae
cctatagcaagtgttaaactttttgcctgtttattgtcacctctatcactacaggaagtcagcaacatgacacatatcttttatgagttctcctccctgaagcctggtgttcctgatgtggaaacattaatggaagtcatcaattcttctgaactcacgcgttttgtcatgggtgcagaggtggtcgattttgttaagaaggcgctcatcgttaacaccacaatcggtagctttaaaaactgctattttgcttttgatgatggggcttactttctcgagtttgacggcaagggtaaatccagacgctttactgaggtgcctgactggttcgtttcccctgcggaatttgcccgctcgcaatggctgattaaccatgacctggccgatgtgaaggcgacggcgtttattgacgtgctgatgtcctacccgcttaaagagcgccgggcgcactgcaatctgctgtttggtctggatctgcataaggtcaatgtggttccggcacctacagcccctgccggaaaaatgggcaataaaaacggaaaaactaccaagcctcgcgttacggatctcggctcttttgagctttttaccgcgttctttgcgcgtatgaaaaccgccgtcaatgctaatgaattccctaccctacaggtgctgaccggccaggaggatcttacaaaagcgccgcacaacttaaagcaagggatcagaacctggtttaaagcgattactggcgatctgccgccgaacaacaaacgtgtcggagcgggcaatgcggtgctgttctgcgctcccgttcgcgagcagatccagcagatagaggccatcggcctggaaaaatactatcagggattatcaaaagccatcgctgacgccggggatgggtttatcactgacttcagctatacctggtctgaaaagtaa

SEQ ID NO: 5209 - DNA, 258 bp, Enterobacter cloacae
cgaagccacgattttcaggagggtgcttttgccgcagccggagggaccggttatcagtttaaattcgcccggagagagacaaaaatcgacgtgctgaaggatggtgttatcacccacacgaaagccaacatccctgatatccagaagattttttttattattcattccgattccattaaccgctgtgataagaagagccttaagcataatcctttccgctacgcagcgctaatagccttaacctatagcaagtgttaa

SEQ ID NO: 5210 - DNA, 186 bp, Enterobacter cloacae
cgatgttgggctaacgtcatcacggtgctcagcggcgagcagcacgacagtttcaaaaccagcaagcgcctgatcgagttgatcctgattacgaacatcaccggagacagtaatatccggataaaaatgactctgctgtttgtcgaagttagtaacatcaaaatcagtcttggaaatctcgattaa

SEQ ID NO: 5211 - DNA, 192 bp, Enterobacter cloacae
tgttttgccggatggcgcttcgcttatccggcctacaggaccgtaggcccggtaagcgccagcgccaccgggcaacaaaaaggcgaccacacggtcgcctttttttattacaacagctcccgcgccgccgacacaatgtcatgtgccgtcaggccatactccttttgcaagaagtcctgcgtgcccacctga

SEQ ID NO: 5212 - DNA, 183 bp, Enterobacter cloacae
tttgacgagttaacgcttatcgtctacggccctatcaggctggcacaggatacccgatacggggtagcgatgacaaaatattttgaacgttgtcatagcctgttgtggttttgcacgaaaattttaatttttatacgtgaagttgaggtacagccatgtcgacacccgaaatcccgtccgtga

SEQ ID NO: 5213 - DNA, 252 bp, Enterobacter cloacae
gccagcgacaaagttattggactggatgtatttgccgatcttgttgttgttgatggtgccatcacctatcagcgcgtctctgatgaacacctgcccgttctgaataacgaacggaagcgtaacggtcgctccggcctggtgcgttacggcgaagcggtcagccacgaagataacctgcgactgcatgccggacggcgtattctcaacgccgatccccatccctgccgcgtaatactgaccattgctggctaa

SEQ ID NO: 5214 - DNA, 210 bp, Enterobacter cloacae
ttcctcataaaaataaagcacgaaatctcgggtaagcctgtactgaacctgattgctggtaagggttgttttgtcctgaagtatattcccacgctggatgtactgaacgggataaccttcaagctctccgtggacaatacttttccattgagaccagatagccttatccagtttcaccagcccggtataatcatccactttgtatattga

SEQ ID NO: 5215 - DNA, 414 bp, Enterobacter cloacae
ggaatcatcatgattcgcatggaagttaaagggcttcaggaattcgaacgccaattactttcccttggtgaaaaggttggtacgcaggttttacgggaggccgggaaagctgcacttgagcccgttctggaggatatgaaagcgcatgctggttacgacgaatcagcgaaagatgagcacatgcgcgattcaattaaaatccgctcatcctcttcgaaagcaaagggcaatgcagttgtttatcttcgcgttggcccgagtaaaaaacacttcatcaaagcgttggctcaggagatgggaaccgtaaagcaagtcgcaagtcccttcattcgtccggcgctcgattatcagaaagcgaaagttctgcgcatccttgcgatagaaatacgcgaccgaattgaaaaccaccggtag

SEQ ID NO: 5216 - DNA, 405 bp, Enterobacter cloacae
agattctacggtacaaatctctgtgctaacctttgctcaaaacaaaggagcaaaaccatgaaaattgtattgagtgtattgttattgactgcatttaattcatacgcaggaactgtagacgattatctggagcgtcattctgaaataaaatcaaattctgttgctgaaacttatgtaagccattacgcctttatgattgcgatgatggaagcacaacaaaagcataatagatctgataatgaatttattactgggttgctttcaaataatggtgatgtatatgcaagattagcggttaaaaagcttgcaaatgattgtttaacgcaaaggagcattggtcaatccggagagttaaataataaagagtgtaatattgtgattagagcagataaatcagaacaatag

SEQ ID NO: 5217 - DNA, 375 bp, Enterobacter cloacae
ctgataactattgcggccttcgggccgctcttttttcggggcaaacaaatgcttgatcagaatgtggtgaaacagcattgccgcattgataccgactttacgggtgatgatgctctgctggagatctacacaggtgcggcggcccggtacgtccagacatggacacgccgaacgctctatgaaaaggaaagcagccctggctacgctgacgacccggacccgatactgctcaatgatgatgttaaggcagccatgctactgcttatcggtcactggtatgcaaacagggaatcggtagttataggtgaaaccgtgtctcaggttccattagctgtggaggctcttcttcagccttacaggatatatggcctatga

SEQ ID NO: 5218 - DNA, 381 bp, Enterobacter cloacae
ggagaattacgggaacatggtaacgggaggcctcttacggggcctcttttttttcaggagaactggatggcggaatatggtgttcagacatgggacgcatcaggcaaggtaaacaactatggcgttaagcctgtcagcgtttgtggctatctccagctggcccagaaccagaaaacaggctcttacacagtagcgcttccaccgggttgcaggctgacctattttcagagcatgaacggcgatcagtttggtacgagtcggaggaagatcaccatttcggggggaacagcaacagtgtcagcagcaggcgataccgactactcagcagggactgagcctgcggcagcggcttatctcattttccagatcgagagggcataa

SEQ ID NO: 5219 - DNA, 1419 bp, Enterobacter cloacae
gcgccaacacgttcaccagcaccacctgccactaacccattcagttttgaacaaaccccgctccggcggggttttttattgcctggagaaaacatgatttatactactggcactatcgccatcagcggaaacacccttacaggtaccggcacaaacttcactgctgctggatctcttattcgtaacggatgtaccgttattgcaatgaccagccctgtgcaggtatttcagattaccaccattggcagcgcaacaagtctcaccgtaacgccagcggctaacccagcagttcccgccggaacccgatttgccattcttctgagtgacagtctgagcgtggatggtctggcgcaggatatagctgaaaccttcacgatgtaccagcgctacatgagcgggttcgctgatgtaatgaacgggacatctgatgtcaccattactatcaacggcactgccgttaccgtgccgggtcaaaaatctctggcgaagaaaggggctaacagcgacattaccagcctttctgggctgaaaacagctctcagcattgagcagggagggaccggcgcaaagaatgctgctgacgctcgcacaaacctcggtttaggaacatcagccacgcttaacgcgcgtcccaacgaaacatatccaactgatggtgttttgactgtagggcaatatggcatcggagcacaaaacccgcctcttaccacagatttcaaaaccatagatcgtggtggaatatttgcgggagctggctctgcaggcgttaatttttataacgcgtttgcacctgtccttgtgatgagcagatattcatcttctgcaatgcaggccatacaagccgataactcaacccttgcgtttaatattaaagacggtaatggctggcgtggatgggttaagctatacagtgaaaataacactacccgtgccagtgatggcacgctcaaagtcgcctcacctgtagtccgaatagtgagatcacaagaggaatgtaggagagcagatgttgacaaggatggattttcctggtgtggctgcggtacggcgaatgcagaggcagagggtgtaaccctttttcgcctcgacgtaggtgtttacgttatcagcggttcggcaggcctggcgtctgagggatggcagttactgccgccaatggatcctggcggcatgggggaactgggtgtagttgaagctgagcagacagaaagcggtgggctgacgattcggctttttaagcggaaatacatactcagcgaagaaggcgaaattgttaaaacgaaaggggctcctatagatgttcctgccaatagctggatcgacgttcgcctcgatatgccagaggatagcatctggaaaacaagagcttccgaagcttctcttgaactgacagagcagcctgaggacattcagccttaa

SEQ ID NO: 5220 - DNA, 498 bp, Enterobacter cloacae
aaaccaccggtagcgctcgctgccaccttcaaagagagagaaattatggctgataaaacttcgccagagtacgcgatgctgcctgctggcaccgtcgttatgtggggtgctgcgggcagcgacgtagcaacaatgaaaccactcattaactgtaaagcgctgggcgctacaggacagacgggcagctttgtagactgcactacgctgatcgataccagtaaacagtttatctctgacctgcctgaaggccctgaaaaatcgctgggctttattgacgatccagccaaccaggactttgctgatttcctcaacgcagcagagaaccgggaaaccgtacagttttacgttgagctgccaaatggtcgaacggcgaacatgattctggccctttctggctggcagatgaatgaaattaccgccccggcaagtgaagtcattcaaatcactgttcagggaaaacagaacaatattacttggggtacggctgccggcagctga

SEQ ID NO: 5221 - DNA, 378 bp, Enterobacter cloacae
ttctcaggaaaaactatgtctaccatcgatgtttctgcacttaaatccgcacttctgaagcctaaaagcgccgttgttaccgccgaaatttttggaaccaccgtttatctacgccgtatgacggcgggagaactcatcgatcatgaagaagcgctgcgagacagtcagattgcagaagatgcacgtaaagcttcagagatcagtgtgcagttgatcgtcgattgtcttgtccatcccgatggcagcctaatcgcagctaaagacaagcctaccgcagccgagctactccagactcatgacaacgtggcgctccttgatgcaatcgccactgtaaaaaaacatgcgctgggtaagcttgaagacgcggaaaaaaactaa

SEQ ID NO: 5222 - DNA, 474 bp, Enterobacter cloacae
ccctctccccggtggggagaggggatagtccttcacctatgtgagtcttcatcaatgagaattaaaacagggttaatggtggcagcattcgtgatgctggcgggctgtaacgcacccgcgcagcacgtgccggtggaaacctgcaaagcggataaccagatgcagcagaccacgctctattttggcttgaatcgcccggcaggggcgcagattaccggcagcgagtggcagcagtttgttgaccaggacgtgacgccgcgttttcgcgatggcttaacggtgtttgatgcccgtggtcagtggctgggtaacgacggcaaggtggcgcgcgagccgagcaaggcgctgatgctgatccacgggaaagatgcgcagagtgagaagaatattgaagcgttgcgcgggatctataagtcacgcttcgcgcaggagtcggtgatgcgggttgaccagccggtgtgcgtgcagttttaa

SEQ ID NO: 5223 - DNA, 243 bp, Enterobacter cloacae
caaaacagccaaaaaggactggacttacgcctgccgggttgtggtatgtttgaggcaggcgcacaggaagtgaaccttctgctgagacgaaaaccggattttatcgtttattttcatgcggataaaaagagaccgaatacgattcctgtattcggtccagggaaatggctcttgggagagagccgtgcgctaaaagttggcattaatgcaggctcaatcgccttgccctttaagaatagatga

SEQ ID NO: 5224 - DNA, 234 bp, Enterobacter cloacae
ctaaaggctggtcaactaagcgaccagccacattacatgattaacattgttccgtttctatcgcttccattcgtattccatatcctcgtaggcttcattcgttttcgagatgaaaacaaaaataccgaggccaataaaaataacgaagggaatgatgatgctcgcaatcagttcccagattgctggcggatcgttttgcgccaggaaactgatacgataggcaatgagggataa

SEQ ID NO: 5225 - DNA, 1383 bp, Enterobacter cloacae
agaatatacaaacaacagccagacccggattccactgtgccagtcgtcatgattgttttcctctatgtgatagccgtcgcaatgggcctcgcgatccgggctctcacctggcctgaacaggaacacgttacggctctcttttttgtgccttcagttattctgcccatctgtgttgtatcgttgctagtttttacaagtttcatatttcatgacgccaacattcattatgctgaaacccgaaaattcatagcaaaagagcaggagattaatttaaaggcgtatgcgcgaaaaaatatcgctatcgcagcatggtctgcaatcacccccctggaggaacccgcgctgaatatgttgaaactggaaggcgaatttccgctggcaccgaaaacgccggttaatattcagctggaagatcgcttcgaccagaccaggaatgaacagatgttttaccgcttactggacccgatggcagaaaaattgaaggactataactaccgtatttttgaaaccgttgtctgggttcacggagggagtggatcctgcattgatgaactgaggcgcactctggagcggttgggtattgaaacggcaagcacgtgtaaaattgagtacagcacagaatgtcctgactacgcgatcgttagccaatggatgaacttatctgattacagagttgaaaaccggttgattgttatcgttgatttacatgaagaaagcggcgaatcaaagagcatggaaaatgcatgtgcattcctgctaaccagtcattatgtccgggaggagggcgaaaaaccggtatatttatatcagcctatgtctgacgtgaccgatgtagaggacaaaatggcggtcttccttgagacgggttcggtacttacgccgaaaaatctctggtataccgggctgtcccgtattgaaaaatatccattaatgcaggcactggataaaaaagcgctcacggtggaacggctggatatcgatgcctctctgggcgcaaagagtgccgggtatcggtggctggctctggcatttgcggcggatgcggtcaaatatgcccagggggagcaactggcagcttattcagacaaaaacaaattttgtattacttcgctttcctccatgaagacagctatcccaaaaaaacttacctggtgtaactggagtaatcccctttatcctgcggggatggcggctttattctgcgtgttatccctcattgcctatcgtatcagtttcctggcgcaaaacgatccgccagcaatctgggaactgattgcgagcatcatcattcccttcgttatttttattggcctcggtatttttgttttcatctcgaaaacgaatgaagcctacgaggatatggaatacgaatggaagcgatag

SEQ ID NO: 5226 - DNA, 327 bp, Enterobacter cloacae
atgccagctgtcagcgctctctttacactcaatccccatgatgcgattgacgattaccgtccccgcaaaatcatcgagaaacaggacattacttccttcgcccagaataagtacgggttcaccgtttcctgttgcgttttgccatgcattcagcaactgctgagcactttcggcacgtacaatttgattagcattccgttgaataccaaaggtattccagggcttaagggagtgattcatagacgctatcctgatgcaaaaaccgggatagtttaccgtatatatggggggataggtgatttgtttatggaaaggaagcaggtgtag

SEQ ID NO: 5227 - DNA, 387 bp, Enterobacter cloacae
atatcgcggggtaaaaagtatagactgtcagcctccgcaggcatggaaaataatcgtactgtctggggtccacggttactgtcgagcctgatgattgactttggctcatcgcccatcgtaattatggccacgcgggaatccttcccctgcgccgctatcgtctggtttaccagactgatggcatcttcattacgatccgtattaacccaccagactcctccgactggcatgtggcgcaattcgtcccataatgactggatgccaatagaaaatatggagtccacggtgtccctcttttcgtcgaatttctatgtctctcagtttactagcgaaagcgtagaaataaacctaacattgaaattaaagaacatcagatttagcatgtaa

SEQ ID NO: 5228 - DNA, 552 bp, Enterobacter cloacae
gctgtcagacgaagacgcacccgatttcgacggctatctcttcgaatcggtccctcttttccaggggaagctggtgtgaatatactgccgcttcacgctgcgccgcagtttacacagcaggtgatcgactggatctggtacgcgtttggtgaaggtatgccgcgtgcctttttccagagcattgtcgagcacagcctgacgccgggcgagttaccgctcacctttattgccgttgaggatgaccagctgctgggcaccgttgggttgtggcgttgcgatttaatttcccgacaggatctccacccctggctggctgcgctgtatgtcgatgaagccgcccggggaaacgggctggcgggaaaacttcagcagcatgttatcggctacgcgcgacgcgccgggtatcacgagcttcatctctggtctgcctgccgcgacttctacgaacgttacggctggcactacatcggcgatgcgctggaatacccggataaaaccgtccatctctatcgctgttcgctcacggcttccgcgggcgataccaccgagtga

SEQ ID NO: 5229 - DNA, 198 bp, Enterobacter cloacae
ccaaagcagtatttgaaactcgtggcgtcacggcagatgcacttcctgacgcttctccggacctgcttcctctcaatcagcaagcagaaaagcagcgttcagagacagtggaaaaaaatgttggcccaatatctccaggcctggttaaatttactgctgaccccctgttcctggatctctggcaaagacccgcgctga

SEQ ID NO: 5230 - DNA, 597 bp, Enterobacter cloacae
aatgttcttattttatcgacgggtttacatttcgggggaaggatcgttatgacagtaaagaaaaagaagacagcgttaaaccacgacgatattgcggacgggcgaatcgtctcctcccgtcatctcgtctcagagcggtgtgctgaattatcagagctggaatatgcgctgatcatgaccagcaatgcgtttaacaaatggatggtgcgctgcatgaccgcagcgggtgaaccggatatgggggcctttgatgtttcgcttctgcaccacgtgaatcaccgcaaccgtaagaaaaagctggctgacatctgctttgtgctgaacgtggaagatacccacgtggtgacgtatgcgctgaaaaagctggtcaaggcgggctacgtcaccagcgagaaagcgggaaaagagctttttttctccactacggaggagggaaaagcgctgtgcatgaagtaccgggaggtgcgggaggcctgcctgatcaacattcgtgcggaaagcggtattccgggcgcgtcgattggcgagaccgcgcagttactccgcgcgatctcctccctgtatgataccgccgcacgcgcggcggcctcgctttaa

SEQ ID NO: 5231 - DNA, 387 bp, Enterobacter cloacae
ggaggaaggatgatttttaaaacagtggtagccactcttttcaccctctccgggctcgcgtcagccctggcagcaacgcctgcttattacatcgcagagtttcaggcgaccgatcttgacgctatcaaaccgtacagcgctcaggttgaatctaccttcagaccttttggtggacgcttcatcgtcagaggaggtgaacccgatgttaaagaagggtttggagcacagggcagactggttgtaatcaagtttgagagtctcaaaaatgcccaggactggtatagctcggccgcataccagaagatcattcctatccgacaccgtgccggcaattcgcgaacctatatcgtagaaggattgccagaactggctcctgttacaccatag

SEQ ID NO: 5232 - DNA, 267 bp, Enterobacter cloacae
ttctcccgtcgcgaagacatgcgcggcgttgtgaaaatcatcattccattcggcggtgaaaagcggcgtctgaccatgctcatcacgcggatgcaggaaaatcacgttgcgactgtcttcggtggtcagatggatatgccgatccggaaaggcgtcgcggatccgttgcgctatctcgggaagaatatgggtctcagcgtcgtcatggatctggtcgatggcgtcgaagcgcagaccgtcaagatgatactccgagagccagaataa

SEQ ID NO: 5233 - DNA, 1167 bp, Enterobacter cloacae
tgcgttcctgaaagagaacgggatcgaggggatcgaaccgctgcatatcggcctgtgggccattccgaccgccattgcggcactgatcatccatatgacgcgtctgctacgcctcgatgccagcattcgtcgcgacgtgatggcctggaaagcagagcagggtacgcaggagatcgcaccatgatgaccctcatcaccattaaccgtgtgtactacctgatcggcttcgtcgtgatgctgctggttgtgatgacccttcgcgatcgcgctaacccgaaacgctataccacggcgctgttctggtttctgtttggcgggatcttcctgtttggcgatctgatggtgcaggagctgggtaagtccctggcgtatcgcattattggcggcgccgttatcgtgattgcgctgctggccggtttcgggctggtcgggaaggggcgttataaaatgtccaccgaggaggagcgcgttgcctcgtcgaaccggctgaaaaactggctgtttttaccggcactgatgatccccgtggtaacggtcatcgggacgctatttctgaaaggcgtgtcgattggcggtgtctatctgctcgaccagaaacagcttacgctggcggcactgtgcgtagcctgtgtggcagctatcctcaccggctggtggctgacaaaaggtacaccgctgcatgcggttcgtcagtcgcgtcggctggtcgataccattggctgggcggtgatcctgccgcagatgctcgccatgctcggcggggtgtttgtggtggcgaataccggcgaatcggtacaaaaggtggtcagcctgtttgtgaacccggacagccgcttcatgctggtggtcatttattgcgtggggatggcgctgtttaccatgatcatgggtaacgccttcgcagccttcccggtgttaagcgccggtatcgctctgccattcctgattaacgtccatcacggtaacccggcgccgctgctggctatcggtatgtacgctggctattgcggcacgctgatgacgccgatggccgccaacttcaacattgtgcccgccgcgctactggagctaaaagacaaatatcaggttatcaagatccagatcccgaccgcgttaaccctgctggtggtgaacgtgttcttaatgtatttcctcgtgtttcgctaa

SEQ ID NO: 5234 - DNA, 1005 bp, Enterobacter cloacae
ggagctgcaatggaattaacgcaacatcaggctgacgccttcgccagaatgccgttgacctatttacgtcaggaatacccgaaccacattatgcatctgctcaacgatgacggcgacgttctgccgcctcgcgagctgcacccgatcttttacggctgttttgactggcactctgcggtgcacggctactggctgctgctgcgctgcctgcgtctctggcccgaactgccgtgccgggaagagatcatcactctgttcgaagaacacctgaccgacgagaaggtggcgaaggagttggcctattttaccgcgccgttccgcgcgtcgtttgagcggccttatggctacggctggctgctggcgctggcgcaggagctgaagcaatcgtcactgccgcaggcggagcgctggtaccagacgctgcaaccgttaacgcgggatattcgccagcggctggtggattacctcagcaagcttacctatccgatccgcgtcgggacgcactacaacacggcgtttgcgctcgcgctggggctggattatgcccgggcggtgaacgatgacacgcttgagcgcgccatcctggacgcggcaacgcggttttacctcgcggacacgcaatatcctgcgcattatgagccgggtggcgacgagtatatctccggagcgctgaccgaggccctgctgatgagtgaggtggtggaggatttcccggcctggttcgatgcgtttctgcctgaagtgggcgccgtttctgcgctgatgaacccggcagaggtgagcgaccgcaccgacccgaaaatcgcgcatctggacggtctcaacctcagccgcgcctggtgtatgaagcacattgcccgtgctctgccggaaaatcatcacgcccggaagccattacacgatgccgttgcgcgccatctctcggcaagcgtggagcatgttgtcggcagccactacagcggcggccactggctggcgagttttgcgctgctggcgctggagtag

SEQ ID NO: 5235 - DNA, 801 bp, Enterobacter cloacae
tgcaccggcttcgctctgctgcgaagtataaaaaatagccgtcggcgcgcaacgctcactttggatagggtaacgtttatggacagttctacactgttgccacttatcgggattccggtggtggttattggttttgcactgcgtttcaacccgctgctggttgtcgtggtggcggggcttgcgacgggcctgctggttggcatggatttcggtatgctgctggaaacctttggcgaaaagttcgtgaatagccgatcgcttgccaccttcattctgatcctgccggtgattggcctattggagtattacgggctgaaagaacgcgcccaggcctgggtcgcgaagatcgccagcgccacctcggcgcgtatcctgatgctctactttgttgcccgcgaaggaacggctgcgctgggcctgatgtcgcttggcggccacgcgcaaacggtgcgtccgctgctggcgccgatggcggaaggggcagctctgaatgaatacggggaactgccgcagactatccgcgacaaaatcaaagcccatgccgccgcgtgtgacaatatcgcggttttctttggggaagatatttttatcgcctttggcgcggtactgctgattgatgcgttcctgaaagagaacgggatcgaggggatcgaaccgctgcatatcggcctgtgggccattccgaccgccattgcggcactgatcatccatatgacgcgtctgctacgcctcgatgccagcattcgtcgcgacgtgatggcctggaaagcagagcagggtacgcaggagatcgcaccatga

SEQ ID NO: 5236 - DNA, 342 bp, Enterobacter cloacae
caggactgtaaaacgctatggtgtaacaggagccagttctggcaatccttctacgatataggttcgcgaattgccggcacggtgtcggataggaatgatcttctggtatgcggccgagctataccagtcctgggcatttttgagactctcaaacttgattacaaccagtctgccctgtgctccaaacccttctttaacatcgggttcacctcctctgacgatgaagcgtccaccaaaaggtctgaaggtagattcaacctgagcgctgtacggtttgatagcgtcaagatcggtcgcctgaaactctgcgatgtaataagcaggcgttgctgccagggctga

SEQ ID NO: 5237 - DNA, 363 bp, Enterobacter cloacae
ttgctgacggaacgtcgaaggaataaacaaaggggggagaagatggtgcatccgggaggattactcggcttacgcctcgccctgcgggccgttgctaaagcaacgttatcctccctggtgcttgcgattaactcgcataccttaaaacaacagcatcgctgttatccaggagaatatggtgcatccgggaggattcgaacctccgaccgctcggttcgtagccgagtactctatccagctgagctacggatgcatcgggatttactactgttactgctgatactcggtatcgcttcaaaagcaacacaaagtaaaatatggtgcatccgggaggattcgaacctccgaccgctcggttcgtag

SEQ ID NO: 5238 - DNA, 390 bp, Enterobacter cloacae
aataatggctcctctgctgtaattatctgtctctttattgcttttataggcatagttatttcattttatatagactatcggaaaaattatcgccaggttaatcaaatatatgcgatattaacaaatcaacagttgctcaaaaaagaagattatcaaacctggcaaaatcttgggttctggggatttggtttcctcaccacaattttatcacgggtcttacagggtaagcgtgtgagattaactgagtgtcgttggcttgagccacagtcgtgcaataaatttttttctgattttgatttgtcatgggttaagtcgtatagaagaaaaatacttattgccactgttatatttttactgctgttaattctttcgagcattaatagtgtctaa

SEQ ID NO: 5239 - DNA, 1152 bp, Enterobacter cloacae
accaaatcattcaaaagaatgccgaacaggagggcaatgctcaggataactataccgccgtggcggtgtggatgggcaaccctcaggacaccactttgctgcatacgctctctgacgcagcacaatttcttccctgcggaactgattagacacacaaggattgatatgaaactttggctatcgggtttggctcttctgacggtggcgaccaccgcacaggctgaaaacttccgcatcgtgcagtctcctgcgcagaagctggatatctggatcgacaacattaaagacaatacgccgcaaagctggtgtaaggcggacgtggcgctgcgtatcgtggcgaacggcaagaaagaggtttcggtgctggaaaacttcgtgccgcgccttggctcgctgctggagcaccagtgcagcaagctgaataccctgaactggacgcttaacgatccggaaggcacgacgcttgcccggggcacagcggctaaagcacaggactgggcgctggtggtgaaacagcaggaaacgacggcggcaacgaccaccacctcaggcgcgctgctgccgcctgaccagaatccggagacgcacaccgtggcggcagatcgtacgccatggcaggagttcacccttcaggacggttgccacctgcgcaccttctgggagggcggttcctccgcgccggcgctgtttattccggattccgacaccacccgctgcggcaacggtagctggctcagcggccacaccgtggtgacgcaaaatcgtaacggggcgcagaaagcgattccggtcacctacattcacggcttcccggtgatgggactgaacaacgcggtcgatcctgaaaaggcgctgatcacctccgtcaacaaagagcgcatggtcttcagcaccccgaacagcgaccagagctggatgatcctgccgtacgacagcactctgaacggctggaagagcaacggcacggtggcggtggaaatcacccgtgagatcgccagcgacgacgccagactccaggcgcgtatcgcagaggtgaagaagatctggagcgcatgggttgcaccgggcgcggagctgaacgttgttctgattgacacgctgcgtccgcagctgcgcgatccggcagtgggcgcctggcgcgcggcgaattaa

SEQ ID NO: 5240 - DNA, 1056 bp, Enterobacter cloacae
aagggcgctggtatgagtgaagttgcccctgcaacgctgcgcgtgcatcgcctgacgccgctgcccgatgcgttctggcgcggagtgcgcgagacgccgtggcgctacgatctgttccagctgttaagacgcattgatgcccagggcggcgagcgttacccgctggggcgcgcaccgctgcctaaatttgagccgctgcgtattggtcagaagccttcaatgggctttgcgccgtcaacggttgctgaggtccggcagcgggaagagaacggactgcatgaggtttccattctgagcttcggcctgtttggtcctaacggcccactgccggtgcacatgactgagtatgcccgcgagcgtattcatcatcatcaggatcacagcctcagcgcgtttgccgacctctttcaccaccgcctgacgctgctgttctaccgcgcctgggcggacgcgcagcctgccgtttcactggatcgcgacgacaacaggcgcttcgaagggtatctggcatcgctgattggcatggggcagcctgcccagatgtcgaaaggcagcctgagcgcgcatgcccgctttactcacgccgggcacctgacccgccacgggcgggacccggaagggctggagaaaatcctgcgcaactatttcaacgtgccggtcaggctggtggccaacgtcccgcagtggatgccgctctcaacgcgggagcaggcacagctgggtgaggggcgtcgcctgccgcgcatgggagagtccgcttttctcggcattgcggtacgcgacgtgcagcataaattccggctcgagattggcccgttgagcgcagacgactacaaccgttttctgccgggcgaaggatgggtcaccgagctgcgcgactgggtgcgacagtacgccggggtggaatttgaatgggaaacacgggtgatcctgcgcgccgatgcggtgcagggcgccacgctcggtagcgccgggcgattagggtacaacacctggctcggccttcagcctcagcctgttccgcgtggcgatctggtgtatcgcgcagagcgataa

SEQ ID NO: 5241 - DNA, 1500 bp, Enterobacter cloacae
atccgtaagcctgcgggtaacaggacggagcgaatgtataacatcaagtttgtctatctgttccacgagaacgtctcgccagcgctgtttgcgaaaataatccgcccgtccgttgccggacagtggattatgtcggttcccgaccattcgctgcgctcactcttcacgcgctacgatctgctgcgcacgatcaccggtgcgaatccttatcagtccgggcgcgatacccgtacgctgatcgcgcaggatttagagatgggcagagtggttgccattgacgaaagttttcgtgactggtcatcagtaacggaaattttttatatcaacgccaaagggcaactccaggctgcctcgctggtcggcctgggctggtatccggtgagtacaattgttgaccgctacgaaactatggtgagaacgtacggatctcgccctgcgccaacggtactgccaaaacaggtggtgaaatctaaaacggcacaggtgccggatgaacctactccgggcaaggacggtaaaacctatgccgggcagcttcagaagatgaccaaagcagaacgctggcaggcgcgtaaagatctgatcgcgaaggggagcaatagcctttatccggatgcccagatcgccgcgaaacgtctggcggcgaataatatcgcggtggaaaaagcgaagcttgcggaaaatatttataagaccgtgaacccgctggaaaccacaccgggcgtgccggagggatggacggatatcagtaatgacgatgcgctgttaggaaagttcgggctgaacaaatccatgctctttgacgatgatacgtcccccaattttctggcgcgcgtctatcaaccgaagccggaagtgtttggtgcagatatgaaccccacgctggtattcaggggatcgcgcgagcctggcttcgcctctctgtctgagaatgtctcctctctactgaccaaaggggaactggcgccggtggtaaacggggctgactggtcgaataacttctcacagggcatgggtatggcttcagattattataaaaaggccgtgagtatcggtaaggagctggcaaggtcaggccagaatattgatattgccggtcattcccttggcggtggtctcgcctctgcaacctctatgggcagcgggaaagcggggtggacgtttaacgccgccggcctcaatgccggaaccgtagaaaaatacggcggtaagatattaggcagtacggataatatccaggcgtatcgggttgaaggtgaactgctgacgaagattcaggaagttaacccctgggaagatctgaaaacgatgaaagggcatgtcccttcgtggatcctcaaagaggaaatctctgcgctgagccctaatgctgccggaataccccatgaccttcccggtggaaccggaagtgcgctggaccgccacgggattaatcaggcgattgattgcatagagcaacagaaggatgaggatatttcgataatcgggagtcgattgtga

SEQ ID NO: 5242 - DNA, 522 bp, Enterobacter cloacae
aagagaagctcatccagaaggggggcgaatggccacccgcgccggttaagtgattgctcaactgtcatgaacgccagagataaggttttcgttttctggggatgcatggatgccctggccgttgtcttatattgtgcccagtccatgcggcatgacaagatcccttttatttccgatatacacgccttcagtacggttgtgaacgcgctgtctgctggtgggtatagcgctctggttattcttttctttattctcgattttttgttgttgctctcttttattgcctcagcatggtgcttcttcgcccggaatttatacgcgagcagactggcactctaccaggaaatactgcgtctggttgggtttcgctactcagtttccctttttcccctggtgttaagtttcacgggcgtgatgaatgtctggctaaatggatttttattcattttgtcagagtttctgaaaatctattccctgtggatttataaatatgaaggggaaaggcccccggttaaagagtaa

SEQ ID NO: 5243 - DNA, 885 bp, Enterobacter cloacae
ttgacacgctgcgtccgcagctgcgcgatccggcagtgggcgcctggcgcgcggcgaattaaggggggggctatgaatacgctttatcaacgtctggcgggtgagtcgattagcgacgcgctgcttcgcctggaagccgaaatcaaagctcgtccggcggatgccgatctgcgcgccgcgtttgtgcagtttctgatcctcagcggcaactgggcgcgcgccctgacccagctgaagagctggctggcgctgatgccgcaggcaaaaccaaccgtaacgctgctggagcaggccattcagggtgaacagcagcgggcgcgcgtgttcgcgggagaggcgcgaccggcaatgcccgaggcgcagtggccgtggctgtcgacgttagcccaggcgctgaccgaacgcgccgggcaagcgcaaacgctgcgcctggcggcactcgaacaggccccggcaagccgcgggcaggtcacgctggagaatgaagagagccacacctttgaatggctgatggacggcgatgcccgtcttgggccggtgtgtgaaaccctggtcaatggccgctatttctgggtgccgttctgcgccatcgatgcgatccgttttcaggctccggccagcgtgaccgatctggtgtggcgtcatgcgctggtccgcctcacggacggcaccgagcaggtgtgtcagatcccggcgcgttatccgtttgctgacggcgcttccgatagcgttagactggggcgcaccaccgagtggctcccgctcgacgacgacggtgtcctgtatgaaggcatggggcagaaagcctggctgagcgagcaaagcgaaagcccgctgctcaccctgagcctggtgacatttacctcggatggtgcgaatgagtaa

SEQ ID NO: 5244 - DNA, 1893 bp, Enterobacter cloacae
actgaaagatgcggggtaatgatggaaagcaaactgctcgaatattacaaccgtgaactggcctatctgcgcgagatgggcgcggagtttgccgaacgctacccgaaagtggcggggcggctcggcatgcgcggcatcgaagtggcggacccgtacattgagcgcctgatggaaggtttcgctttcctgacctcccgcgtgcagatgaaaatggacgccgaattcccgcgcttttcacagcgtatgctggagatgattgcgccaaattatctggcgcctacgccgtcgatggcgatcgctgaaattcagcccgacagcagccggggcgacctgagcaaaggctttattgtgccgcgcggtaccatgatggacagcctggcgctgaaaaaaaccggcgttacgtgcagctataccacggcgcacgaggtgaacctgctgcctttaaaaattgagcggatcgagctgggcggcgttcccgccgatctgccgctggcccagctcggcctgagtcagcgggggatcagcagcgccttacgggtccgcattgcctgcgatggcccgcagcatctcgggcacctggattttgaccgcctggagttcttcttaagcggcccggacatcgaggcgctgaagctgctggagctggtgatggagcaccacgcgggcatcgtctgccagacggtcagcaagcagccccagcgccagctgctgtcgtctgacgccctgcgtcaggaaggctttgatgcggaccaggccctgctcccggacgatctgcgtaactttgacggctatcgcctgttgcaggagtacttcgcgttcccggcgcgttttcgtttcatcagcctgagcgggctgggcaagttgatccagcgctgcgaagacgaaaaagcgtttgatatcttcattctgctcgacaagagcgacgatcagctggagcgcgtggtggatgccagccacctggcgctgcactgcacgccggtgatcaacctgttcccgaaagtggcggcccggcagaagctgagcgaaagccagcatgaataccacctggtggtggataacatccgcccgctggattatgaaatttatgccgtgaaaaaaatctatgccagcgcggatggtcagcgggacgaccagacgtttcgtccgttctggagtacctggagcggagacgcgggcaactacggcgcctatttttccctgcgccgtgagcagcgcgttctctccgaacacgcgctgcgctatggcacccgcacgggctatatcggctcggaggtcttcgtctcgctggtggatgcgcagcacgcgccgtggcaggaaaacctgcgctatatctccgccgaggtgctgtgcaccagccgtgacctgccgctgatgctccagcaggagcttgggcagtttattatggccgactccatgccggtgaaggcgttaaccctgcgtaaaggcccgacgccgccgcgtccggcactggccgaagggttcagcacctggcggctcatcagccagctgcaaatgaactaccttagcctgatggacagcgaaaacgaagagggcgctgccgcgctgcgtcagctgttagggctgtacgccaacctcgccgagacgccggttgcccgtcaggtggatggcgttcgtcactgcgtgctggagccggtgcaccgccgcgtgccggaacccggcccggtggtgttcgcccgcgggatcggcatcaccctgacggtggacgaacgtgccttttccggcgccagcccgtggcttttcggcagcgtgctggagcgcctttttgcccgcctggtctccatcaacagctttacggagttcacgctcaagagccagcagcgcggcgaaatcggctactgggcgccgcgtatgggtaaaagggcgctggtatga

SEQ ID NO: 5245 - DNA, 387 bp, Enterobacter cloacae
acaatattgctttcgaaaaagcccttatatggcaaacaggaaagcatggggctgaataaaaccgtccatattttacctctgcctcatatcaaacgacccgtgtcatttgacagtcttacattcccccgaaataacggaatgaatgtgaagtctttattactgtgctttattgtggaaccagttaaggacagcattagcaatttagccgtctttcttgccgggtggcgctgtgcttacccggcctacattgagcaacgatatcaattgattgcacgtttgattgtaggcccgtgcaagcgtagcgccgccgggcgaaactcacaaaacgcacgtagtcagcagtctgacgctcttacgcgtccttcgtcttcagcgacggcagtttag

SEQ ID NO: 5246 - DNA, 588 bp, Enterobacter cloacae
tgtcgatggcaacagcaaagcctgcaaagacagcgcgaacggtacctggatcctgaactaaacgggtttcacgagcatatttttatgaataataaaaattttcatcggatgtggttccctttttttgcgttgattttcgcgctgatcggtggttgtacgtcgtcttcacacagcgacccctcccgctacaatcttcagtttcaggctcatcctcaaatcaatgattctgcgccgcttaaggtcagagtgttgctgctgaaatccgatgcggatttcatgtccagtgacttctactccttacagaacaacgcgtcagccacgcttggcgcgaatctgctgaacagcgatgtgttcttcctgatgccgggccagctttcgaaaaccctgagcgggcaaagctcaccggaagcgcgttatatcggcgtgatggcggaataccaggcgctggacggcaaaaaatggcgcgtctcacttcctttgcctgttcccggcgaaaacgcgatttaccagttctggaaatggtccgcagatgaactccaggccagcgtcttccttgacgtaaatggtatccgggtcatcagccagtaa

SEQ ID NO: 5247 - DNA, 1032 bp, Enterobacter cloacae
ataagcagggatcttatgaatatcgatgaatttctcgcgccgataagccccgacaacccctgcggtgaaaacctggagtacgacgctgatttccaggccatggggcaggccagtcagggcaaagccgagcagcagtttggcgacaccatcattccggcagagcctgccgactggaacacggtggaaaaactcgccaccagcctactgggacgcaccaaagatcttcgcgtcatgctggcgttaacccatgcctggacacgtcgtcgcgggctggcaggttacgctgacgggctactgctggtgcaggaagccctgtcccgttactgggagcagctttacccgctgctggaagagtatggcgaaaccgatccgttctaccgcatcaacgccctcgccgggctgagtgataaatctgacctgacggtcgcggtacgtaacgcctcactgctccgctcaaacggcgatgagatttcgctccgtgacgcccaggcgctgcttgacggcagtaaaaccgagtgtccggattatccgggcgggcgtccacgactgatcgatgagctggcccggggcgatcagcccggcaccgaagcggtaatcgtgatcaacgaacgcctgctggccatccgcgaactgcttaccggctatctcggggaaagtggcgtaccggagatggaacagctgctgaaaaccgtcgggctggtcgccagcgcgtgtcaggtgaccgacatcagtaagctgctgccgaaccgtgacgcgcaggctgaacagcacgctgagccgcagcctgcggcagcgcagcccgttcagccggtcaccgactggcgcagcgtgcaggtgaccagccgcgccgacgcgcagctaatgctggaaaaagcgaaacagtactttgcgcagtacgaacccagccatcccgcaccgctgatgattgaacgggtgcagcggctgtctgaactcaactttatggacattattcgcgacctggcgccagacggcgttaaccaactggaaaacatctttggacgccgcgaatga

SEQ ID NO: 5248 - DNA, 630 bp, Enterobacter cloacae
aacagcagtactgggagcagaccactgccggtggtaaaggtgctgaaagcagcgctggctggaacatcaaagaaaacaaagaagcgtaacaggagtgggcccgaaagggctcactttatcctgtactttctaaaagggaaaatatttatgcgtcctgcttttggtgccgcctggaacagatttagagaagttaatgtcaatgtcgaaacggtgggcaaattattgggtggaaaagtccagcacaatattgaagccggaattttccaaaatgcatgccccattcgtatgagctacgttttaaattattgtggcgttccaattccctccaacagcagatatgcgacggttacggggagtgataaaaaacgttacatgtatcgcgtaaaggatatgattgcttttctgccaactgtactgggtaatgcagatatgacggtgacgtctccaacaccaagccaatttgcaggtaaacaaggtattattatctttagcggtcacggctggagcgatgccactggacatgtcacgctctggaatgggaatatttgctccgatgattgccatttcttgggttctcccggtaatggttcgtttattcctggcagcgctacgctctggagcctgaaatga

SEQ ID NO: 5249 - DNA, 555 bp, Enterobacter cloacae
cacctaagtcaaattttatccccctctcttcatcctctaaatatcgctacggaaaagcatatgaaactgcgtgtattgttatcacttctgtttgttatggcggtggcgggctgtaaggcgccgcaaaaaccagcgatcaccgatgatacgattgtgaccagccaggtgaatggcatcacgctgacgcaccgtcacgctgttacccctccggcggagttcactcaagtgaatgaaccgtatcgtgccatgtacccggcatccctgatgagccgtcctgactacggtggaaaagtgatccgtacgcttgagaccggcaaaacttacgtcgtgctggggcaggttgaacatttctggatggcgctggccgatgaagggagtgaacagctgattggttatgtgccgatgcgtgccgtgatcaaggctgaccagtacgaagccaccgtgcgtaaacaggcactgcgcccgaaagcgcgtaagaaaaccacctgtgttgatgtcgatggcaacagcaaagcctgcaaagacagcgcgaacggtacctggatcctgaactaa

SEQ ID NO: 5250 - DNA, 1386 bp, Enterobacter cloacae
atggtatccgggtcatcagccagtaacgcccttcataacaggaaagagatcatcatgacgaaagcagaaaaggtcgtctggaccgagggcatgttcctgcgtccccaccattttcagcggacagaaagttacctcctcaaccacgttcgtgagtggggggccttgcagcgttcgtatctctggggctttctcgaccttgagctggatgaagcgatgcttcgccagggctgtattgccctcagctactgtagcggtttgctgcctgacggcacctttttccaggtgcgcagcgaccgcaacggtccggctccgctaaaaatccccgataatctcaccaatgaaaaggtggtgcttgcgctgccggttcgtcgcggtggccgtgaagaggtgattttcagcgaggagcagtcttctctggcgcgttttattacctttgaacaagaggtggaagacgacaacgcgatgtcggtcggggaggcgacggttcagtttggccgcctgcgtctgaccctgatgctggagaaagatctgacggcagaatggaccgccatcggcgtggcgtacgtcgctgaaaagcgcaacgacaaccacgtgcggctggataacagctacatcccgccaatgctgaacgccaataacagcccgcagctgtacggcatgatcaatgacctgcacggcttgctggtgcagcgtagccagcagatcggcggccgcctgcgccagccggggcgtttcaatacgtctgagatggttgagttcacgcttctctcgctgatcaaccgccaccttggcgacgtctcacatttaaaaacgctgccgctgtttcatccggaagcgctctggcgcagctggctgccgtttgccacggagctcgccacctggacgccgcagcgtaccgcagagagcatactgccggtatacgaccatgaccatctcgccgtttgcttcagcaaactgatgctgatgctgcgtcagggactgttcctggtgatggaagatcatgccatccagctgccgctgcacgaacgctcccccggtctgaacatcgtcaccgagcccggagaccagcatggtccgcgaatttggcttcgtgctggcggtaaaagccaatgtccccggcgaacacctgcaaacccattttcctgcccagatgaaggttgcgccagtctcgaaaatccgcgatctggttcagcttcagctgccgggcatcatgcttcgggcaatgcccgtcgcgccgccgcagatcccgtggcatgcaggctacagctatttcgaactcgaaaggggcagcgaactgtggcacgagatggacaagtccggggcattcgcgctgcatctcgcaggggaattcccgggtctcgatatggagttctgggccatccgtag

SEQ ID NO: 5251 - DNA, 837 bp, Enterobacter cloacae
gccgtcaggccacgttcaacgtcgacggacatcaggtcacgctggagtttgccccgaacagcatccgcaacccgttccagcttccccgtttctcatgcccataaccgcaaggacagccgtatgacgaatacccctgcgatgaaccgatatagctggtatggcaaattacccagcgccggagattttttgcagcgtcgctttccggataccctgcaacgccagtggtcgcactggttccaggtcggcctgctggcctggcaacaggaagagcagcgcagcggcgagcgcccgttttctaaagccccggtgtggaactttgtcgtcccgccgatgctcggtagccagatgattcagatgggctgcctgctgccgggccgtgacagcgtaggccgccactatccggtatgcctgcaactgagcttcacccccgccgagtggtcatcccgcctgctcgggcaggctgagagctggtaccagcagcttggccgtctggggctgcacgcggtgcgtaacagctattctgcctcccagctggatgaaatgctgatgaccatcccggcgccccagccggttgagccgcaaaagcgttccgacattctcgacgtgattggctatgacgacgagggtcagagcacgctgggctggccgcaggcggcggagtgttttgatccgctgcgccagaccagctactggtggacaaaccgctgcgacggttatccgctctacacccacgtccacagcggaaactttaccgggcagctctttacgctgctgttcgatccggcaggcggcgcccgtccgggccgccacggtctttacccgcctatgtttgaataa

SEQ ID NO: 5252 - DNA, 357 bp, Enterobacter cloacae
acatcgtcaccgagcccggagaccagcatggtccgcgaatttggcttcgtgctggcggtaaaagccaatgtccccggcgaacacctgcaaacccattttcctgcccagatgaaggttgcgccagtctcgaaaatccgcgatctggttcagcttcagctgccgggcatcatgcttcgggcaatgcccgtcgcgccgccgcagatcccgtggcatgcaggctacagctatttcgaactcgaaaggggcagcgaactgtggcacgagatggacaagtccggggcattcgcgctgcatctcgcaggggaattcccgggtctcgatatggagttctgggccatccgtagcccgacagaataa

SEQ ID NO: 5253 - DNA, 396 bp, Enterobacter cloacae
tggttcgtttattcctggcagcgctacgctctggagcctgaaatgagacgtttactcgctttcgtactcgcgttaaatacctcatataccatcgcccatactctcccggacgttaacaccttttctcaacaacagatttttgaaaactgggtgcagaatcgctgtatcggcaagattgcggacagtgcgacgctgaaaaatgatgcaaaggcaagcgccgcagcatggctggaagtcagtaacctgcctgccgagaatttcgaaaaagccgacgaggttattaactccttactgaaacaaaagctaggtggtacggcaccggcaaactatgaggtattaaagtgcagcttaatatcccatagcgatgcgattcgccaactcaatgtccaaaaataa

SEQ ID NO: 5254 - DNA, 987 bp, Enterobacter cloacae
actttctgcaaaagctacacattaaaaatacaaggagtttacatggcaagtccgtcaaacgttgctccaggttactgtgtcgttcagcaacccggcactctggattttcaggcaagacagctatttggcactgcgcgcaatgaaaaatccgagtattttatgcaattgaataaagacactgcgtggctcaaacccggacaaatattaattgttgctgacccgcttggcgataatcaaactcaacagatcaatagcttagccattgcaaaaaagaaggtgaccaacgcgcttgcgactttggatggagccaccgctgagtttttgaaaaataattatgataatataaaagccataacaggctggggcgatacaatcgtcgggggcgtgagcggtacaggtgagtcatattttaagcaaattgaaaatattttaattaaaattgaagccacctatcaaaatcagtacaggacacaaggtgcgctttttggccaacaattttatgctgagcgcaatgcgcttttcgcgcaattgaaacccttgttaaataaaataactaaaaaacagcttaagtttaaagattatgcggatcttaagagagcattaggactgtccacgaaatcaatagtccatgaatggagtacagttggtattggtgcaatccctggctactcaacatatattgacagagcagccagaatatcctcttacctgaaagcaggtggatgggttgctttaggtttttcttttatgaatacgtctaacgaagtttatcatgcctgcactactggaagagaacatgagtgcagcagagttgcagtgacagaatatagcaaatttggaggcggtgtcgctggtgctgcattaggctcctcccttgcggctcctgtttgtcttgcattaggtgtgcccacagcggggacaggtacattcatggtgtggtcaagtggaaggacagtgggggcagggggaaaaacaaaaattgttggt

SEQ ID NO: 5255 - DNA, 207 bp, Enterobacter cloacae
caggcgcttacgcagctcaatgaggtgcgcaatcagcggttgagtatcatctactgccatgtttacgctttatcactcgacgagggggatgattcggaaacaggcgcggcgggttttacctcagccgttttgaccacgggctcttccggcggcacctgctttttcacttcgggctcctgcggcgattgctctggcgaagcggcctga

SEQ ID NO: 5256 - DNA, 300 bp, Enterobacter cloacae
cggccaggcggcgatttcccggtgcagggcggtgatctgctcggtaagatgctccgcaagccacgcgacctgttcctgctgttcactctcaaccgcgtggcgaagctcgtcgaggttggtctgcgcttcagcaaggtaatcctgaatgacggtgctgcgggtgcggaagagctgccggtcaaagcgcggtttcagcgtggcgtggcccatcagcggtgtggcctgcgcccgcagcgcgatcagctgattttgcagcctctcaagaagcagtgctgttttcaaggcgctctccagtggtaa

SEQ ID NO: 5257 - DNA, 258 bp, Enterobacter cloacae
tgccataaggctttcctctccctcccctcagcaaatttatcaaaatctgccttttttcatgcttattgcctttttattgtgttttcaacaattattcataaacataagcgtaaaaattgtcataaactattaatcggctttttggtatttgcaccaaaaatggatcacccatcgcaaaaggagacggaatgcaccacgccacaccgcttatcaccaccattgttggtggacttgtgctcgcttttattctcggcatga

SEQ ID NO: 5258 - DNA, 219 bp, Enterobacter cloacae
cgtccctggcgtttatcctccggcgttatgccgctggttatcagctccggcgcgggctccggcgcacaaaacgcggtaagtacgggtgtaatgggtggtatggtcacggcgaccgttctcgccatcttcttcgtaccggtgttcttcgtggtggttcgtcgccgcttcagccgcaaaaatgaagatgttgagcacaatcattcggtagaacatcactga

SEQ ID NO: 5259 - DNA, 192 bp, Enterobacter cloacae
ccccctgaggctggtgttttattttgtcacagtcgaaatttggctcgcgaacgctctaatcctctctgcgctacgctaaatatcctgacacgctactggtttttcatccagtgttttttactggcaatcctggccacaacgagtaaaattactcacctgccgcttattctgtcatcaggtcgtcgcccatga

SEQ ID NO: 5260 - DNA, 1038 bp, Enterobacter cloacae
tgtcaggaatttccctggaagggtttactcctgctttcgggcgtgcgtaacatagcgctaactattttgtcttgcggacttattatgaaaaaaccagcgtttatcatcacgatcgataccgaaggggataatctctggcagaaccaccggatgatcaaaacggaaaacgcgcgctacctggcgcggtttcaggcgctttgtgaacgcttcggctttaagcccgtctggctgaccaactacgagatggccgtcgaaccggtattcattgagttcgcgaaagaggtcatagcccgcggccagggtgaggtgggaatgcatctccatgcctggaatagccctccggagcacgatctgaccggtgatgactggcgctggcagccttatctgattgagttttcagacgaggtcatgcgtgagaaagtgctgttcatgacccgcttactggaagagactttccagacaaaaatgctcagccatcgcgccgggcgctgggcattcgacagccgttacgcccggttgctgattgagctggggtatcaggtagattgttccgttacgccgcgcgtgaactggcgcaacgcgaaaggtgccccgcagggtaatggcggaacgaattaccagcattttcccgatcgcgcctattttttggacgtagacgacatttcccggccgggaaacagccctctcctcgaagtgccgatgagtatccagtataaacacccggcatggctgaattccctgaagcagggttacgatcgtctgcgcggtaaataccgttctccgtcagttaactggttacgcccgtccggcggtaacgcgcaggagatgattaaggttgcgcagcagtgcctggctcaggggaatgactacgtagagttcatgctgcattcgtcggaatttatgcctggcggcagccctacttttaaagaccaggccgcgattgagggactgtatcaggatctggagcagctctttacctggttatcagataagaccgtggggatgacgcttgcggagttttaccagtacaaaaaatag

SEQ ID NO: 5261 - DNA, 327 bp, Enterobacter cloacae
acaacccttccgcacgtgcggtctcgaggtcgctgtttaactgtttgtaaaaatcaccacgcattgcaattctccagactcggcaaattttggcacatattacccaaaccaatagttcatgacgagatgacgcagtatctcttctcgtttttgcagcataaatcacgcgtacccctgctgcatatcggtgaatggctgaagcctgagcattgtgatgatatgataaagagattagcgttcgggatattccccgactcatacttcaaaggttacagttatgatcatcgttactggcggcgcgggctttatcggcagcaatattgttaa

SEQ ID NO: 5262 - DNA, 930 bp, Enterobacter cloacae
ccaaacgagaagaacatgtttaaattcctgaatgctcgctaccgccacattaccgggcgtcataacattccctacgcttcccttccggtcacgcgcgatctcgttgcggttgattccatcgtgatcccttgtacgggcgcggatttcgtcgaagaggcgttattatcagcgacctttgcagagcgttacgccaccgacgtcagcgagattgttatcgtcagcgatcagcctgaatccgctttcggcgagctgccgctaaaaacccgcgttgtcaccctcacgcttccaaaacgtgaagaggggtaccgctataagcagatctacctcagtcgtctggtgaagcttaatgctccgttgcaggcgcgcggtgaaggggtgctgatgatcgactccgatctcaacctgcttaaaatgccagagatcaacatggcggatatgcacatctactccagcttccgtcagggcaaaatgattgccaagctggacggtgcgccagcggagaaagtgccggcatattacaaagaaacggtgcgcccgtatctggtcgatcacgttaacggcgcgtttcttgcggccaccaaaaagacctggcgccgtatctgcccgctgtggctgacgctgttccaggatacctgggagctgatggacgatacgcagccgccgaccgatcagctgccgctcgctgcgctgctggacatgctggatgtaaaaacggttaacctgggcgactggatgaactggccggtctccaagaagatcggcggtcaggaagccgttgtgccgaaagaagtgattggcgcgcacggtggtttcccgctttccgagtggcagaagtatctggaatcgccggataacaaactgctgttcaaaggtcaggactacacccgcaaggtgcgttacctgacggacgaagagaaaaagaatcagtaa

SEQ ID NO: 5263 - DNA, 246 bp, Enterobacter cloacae
ttcaggcatggttcctccgttgagatgcagaatgcaaaaaaccccgcagttgcggggtttttcaatacaaggagactaaaattatttgattttagcttctttgtacagtacgtgctggcgtacaactggatcgaattttttcagttccagtttttccggcttagtacgtttgttcttcgtggtggtgtagaagtgacctgtaccagcagaagaaaccagcttgattttcttcgcgaatacctttag

SEQ ID NO: 5264 - DNA, 195 bp, Enterobacter cloacae
tggtacgtggcgaaggtgacgatgtctggtatcaacgtttatggcgaacgctggagccagaatatttcgacattatcacccaggaggcgcaacgctacctgttaccgttatacaaatttaatcagtcctgagtgctgtataaaaattgcgcagtatgaggtgttcatttatgatgcacctcttatcacggactga

SEQ ID NO: 5265 - DNA, 183 bp, Enterobacter cloacae
ccagtatcgtcagctatggcatcatgcgtggaatcaatcgcagatctcaacattaacgctcccgccgggctggcaagtcagtcgggggcagacaacacagtccggatgtgtcagcatcacggtcacacttatttctcctatggggcggcagggcgcgttaacgcgtctgcactgcccggttag

SEQ ID NO: 5266 - DNA, 183 bp, Enterobacter cloacae
ctcgtcgggctcataacccgaaggtcgtcggttcaaatccggcccccgcaaccaacacttcttaaaacaataaacaccctgaagggtgtttttttgtatctggcgtttgtgaaaatgccgggcatgatacccggcttaatgccctacccccgccgcgccagcgtttccccgtctgagaagtag

SEQ ID NO: 5267 - DNA, 258 bp, Enterobacter cloacae
aactgttcagacagacatgtcagggataaagctgaagaaaaaggtacaacgaagaataaccaagacataggcctgccgggtaagtggtgcacaggactgtcggaaagtacgctcagagagggtcgtttaagcatgatgcaccaccgccagccagccttaataatggtaatgtaccactgggttaccagacagaccagtaacgcatcaaacataaaactgttttttaaaaaacgtcaggaacgtagcctgaccttttaa

SEQ ID NO: 5268 - DNA, 480 bp, Enterobacter cloacae
tttatgaagcatctgaaaatgattgcagccatgttactgcttactcctttgacatcattttcacaggaaacagacagcgtggaggctttgaataaatatagcaccgctctgacagagctttttatgaaggaattgcagaagtcacagcaggcaaaaaatcctggcggaatggatttggtggctgctaacgacgctgttgcttctgcactgagcaaaaagttcttcatttttaaaccggctgatgaaaccagcatcaaaacttctgctgaaaaattaaaggcactgaaagatgataccgaagctcttgaaaagggctacaccatcattcagccagataatataggaagcaataacatttcatataaggtgacgacaggctctcggatctgctttgttcaggtcacacgcagtaagtcatcttcaaatactagaacggttgctgtcgatagcatagattgcacggggcctgaacagaaatga

SEQ ID NO: 5269 - DNA, 420 bp, Enterobacter cloacae
  unsure (37)
  unsure (44)
  unsure (107)
aggaaaataattggttattttagcaatcattgcagtnatcgccntgggtggtacgcttacggatttattaacacccgtgagctgagcgctttgcgtaaagaaatganactatacgtggatcgcatggaagcagcggagctggacttacacgcaatcagaagtgtagcggagcaccggttgcacggtgcaggtaaacagtttgccgacctttacagccgtatcgacggtgcaactgtgacgctgacacccgaagatcagctgttactggcaacgatgccatttaatattcaggatgtagaagacatcgtaaacgagcgcggtccaaagacaattagcggccgtccattctgggaagttgagccaggcccgcataactatgaatatggcccgcaatatccgtatttcccagaccagcgctag

SEQ ID NO: 5270 - DNA, 387 bp, Enterobacter cloacae
atgtcttgctacggcgataaaatgtttcgccataacactgagcgagagtggctcatccatcatctacaggagctttatatgcgcaaatttaagtacataatctgtcaccagtgcgaaggccacgggaccatggaaaacccggcctttgaaaatggattcacccaatcagaaatggctgagtgggagccagaaatgcgtgaaaagtattttgccggagcattcgatgttcgctgtgacgtttgtgccggtgacggtaagctcagtgtaccaaacgtagcggctatgtctttttcagaacgacgggttctggcagcacggcggcgtgatgagcgtcttcaggcagctgatgaacggctgtcccgccaggaacgagcaatggggtactaa

SEQ ID NO: 5271 - DNA, 873 bp, Enterobacter cloacae
ggtgcgacagcaaagatgaaaatgacgaagccaaaaccggtaagccggatgaaaagaccgtttattagtgagcttgcagaactgggtttatcgggtgaaattctttcaattcgaactgacggcatgcaggggacgcttatacccgatcttaccgcaggggtgagtgaagcaggccgtgtgaaaaccggcaactgggtaatctctgacaagagaaccttcgaccatgtcgttttgtgtgttgaaagacaagatgagaaccatgatgtgttcgtaggtaaattcatccagttacatgtagccgctaataagagcctaaagatcgtcgaaatgggcgatgtgaaactggtggccataaccagctcgattcctaccacttttaatggggggattaggagatttaaaggggttacgtatgtgtcactttcccaaacagctcaaaccactatcgacttcccgaagcgtatctacaaagagggccaggaatgtacttctgtcaccagccctgaccagggtcctttcgcccgggatgttaggttgaattgctacgggcgatgtgttgtcaccggcgtaaggtccccctggcgtactgaggccgcgcacttaacgccccgtcatgaagaaggaattcccgacgtaacgaacggaattttacttcgccgtgatatccatacactgttcgacaatgaccattgcgccataaaccctgacactatgaaaatttacttcagccgggaggcccgggagttggatgatgatctcctgaaatggcatggcgatgagatagagacgacacgcatgcaggttccggttaacatcgaaaaccttcggatacgatggcaaaaatttaaggctaaggatcgtcagcgtaaataa

SEQ ID NO: 5272 - DNA, 501 bp, Enterobacter cloacae
tactgtagagcctttgttcattggaaatcgtacagggaggcgcatatggaccgcatcaagtacctgaaatggatagctgaagaatcaccaagtacggctcagcagctggtggcctggttaaacagagcaaggcactatacgcccgacatgaaagagcatcaggcaggtgtacagattcaagaaaaggggattgttgtagggcttagacaaagtactaatcgttatcatggagattgtctgaccatacatgtggtacggcttccggaagaaatacaaaacaagggatggtttaagtcttttctgaagctttgctgtgaatcgaatccctggtgcgatgttgtaatagaagacgtgaaaaacccatatttattaagcttttgtaagaaactaaactttactgtattagatgaattttacccgaatacttacatagtaaacacagatgccattatgagtttacctatcccacccttagggagatacgaaacctatctttattaa

SEQ ID NO: 5273 - DNA, 273 bp, Enterobacter cloacae
tgggtacagaaaaggcagttgcttgcgctgggcgtaagttacccgccgaaaagcggctggatcgaacgactgatcggcactgaggtatctgacgagcagtacgaacgctttctggggcacagcacgagcaagcaggctgaacagatcctacgcggagagcagccagccaaggggcttcagtatgcaaagcgagcgaagaagctcgcttctgaaagaaaagccacaattgatctggataacgagcacctgtctgaaatcgaaaagtatcggtag

SEQ ID NO: 5274 - DNA, 444 bp, Enterobacter cloacae
aaaccggaagcagtgataacacaaacaggcccctacagcgtaaggattgtgatggacgataaagagcaatttacgaatcttgtggcaaagcatgcctccggactcaccgaagagcagctggccggttacgatgcctgttccctggatggtgaatgcgtcacgccttcatacgaggttttccgggggtatcgtacccgccataccctggatgaatttctggagatggccatatcgctgaatgccatccacccggatgaatatttaacggatatgctgcttaagcctcatgaggtgatcggcgctctggccgatgaaggcgaccagctgaacaacgccaccccggtttatttcttcccggataccggcgtctatgcagcggccgtcagtgaaacccgggtgctcgatgcctggctttgctggccatgctacccggcgaactggtaa

SEQ ID NO: 5275 - DNA, 408 bp, Enterobacter cloacae
ctgttctgtgctttgctcgccggtgggatagttcttgcctgcttaaacataactcaggaaggaaatctgatggcaactgaaattgaagtcatgactgtcgcggagctgcatgctcaactacaacagctggttgatgaggggcacggagatattccggtttgcgcgtcagatctccgtgccaggtatccatttaaggcttataccgtgctcagtaccgcaggctataccgaagcgctgctgattaatgtgtggccggatgcccattttacacgtaaagagcccctgcccactaactgggggaaaaaccgtgtagcagagtggaacagtgatgccgatgccgttcgccagtcctgcggggccttcgcagataatcctcaatcaagacaaatgacaggtgataatttatga

SEQ ID NO: 5276 - DNA, 573 bp, Enterobacter cloacae
gtcatgatttcttcatcacttttatggtgctctttttcacctatcacacagcaagttatgaatacgaggcctgtaatggacgctaccgaaactgaagagctcgaaaaaattcgcaagaaggcaatggatgaagttacaagtgctcttcaggcgcttgaaaataagttcccgggtattactgagggcgcagcagctttggcggggtcaggcgtaggcgcagcggcttcctttggtgctctctatacgcttggtacaactggagtgtcagcagctggcattacctccgggctcgcaacagcagggtctatcgtcggtggtggtatggttgcaggcattgcggtattggccgcacctgtagctgtgttagggattggcggctacgcggtggtgaaacacagaaaaaatgcgaaactgacagccgcccttagtcaggccatccaaaagctctacgaagttcaggaaaggctcatgtcgaatgcggaatattttaaggcagaaattgctggcatcaaggcaacaatcgacatgcttactaagaaagctccaaaaggtagcctggtcgcggtgaggtaa

SEQ ID NO: 5277 - DNA, 453 bp, Enterobacter cloacae
agagctaaaaaggacggtttcaattatatgaataaaacagcgttagttatgattctgggaatcctcggatgtggtaaagcatttgcagccactgaattacagctccagcaaaaacgcgttatgcatttctgtgccaatgccagccttccgttgttaattgccggtacaacttatgcgaatacgtctgacaatggacgaccagaaaaagaaagagtggcaatcctgaaaaatgcagttgtaagctcaacagcttattcaatggcatctcccggagttcagagggccatgatgagtgtggtggaagatattgccgatccgaaagaattagctcttcatcaaaaagaggttagacgtcttggggctagttatctttctgacagcggtgttacatgggcttcaaaaaccgtttcaccatttacagcctggtgtaactttaaccgtttcgaaagttaa

SEQ ID NO: 5278 - DNA, 204 bp, Enterobacter cloacae
atgcaaacccaaaaagaaattacagttggccagatctgggaagaagtggatccaagactgatccggaaagtgcgagttgttgaggtggcctcgttagaagggcccaaaggcatcctaatcgaaaacgtggagtctggtcgtaagaactgggcgtcgtcatcccgctttaatggaaagcgtggggggtatcgtcttatttcctga

SEQ ID NO: 5279 - DNA, 462 bp, Enterobacter cloacae
gcaacagcttcatgcgcgtttacaacaacgacaacggcacggaaattgcccgtttcgatctgtctgaagatgcctcaaccgaaaccgctatggtcttcggtgaactgtatcgtcatggcgctgagtggaagtttaaagctgtcggtcagggctttgccggtggcctggcggctcttgcctcccagcacggcgttaacatctaaaataacgctgaatcataccccggcaatgccggggttttttttggttgcgatccgctatcaggaggggggggggcagaaagggttcgggaatctcagaaagcagagagatgttaattctgacgtgagccttttaaaggcaggaaacggatttttctctggttgctggttaaagcctgtattccgtgccttatatcaacagcatgcccctctgatatatgttacgtttgcgacttatgaaggcacgggttctggaagataa

SEQ ID NO: 5280 - DNA, 210 bp, Enterobacter cloacae
acgagtctctttgagcctggttacagtgacccatttcctggaccattcatcaaattgtcgctggcgatcccgataacgttgttcttcctgctgacgaagccagtcgcgatcaacagcgaattttcggtatccaacaaagagcccttgtactttggccatgacaacattccggtttgcttagaactgttcagacagacatgtcagggataa

SEQ ID NO: 5281 - DNA, 225 bp, Enterobacter cloacae
gttcggctgcttcgcaagctgatttcatttggaagaacgcggaagacctgtgggggggatttcaagcataccgacttcggcaagatcattttgccgtttactctgctgcgtcgattggagtgcgcactggagtctacacgggaagcatcgctcgatagccaaccagccacgattgagttcttagaagcagagttcagtgttgatttcgatgcgctgctatcttga

SEQ ID NO: 5282 - DNA, 207 bp, Enterobacter cloacae
agggatgaggacatgcagcatgttacacgcttaacccccagatggtatgatgggcttgctttcacctttttgtccgaccgtcattacgttctgataattcgtgaggaacacggtatgagcaatgaagttacgaaagggatgctatcggctcaggtacgcggaggtattgtgcgtgactgttctgtgctttgctcgccggtgggatag

SEQ ID NO: 5283 - DNA, 1398 bp, Enterobacter cloacae
ggtaaacacatgagtcagtctccttatgatgatgagttcagggccatccgttatattcagctccgtggtcaggatatcgcgaacgctcacgagacaattagcagtgatatagagagccttaaggcacagttgaccgggctaatcagcggcactgaacttgatgaagcggagcatctggcgcttaaagaacatcatctgcgagaaatgactccttcagatactgccatgcattctactagtctcaagactatatatagcgaggctaaccagcgtgtatgcggtgatattggactgaccacaatactctccacggatgacctggctgttgtagatgcccggatccagaatcatattaaagaatttaatgatcgctacgcgctcgacgcctgggattatgctattgcctgcggatgtgggctcatagcatccatgctggatttactttgcgtcagagccccgccaaaacctacggtgagctttacggcagaagtggatggcattttcaataaacaggtgcagaaagccttcaatgccattttgccggaggacctgagtaaaaaactctcagaaatgttccctataggggcaccggacagttcgatcaccagcgatttagtgggcgcggccggtggcgttttgtctcccacaaatcaccgcttacgtgctttgtcacacgatcccatactgggcattattatcggcataaaggatatgctgaacgggacctgtacggtggttcagaatggacagatcgtggtttatccttccagtaaaggcgttactgacgaaacaaatattttcaggctcatcgccagaatgtttggacacctggcatcggatgttaatgccccctcagcaaaaggaaaccgtggcatgggtttaccggctccttttatggggctacttcgtatgcttgaggggatccctgtggggagttctaacttcggcaaacaaatagagtacatgtatgtcaacgggtatgactttcgtcagtttatcgtgacaagtattccgatgaccataatggaagttttgatgcgggttttctatgtggcgaaacaggtatcgctgggaaaaggagcttttggggagaccttactggataccatgccgttgcggctaaatccacgcttccggatgatgcttgccttgggttatggaacttccagtgctgttaacgcaggtaaaatgtatatcaccggcaatattctcaatgcgaattacgcctcctggatggggttggcctggaatggttttcactcactcaagtggtctctttatcagcgacacttaaagctttgggccggtattgaaaaggcagaactggaacggcttcagaacaatatagacagcatcgaggcattgaacatcagagcaggaaacttgccagtcaagtaa

SEQ ID NO: 5284 - DNA, 210 bp, Enterobacter cloacae
tatgacagactgaagccccggatagcgctcggcctttccatgaataaacagccgcttgtcatgaagatcacggatccttggcgcaaaagcgaatcccagcaggtgcatcagggcgaaaacatgttcagtgaagcctgcggtatcggtgtaatgctcggtaatttccagatcgctttcatggtacagcaggccatcaagcacgtgggttga

SEQ ID NO: 5285 - DNA, 384 bp, Enterobacter cloacae
gtccagatcgtacaccagcggtgtgattttacggccttcaaacagctcgcccacctcaatgcctggcttaaaatgaacggtcagggtggccggatctatacccataagatcggcatcaaacagcgcatgcattgttggagtcatcaggatgccattagacggattgtaccgggttccatgttcaatgtgtgccgcatccaggacaccaccattaacccaaccggttaccgcacaacggccagcgaaattctcgatgagcagagctttaaatttaccctgtgccacgccactacgttgcgtcactacgcgctcgcagtgctcaccctggatatctacgtcaggtttccgcattggttcgctggtggccgtctcaacttgttttag

SEQ ID NO: 5286 - DNA, 225 bp, Enterobacter cloacae
atccagcatggatgctatgagcccacatccgcaggcaatagcataatcccaggcgtcgagcgcgtagcgatcattaaattctttaatatgattctggatccgggcatctacaacagccaggtcatccgtggagagtattgtggtcagtccaatatcaccgcatacacgctggttagcctcgctatatatagtcttgagactagtagaatgcatggcagtatctga

SEQ ID NO: 5287 - DNA, 258 bp, Enterobacter cloacae
tttgtgggagacaaaacgccaccggccgcgcccactaaatcgctggtgatcgaactgtccggtgcccctatagggaacatttctgagagttttttactcaggtcctccggcaaaatggcattgaaggctttctgcacctgtttattgaaaatgccatccacttctgccgtaaagctcaccgtaggttttggcggggctctgacgcaaagtaaatccagcatggatgctatgagcccacatccgcaggcaatagcataa

SEQ ID NO: 5288 - DNA, 195 bp, Enterobacter cloacae
atagtggaaggtattgagacactgagtttgcagcttgatgagaatgaaactatggcccttgctcaattagttaaacgtctgagctggagcgatcttcgtggctgtgctgtgagtgacgaagaagcctgggtaatgaaaagcgcaattgaaaaattacaacaggcgttaagggaagaaggttatgcgcctcgatga

SEQ ID NO: 5289 - DNA, 282 bp, Enterobacter cloacae
aacgtgatcaatttaacaccttgccggttgaccgtaaagaaagatgcgctacatacaagtgtagcaccgttctgtacgtgtaaattcctgaatacggcgatggctgacgaatacgccgccctgtccctctcactcttcatcaaccgtaaaactgccatccgagtgtcaacaatgttaggatggttagcgattgataatgacggtaacaagcatgttagacaatgttttgagaattgccacacgccaaagtcctcttgcactctggcaggcacattatgttaa

SEQ ID NO: 5290 - DNA, 225 bp, Enterobacter cloacae
cttctcattattggccttaacggaaatttcgtttccctcaggaaaccaggtctgattatcagtgagcgcgaaaacggcccgcgagaacatctcaggtggctcgcttttcaatacaaaaccgtgtcccccggcggcattaactttgcgccagatatcattattgtcatccccgctgaccaccaggagtcgtacctgtgggtaaagttgttttacttctttgagtaa

SEQ ID NO: 5291 - DNA, 183 bp, Enterobacter cloacae
tttcagggccgttccggaagagagccaaaaatcgattaccagcaaacgtggcgggccatgatctctaatttgtcggtagcaatcatcctcattcgtcaccacacacgcctgtttaaactggcaatgtgtaatcagaaaattggcgatgccgcttgctaccaatggatggtcatcaacgactaa

SEQ ID NO: 5292 - DNA, 501 bp, Enterobacter cloacae
gctccattttttttgattttaaaattgcctcatgatattgtcaacgaatctcaccctttttccaaccccacccttttgaaattaaaggaaattaaaatgctgcccgacaatcttgtcccggcaaagtaccacattacgcctgtggaacagccttcgacggaagcagataaagaggcgaatttcactcaaggaaaaagaaaactctccgactatgaagccgacatattaattggtgtttcacgcactggcaaatcccgtaatatggtgctggaagagcacgatcgccatttaaaagagcgtttatttcgcgcgatcaagattgaagccttagttcatctgctgaatgatttacaggccgaaggggaaatagacgcccagacgctaagtcaaataatggtcgagaaaacgcagcaaataaatgaagccggcaatgaaatttggcttaatttaattacgcgtgaaaaaaacaatcccattttttataacctgggggaagattaa

SEQ ID NO: 5293 - DNA, 318 bp, Enterobacter cloacae
tttatgaaaaaaccactaatcgttttaaccgttacgttgatgttagccggttgttccacgttgaaaaccgatcaggctattccactcctgcaagcggaaaccgctaaaatgctgggactgggatcatcggatgaaataactgtgaccaatgttaatggcgcccagccggacgcactgggtggacaaaagctgtcttatcgcgccacgacggaaaaagggcgtattttcgattgctcatcaatgatgatgccggggattttaggatccgcaccgacactcagcgcgccaacctgtacacctgttgtcacacataaataa

SEQ ID NO: 5294 - DNA, 282 bp, Enterobacter cloacae
ccatcgcgcagaaagagaccggtggcgagaatcctggaggagaaaatcccggaggcgaaaaccctggcggtgagaatcctggtggtgaaaaccccggaggcgaaaaccctggcggtgagaatcctggcggtgaaaaccccggaggtgaaaatcctggcggtgagaatcctggtggtgaaaaccccggaggtgaaaacccgggcagcggcaagccgggcattttccagaccgtggcccaaagcagcaaccagtggaataccgctggcgcgctctccacgctga

SEQ ID NO: 5295 - DNA, 477 bp, Enterobacter cloacae
ttacgcgtgaaaaaaacaatcccattttttataacctgggggaagattaacgtgaatgatgatagcggtaataacgtttatttgactttagatgataaaaaaagcgatgaatttatcttaaagcagaatctcgacgccctgaaaaagataaaaaatgacgagatgacgcgaattacgcaggatttggtttcgattccggccacgctggtacgcctgaaatggcagaaccgtcgggagatttacgccttgcaggccaaggaggagatatacggcgcggtgatgaacgccattattgaacagcgtcctgagcttaaagagaagatcctcgggcgactggaggcgaactatcagtacctgctggcacgcgagacagccaccctgcgcctgacccgtaaactctcggaaggcaattaccgtacatcaaacgtgacctgtgtggcgcttgatgaagaggcgccgacggcgccttcagagtga

SEQ ID NO: 5296 - DNA, 528 bp, Enterobacter cloacae
aatcaaaaaaaatggagcctacccatgaacagcattttcttcacggtcataacgttactattactgaccgctggcgtgcttttattgatgcaagagttcaataaaacgaaagtgtcaaaagacgtcagtgaaccgccgcagcctgaattgatgtcgaaagaggagggggaagatcatttctccgtattgatgaacgccgtgacgccggtctggtactggcgagtaaatcacgaatatatcgatttcctccatgcgacaattaagcgaatgaaaatggccgaaattaatgatacgcccggcctgttcgacgcgcagcgccgctgtagcgaccttaattcggcggtctataaatattacgacaatatcaaaaagcgctgtctgaatggcgagaaggtgtcgtactccgatttagatgtattaaatctgcgccagtgttttcgtgagtttagcctggaagcctacccggaactggtcgcgctggtctggccggagtatgcgcgtccggatgtagatcccaacgaggtatag

SEQ ID NO: 5297 - DNA, 261 bp, Enterobacter cloacae
cgtctccggcatcaggatccagcacagtgcccgcggctcgaaaaagatatcccagtggcgaagctgaagcttccagcttatgtcgatatcctctgtgatcatatccgggctccagtacccgacatccgccagcgcctgtcggcgaaaggcggcgatgacgccggagacggtaaagacccggccatagatccgctgcgttcgcttgatgaggccaataatggaagaaaactcgcccacctgaatacgaccaatcagcgttga

SEQ ID NO: 5298 - DNA, 591 bp, Enterobacter cloacae
aagggatggttagtggcgacttcaatagtgttagtgactcaggattgtttccttgtcagggggatgcggctatttttcccggatataatttgcctcagttcgatagacagaaacatatttgataccgacgcaaatgaatatactgtactgattgatagccgtacgccgctccgtttatatgattacctgatacgccatccggccagaacgagaaaaacgatctgctgcgttatgctggatatgcgtcctcgagaggaggatcttctcagtatgaagctgtttatgaacacgtcgcttacggctccggatatggcgtcgttattcaatctggtgcttgatatgaaaggcaggcgtctgacaaccaaatggctgcttaacttacggctgagtcgacacgaagcgataatgatccggttgctgaaggcagggaggtcaatggaagagattgcagataagctgaatatgtcggttaaaagcctctatcgcaagcgaacggtgctgtcggagcggttaggggcagggaacttcaacgaggcgtgtttgtttatctttaaaaacaaactgctggacgcggttgggaacgatccctag

SEQ ID NO: 5299 - DNA, 213 bp, Enterobacter cloacae
agccatcacgcttctgcatggcaagcaggaaccgtcggaatgaggtttttccagagcttacaaaatgatggtatctctgctccggcgcagatccgtttgctaaacaacacctttcttcggctggtatttagctttagtgctgtgccctttgtgggtattcctttcgccatctggatttatatgcttggggacgacctcggcccaacgattatc

SEQ ID NO: 5300 - DNA, 333 bp, Enterobacter cloacae
aagcggatttttgatgtgacattgccggggaatgtgcggcctgatgccctcaccccaaccctctccctcaagggagagggggccgtctgtgcaggcattattttgtggggatccctcagctcacagggagagggcgcaaacactaaaaacggtaacggttgttaccgttttgcatctaccatggtcttaaacacttccgccaccgcgactgcccccggatccatcaccccgtccagattctctttattcacatacgacgagcgtcccgcgccggctttcgccatttttgccgttgcttcggcgccctgctgcgcggcctgcgctgccgcctga

SEQ ID NO: 5301 - DNA, 363 bp, Enterobacter cloacae
gcaggccgctcatccagaaagcttccagcggatttccaacttatcgggaattggtacacaggtcaaatggcaatcttatttatacaaaaatgtgctaaagagtgcttatctagttgtttttattgtgtatttaactatttttacaaccgcttaaagcaccgggcaggtgcaggggagtgtgatctgactcactatacgaaagcggtattatcgatgcagcgtgctgaaatgcagatttatagcagaatattaatctggtgttgcattcaatgccgcataaaatcactgtttttcagtcctggcgctataaatgaaaaaaaccatcagaacataaggaaaagtaattacgttcagggtgaatga

SEQ ID NO: 5302 - DNA, 264 bp, Enterobacter cloacae
cgtttcatacgcggacctcgcattcgccctctttttcatccttttgcgcaggtaaacaagtttgaggacttgcttcagagggaatctcaattactgcataaatatgatgagcaggccgctcatccagaaagcttccagcggatttccaacttatcgggaattggtacacaggtcaaatggcaatcttatttatacaaaaatgtgctaaagagtgcttatctagttgtttttattgtgtatttaactatttttacaaccgcttaa

SEQ ID NO: 5303 - DNA, 339 bp, Enterobacter cloacae
aaacagtatggcgtaggtaaaaccacaggtggtgtgaatattggtaactatatgcttttcatcaaaaataagaaagtcaccattgatgggcaagagggcgacgaaattttttcaaacgtcgactggaatggctctaaatgggaatcaggcggtgcggttcgcagcgacggtatctccattatcagtgccgcaaccacaggcacaacgacccctgttgcatttaccactgcggttttcccactggttacctctctggctattcaggggaccgatacgctggcgattactgacgatacatctttagatggtcaggcaacaattaccctgaaatacctttaa

SEQ ID NO: 5304 - DNA, 669 bp, Enterobacter cloacae
ctcttcagacggctgcattattgctcctttgagtgcgagaagaagcatctggaaaagcaacgatacggtgttgattgtcaaatgaagcgtttaatttgttcattgccattactcgttgcagtcagttcgcacgtctcagcatctgaaatgaccggcttcgcaacacagtattacgatgaagacggctcgctgacggaaatttcaaccatagtgcccctttccccgaccatcacgatcggcaagaaaacggttcagatggaagttactcatctgtctcagattttcagtacatacgtggagaaagacagctccgcgcactggatctgccttcatgacgacgatggcaccaattattggttcatttcagataacgaaatgggtgcagggctgttaactgcgctagccatatccagggatggcatccataaagagtgtgtgaatacaacggaacgagtcagtgtctcagtctctggcgttccattgttaaatgccactcacggggatttagttgaattgttcggcaaaaaaacaatcggcaacagaaaaaagatcctgctttatcaggagacacctgtacaggatggatttgttcagaacaataccgtctcttattactttgatggcgaaaaattgcgcggcgtaattatcgggcaaataaccagtaactag

SEQ ID NO: 5305 - DNA, 345 bp, Enterobacter cloacae
cgcggaggcagcatgacatatgaggaattaataaattcgccagccggtgagtttgtcatgtttgccagcaaggatggaaaagttcgcattgaatgccgcttcgaaagcgatacgttgtggctctcacaggccacgatctgtgagttatacggcaaagccaaagctacgatcagcgggcatatcaagaatatttttgatgagggtgaactggtcgaaaattcagttgttcggttttaccgaacaactgccagcgatggtaaagtatacaacgttcaatattttagcctgcccgttattctcaccatcggctatcgtcggcttattaaaatgggaaaagcaggctaa

SEQ ID NO: 5306 - DNA, 924 bp, Enterobacter cloacae
tttccgtcggtatataccttcggcgaattctgcgctcgcgacagattatccaatttattgttgccagtttctgatgccaggataatctgtaaacgttggttatcagatgagaaaattaaaatggatattgtacttttccctggtcagaacgcccgcgcatgggctgaaacaatgataaatcttgaagcccgcaagctcatcaatactgcgaatattgtcggagggcaacatctcagcgacggactcgcacggattaaatttatggatgatattcggcagtttgtgatgcaacaatttagtgctacccgggcagccagaagtgatgaggagtgcatggaatgcctgaaaaacatccgggctgagaacgaaagtcttcttgagcaaagcagaatgcttcgctcccgtacagctcagctttttgctcagattgaactggttaaagaaaataacaaagtcgtcggttacgttatctcatcgattaaggttgtgctttcagggttacagattgttgcaggtgttggtgcaatgatgacaatgaatccagtgggtgcgcttgcaggagcgattctggttatggatggtgcaaatgccatttcaaaagaaattaacagaacgcttcaacatcaaccaaactccgaaggtatgctggcagatggcgtcatggatatcgctcagtttatgggatttaaacgtgaatcagcacttggggtattcaatagcgtaagcctggcagcaagcgtctatacggtatttggcgccatccggaaacccgaatcatggcgtctgtttcgttatctcccgctggatttctaccgcaaagtcgacggaatgaatcgcgcagcgctcactatgaaaattgtcggctggggtgtctctgcaaaagtctcgtttgatttaatttctaatgcgtctggacagaactaa

SEQ ID NO: 5307 - DNA, 885 bp, Enterobacter cloacae
tcttccgccaaaaatacagctaaatctactttcagagttaataacatgtataaatatcttccctcagaaagaatcgatatacttgaaaataacttaatatgttttaataaccctttaaattttaacgacccatttgaattcaatacttcttttaactttagtagctttgaatccaatttatacgattcgttaagcactgtagaccttcttaaagaatttccagctgaattattaaatcagattgaaaaactgcctaaagaaattgtcagcaatatacttaaagatgcaaaaaaagcaatgctctcaatgtataaaaaagaaaaagaaaatataataagagcagcagatactacaatgcaaagttttaactcaaagttgataggaataacgagaattctatcattaacagaaacccctacgaatattttgatgtggggacactacgcacaggcccacagtgggtttattattgagtttgatatcaatcatccatttttctcacaacgtcgcggccaaaaaggtgaatttggttatttacgaaaagtcatatatcagaaagaatatccattcttggatccattctcaggcgatcaaataaatcatttcctaataaaaagcaaagactgggaatatgaacatgaatggcgaatgttgttaccacaggccaattctggtaaaacaattaatgtatgtgaaaaagagtttgatctctatgaactaccatccgatgctatcaaaacaataatttttggttgcaatacctcagaacattttaaaactaaaatgttcaggttaataagttcacgaaccgactatgaacatatcagttttatacaggctaaaaaatcaaattcaagatttgagattgtattagacccgttataa

SEQ ID NO: 5308 - DNA, 189 bp, Enterobacter cloacae
cttaccattcaaaatgggaatgctgaagaactttgcctgcttaaaaagaaagttatcgttgcgagatatatgtggtatgaattgatattaaaaaagtataaagttgatttatggttgttcttccattttaagaacaataatgacataaaaaatgtatcaagtatcaaaatggtgaatatcgttaaataa

SEQ ID NO: 5309 - DNA, 753 bp, Enterobacter cloacae
gcaatgatgcttttgccgcgtctctatgcgcgactctgcgcgcgccaggccgggcgcacgctgctggcaaaccggatcacgcaaaactacagccagtttatgcgctgcccggaggccgatgttccggctgattttctgcatcagaatgcgcatgagctgagcgggtttaacttcgtggagcagatcttcccgcccgcgctttgggcgcgcaacgttcgttttgatctgcacgggtacgtggcgcagtggacgcgggagcaggcattttacagttcatctcgcaccctgctactgggcatgcgctgggcgggctttggtctgatcgtggatgcgctgctcgccaccgcgccagccgatgtgcgctttcagtttattacccgtcaccctgcgctgcataagctgatggccgcgcacgaaggccgacgcgccagctcgtttttcgcccctcaccgcctggtgacggtgctgctgatggacgaacgcctgccggatgcgccgctgttctccacccaggcaggggatcaaaaggcgtggttaacggacgtctcaacgcggtttttatcgcgctatggctacagcgtccgaacgctgctgccgatctgttcgctgcacgcggcggagtttgggctggagagtcaggcgtatgcgccggaggattaccgtcaggccgccgccgacacgctgaacgcgctgcgcaaaacccccacgctctggagtgcatgggatgatctttcagtgatttatcatggatga

SEQ ID NO: 5310 - DNA, 363 bp, Enterobacter cloacae
tccacgttactttccagaagaaaaggtagtggcatgaacaatattgaaacgcagttacttgaatcaggtttcaccgtaaaagaattagcgtatctgaaccgaaacattagccgttatggttcatccctgctcgaggtagtgcttgagttaggtaagcgatttatcatggttctgtgtattactgcgactgtggccctgattttcctggcgcttctttttttcgctgaacattataatattgtttccggtggcatttctcttttcatcgtattgattattgcctggttttttcaacccccgatcattacctacaaagcctggcgcttcagaaagaaatacattagttctgtccagacgcattag

SEQ ID NO: 5311 - DNA, 207 bp, Enterobacter cloacae
agatatcttgctcttgtaggtacgtacatgtcaacagctaaacgcgaccctaatcagtcaaaatccggaaaagcaccaacttttcagattcgtattacgccggagttgaaggcgcagtttgaggctgcggcgaaggctgaagggatgagtttggggaattggttaaaaaatttaggtcgaaatgaattaaatagattaaaaaagtag

SEQ ID NO: 5312 - DNA, 192 bp, Enterobacter cloacae
atcagcaatgacgcgtgtcgcttgaggttaaaaaatgcgtttagtcgggtacactatcggaaatacgagatgagaatgacgaatgaaaaagaaaacatcgctcagcgaggaggatcaggctctcttccgccagctgatgaccgggacgcgtcaaatcacgcacgacaccattgtccatcgcccgcagcgtaa

SEQ ID NO: 5313 - DNA, 243 bp, Enterobacter cloacae
tcagacgctccagtacggtgcgttgctgcgtggagagcggttgttcgcctggcgtgttgggcgttacggggccttcacccggagggcgcggaggcgtacctgaaatgggctgcatcgtcaaaaatccttaaagtcaaactctgcgtaaccgggcggagatatatgcccggcggcgagattatggcacacttggtaggtttacttcctctcaaacaggtactcagacgtgaaaatcctcgttga

SEQ ID NO: 5314 - DNA, 222 bp, Enterobacter cloacae
gacgttgaattccaccggccgtcactatctcttcagggcgtttcatgcatgcagatcggtctacgcaacgtgctaccacgcggctatgtattcagtgcggactttttctcttacaacacggggcagaaagcgccctcgtcgaagaactttccacacgccttggtctggcgctggggatggacagcgttgagagctccatctcgtcaaatgccattgtactga

SEQ ID NO: 5315 - DNA, 354 bp, Enterobacter cloacae
ggtttccgcaaaggtgcgccgttaactatccataagataaattttccggggcggctggcgacgtcgtcaggcgcccccttaacgctggaaagtcttatggccccttcaccccgaagccgctcggctgaacgtctggttgacatcattattgccctgcaccgcaacggaagcgttaatcgccgcgatctgatgcaaaaatttggcattaccgaacgcacggtgtaccgcgatttgcaggcgctttccccgattattgaacacgacggcaaagggcgctatcagctgctgcctgcgtatcagacctgccgctgcgtgcactgccctgaagcgaacgacgaaaccccgcaggggtag

SEQ ID NO: 5316 - DNA, 198 bp, Enterobacter cloacae
cgataccccacgccgtgggctgtgcagcgcagtgtgataccgacaccatgctggcgctcaagcaccagctcgaacttttgcgccaacagcttcatcgcgcgtaaggctatactttacgcgcctgattttaacttaatacatcgcgcgctatttaatagtgcatataaacgtaagatgaggaacctgccatgtctttag

SEQ ID NO: 5317 - DNA, 204 bp, Enterobacter cloacae
agtatagccttacgcgcgatgaagctgttggcgcaaaagttcgagctggtgcttgagcgccagcatggtgtcggtatcacactgcgctgcacagcccacggcgtggggtatcgtcacggcctgctgttgcagcgcccgacccgcgtcgctcagggtgacggcgacctgacgctcatcctgacgggaacgctggcggaagattaa

SEQ ID NO: 5318 - DNA, 1626 bp, Enterobacter cloacae
tgccgctttagcggtactcattgtctctcaaggaaaacaatgatgattagctcatcgcatcatacccgcgaacagtttgaacactgtctggcggcgatccgtcaggcgtctgttgaaattttacttctgttgaatgtacatgtttctgaaggaaaagatccacgctggtttctggagcaactggatagcgcccgcctggggctgggcgggtggggcgctgtagccaggaagctgaacctgaatgatgcggaaatgacggcctttacgctgcaattacgcttgcttcagcagcgtgttccccagtatgaaagcgggcaggatgtcagcgaaaatcagctgattgcggcgatgcgcttcgtcacctcccttgaatatctgcgtctgcaacagcccctcctgacctacgaaaccgggagggtgccagagaaggagagccagcttcaggcgcagaaacaggtgcgtgccattgagctgatgattaaagggctgatacagcaggcgtggcccgacccggtgcggctgaataatcatcttaagacgttgtttaacgctgaacgcgtgcgtcgctggctgaaaaacggtgaaattaatgatgttctgagcggcatgttgttcagcgaactggcccagctgctggtagataaaaaagaatttagccgctactacgcgccgctgtttaacgccccggacatgctgacactgctggtagagccccgcaaaaccctgcaaaccttcctcgaagatattcgacaaatccgcaacagcatcaccgtgcagcagccgttaagcggagcgcaaatccagctgctcgactgctattacacgcagatcacccgctccgttcagcgcgcgtttgaggaagggcggacacgcgttaacccggcggcgctgatggcggtggacgaaagcgagctgcacgcgttctgggaaaaggcgcaaaaaatggaccgcaccacaggcggcgatctttttgaagtgcgcgacagtatagaaaaaccgactcagcgtgccacgcgtacgccagagcagcgcgaacagctgatttccggcgtgctgtggggagcggttggcgtgatggttatcgcgattgtcgtggggggattctggctggtgaacagcagtaaaccgcagccggctgtggccagtacggcatctcccgcaccggtgcaggagatgcgcgaaacgccttcctcgcgagaaacgctgacgcggatgggtgtcacctgggatgaaaacaacttccgttcagcgattagccgcaacgatacccgggtggcgctcctgtttttgcagggcgggatggactggaaaatgtcatggacggaggaggcgttgtcggcaggctacgacgatgtgctggaagtaatgttgcgctaccgcctgcaaatgacagagcaaaagccctgccgacgctttattaatacgcttagccatgcgatggcgaacggggaatcgctgacgcctatgcgtaagcagtacctgaaagcattctgtaccgtccctgcggtggtgaaacgccagcagcacgacgccgatatggcaacgcgccgcgcgaagacgcagcccgatgccagcacaaaaaaatggcagtccatccagactgccatttatgaggtgattcgttaa

SEQ ID NO: 5319 - DNA, 429 bp, Enterobacter cloacae
  unsure (34)
  unsure (282)
cattgcgtagattatatatatgtaagatttgacnaaaatagcatttttcaaaaacattacctacttaagaaaagagatgtatttaaagggaaagctcatcttgatacagaagtaatggctgattgggtagatactcaaaaagaaattaatttatttactctggattcgctcagcaatatcaataatacagatgaatttaacaggaaaggtaacgaaagattaaatgaaatatacgaatctcgccgggtacatggtaaagatattaaaaagaacaggaaaatngaacttgattcattaggacgaactcatgttgctaatggaagatctgaacccatacttccttcatccagtaatgttctgcttttgcctggccgggaggagaaacaaagatggttaaaaggtaagaagaagactgaggacgcagaataa

SEQ ID NO: 5320 - DNA, 333 bp, Enterobacter cloacae
aaagcgctacgcgttcgcctgttactacggaaaaagattagagatatgaaaatgcacgtaaagatcaccgcaaaactgatggccaaaatgcaccttgttctcgcgctggtatgggcgatactgactattcctaccctgctgtggtggaaaaacagcattctgtgggtgtcgttaatgagcatttacgccatcgtgatttcccatctggctgcgtacagcgccgcccatgcagaaaaagcggccagcaaggcgatggataaaagcgaaggcgccagccagaaagccaatcaaaccgccaacagccttcaaggcaatgcgcgtcaggcacattaa

SEQ ID NO: 5321 - DNA, 243 bp, Enterobacter cloacae
atgatttgctatttgttgggtaagccggagaggaaagagtgggaattgttcccggatatcaatcaccgagtcattaaactcagccagatagaaaaagttactttcgacagaagaaaggagatgatggtttcgaaacgtcttaaggccaaagactatcgaacggtttccacgggatttaacgtcctgagctctaagccagggctgataactttggccatagcccactcctatgccgtcacctag

SEQ ID NO: 5322 - DNA, 204 bp, Enterobacter cloacae
ggcgccataccatcctggatctggcacggaagatgtatcgaaaagcgcctgacacgttccagatcgaagttcaggagtggatttccgatcgccgttcgtccacgtgaaaagccgggcagggaaaaccgctacccggccgccgcggttaagaacgtaaatcaatcaccatacggccacggatctggccctgttccatctctttaa

SEQ ID NO: 5323 - DNA, 312 bp, Enterobacter cloacae
tgcaatatttgtttaacaggtgatcaacatttgtgcagcgtagttcacttttggtgcagtgtgcaggctgaagggtatctatttggtgaatacgtcagcctcttcacattttttggtaagatgaaagctctggggaaaaaagagggagccttacatggcgaatttgccctggcgggtcagcgtgcgcctgatggctctcgcaaaaaaaatagcgatggtcatcgggatcattgtgctcgttctgctttcggtgcgggtttatctttcgcagcaggggccagccctgcatcactggcacacctggcgggctga

SEQ ID NO: 5324 - DNA, 336 bp, Enterobacter cloacae
atttgtcgttttttcataaggcatgggcgtcggccaggagatcaattccacaatactgccccagggggtctgtccatagcagaaagcattcccttcaccttgctcatccggaaacgtgagcggctttggcgcggtaaacatctccccgccggcagcggtgaaagcggctatcgccttatcaaaatcatcaacataaacagcaaaatgctggaggccaaagtcgctggcgcgggcgggcattccctgttcagggccatgcatttcgaaaagttcaatgccgggtccatggggcataacaagcatgcgaatggcgtgaatttttgtgccgggaaataa

SEQ ID NO: 5325 - DNA, 534 bp, Enterobacter cloacae
caggagtttactatgccatcgtcagtaaggggcatcgaccatatcggtattacggtgcccgacattgaaaaagccaccctattttttgaacgcgctttcggcgcacaggttttatatcattctgtcgatgcggaaaccgataatattgatcaggccgcccagcagcacaccttaaaattatttcccggcacaaaaattcacgccattcgcatgcttgttatgccccatggacccggcattgaacttttcgaaatgcatggccctgaacagggaatgcccgcccgcgccagcgactttggcctccagcattttgctgtttatgttgatgattttgataaggcgatagccgctttcaccgctgccggcggggagatgtttaccgcgccaaagccgctcacgtttccggatgagcaaggtgaagggaatgctttctgctatggacagaccccctggggcagtattgtggaattgatctcctggccgacgcccatgccttatgaaaaaacgacaaatttacgccgctggaaaccctga

SEQ ID NO: 5326 - DNA, 207 bp, Enterobacter cloacae
ggtgtgcagtttctcactggtaataaacatccgaacagtcacgtcccgagtaggcgttaccagtttctgccggaacgagtgaaaggcggcccggaaagcgttcggttcagtactcacattcctgaaaatattgatgtacagcaggtaacattccgtcagtgtcataccccgggtgaggagtacactcatcactccgtttgtcagtga

SEQ ID NO: 5327 - DNA, 252 bp, Enterobacter cloacae
cggtatgtaccatatcagatgtatcctgagaaacatcatatattaacaatagcatatattgcgtttgtatcaacgcttatattcattttgagaacatgttcgcaattagttaattatctcgaagtaacggaaatatgtcagatattatattgtgattattattgtgtgggtattaatgatgttgttcattatttaaacaaaaaaagactgagggaccgttatccggaaaatgttgtatcgccaggaggataa

SEQ ID NO: 5328 - DNA, 849 bp, Enterobacter cloacae
gatttcggagaaaaaaagatgcgttatacccgaaccagcactgcaactgatgtcactgatacactcagacaataccaggctgacttgctgacaggtccttgctggatgtcggtatggccactgatagagcggctactgagtcgtgagaatgaaatgcagtcggtctggcagaatattgcccgtcaggcgctaacctggcagcaatgctattgtcttctggagcaaatcatactggcgggccgtttcagtagacctgatatcgtttcccgattgaaagaggattatcgccagcttgaagaactgaaccggactatcagtaaggaggccggtgaactggcacagaagatattggtccgagatgcgatcctgaaccggaacgcattcacacttgagagaaccacgcacatcgtggaactgatggagatggctgaagataatgatgggctttaccgttattatcttcatgaaacactcgatggcctgacctgtcgttatgacggaaaatactggccgggactccctggcgtcctgcaggttatagcaagggagcacccggaaattggatgtctatcagaaagcgatcgggccatcattaacgggcgcggcaaaatgctccccgattatctccgcgaattattcagtagcatcgagaacgtcaggcagggtccatggggtctgccgaaagaatttacgttgacggacagtagcctggctacgctggccactgtaacactggatcatactgaagtgttctccgctgatacggtaaaagtacgccggagtgaattcagcaaaagaggagagcggggagcatggccatttaagccactgaaggcagtcgatatgtag

SEQ ID NO: 5329 - DNA, 1740 bp, Enterobacter cloacae
gtggatcactttttacccgttgttgacagcaatccactcagcaccatccgcgaactgctatttctttacgaaatggaagatcgtttcagtgccgataaaaaaagactccgggtggccactgaactgctcgagttactcgagaccgatcaagttctcaggagagaagcatttgaggacatccccgctcaactggtgactcttctggacagagatttgctggttgaccccactcgcagcccggtggaaaagcgtcctcgtcttatctgtagcctatgtgtacaactggcggatatcaccgaggccagttatatcactgaggctcttgagatgcttgaacaggaactgtttgcatggccccctctggatgaacaccatgcacgggatatttactcactgacaaacggagtgatgagtgtactcctcacccggggtatgacactgacggaatgttacctgctgtacatcaatattttcaggaatgtgagtactgaaccgaacgctttccgggccgcctttcactcgttccggcagaaactggtaacgcctactcgggacgtgactgttcggatgtttattaccagtgagaaactgcacaccctacttaacacgcaaggacccacactgcagttcaacggatgtgtgttcatgccacttgatgaagcccgacaacgcttctccctctcagtcgatataccggtttgctcaatgtctgacacatctgcccgtaacatggccggtcagatgcttcgtgaatccctggatgtcattgcctacatggtaggtaagggagatatcaccgtccagaaacagttcatgataatcagggatgaagacgaaacagaagtgccgcgcttcgataatgaaatcgaggcaaacgcggaccggttaacggacgaggagtttgcgcgctttatggtggcgatgaaccgactgttcacggatacaccggatgtgtcccgtaaaaaaatcagctccgcatttcggtttttccgtaacggcattgaaagccaagttcaggagagtcgtttcaccgcttactggtcggcgcttgaatcattaacgctaggagttgcccctggcacaccatcacatgaacagcatgtcatcggtgttgtggctccctgtatggtgctggactatgttgttaagcaactgttttctctaagaaaagttctgcgcttcattctgcgagagccagggcaccccttgcgcacaccggagatcgcttcacttccgctggggcaactctatgcccttcttaaagatgcggaccgggtccgtgaacttcagacagatttacagcactttccctatgtcatgtatcgggtgcgtaagcttgccgggatctgtgcgtcacccgagaaaatggcggataaactggggcaacatgccgagaaagtcacccgacatcttcaccgcctgtatctgctgagaaataccatcgtgcacaatgcaggtaccagcccgcacattgacctgctgacggtgaaccttgaacactatctgcgggcaacaatcagcgcgttgtttaatattgtggtgatccacccaaccgtcagcaccgctgaggaggcatttacccggtgccagtttaccagtgagtcagttttcagggaactgaacccccttcacgggatcacggaaaagaaagtatacacagccattgataatcagttgaaaaacgggacgctttcccgtagcgatgctcgtttgatagcatggctcaatgcccaccactga

SEQ ID NO: 5330 - DNA, 225 bp, Enterobacter cloacae
gctcagcaggatttacttaacatcttacggaccattttcttcttttttattccggactgggaattcagtatgtaccccaatgaatcagcgatctggattatttatccgcaaaaaaacatgtcatataaagtaaggggttttattgattttattgattttattgattttattgattttattatcgatgaaatcggaactactccttactggaagcacggaaagtaa

SEQ ID NO: 5331 - DNA, 246 bp, Enterobacter cloacae
accttactgatgccgctgaaacatcagcggcattccttatttaatcaccggcgccggcgcaggcaatccgcttactgctgcataaatcccttttgtcattattccttcttaactaatggttcggcacatcggttaacgccattcaacgtaaccagcgtcagaagtaaagttgatttacgtattacaggattaaactatgtcaaagaaactttttggtgcccccccaaccctgacagacgccagtaa

SEQ ID NO: 5332 - DNA, 519 bp, Enterobacter cloacae
gaaacctgttgtaccagggcacagcaaaaacaccaaatcttatccagtgttaaacatcactgttatgcaggtggtaaggagaacctgatgaaactatttacgattggtttcacacaatcttcggcggaggatttttttacgcgtctgaaggaatccggagcaagacgtattctggatgtgcgtctcaataatcgctctcagctggcaggttttgcaaaacaggacgatctgaagttctttgcccgtactctgtgtgatatcgattacgcacatatgccagatcttgccccgacgcgggaaatgtttgagcgatacaaattacagaaaggagactgggatatatattcttcggatttcatcgatctgattacaaaaagacatatcgaaacgctcgaaaagagtcagtttgctgatgcttgcttattgtgtagcgaacataaaccacatcattgccacagacggctggttgctgagtacctggcagataaatggcctgatgtcactatcatgcatttatag

SEQ ID NO: 5333 - DNA, 204 bp, Enterobacter cloacae
cgcgttctgtgtgccgttctgacctgggactgcgcagcggtagatgcgaccacggagattaaactggtgctgcgcctcgctggcaccccgatcgacatagctatcgccgggcacgcaattgtcgccggtgccgtgctggtgacgaataatgcgctggagtttgagaggatatcgaccttggtacctgaggactgggttaactag

SEQ ID NO: 5334 - DNA, 210 bp, Enterobacter cloacae
ataatgttcaatgtcgcccgcaattttcccactgacaggatcaatccattttgcggattctataacatcatcaaaaagttcgaccctgatggcctgatgttcggaatcggcagggaatatatcaataacgtcaccgcgaacccggaacatcgcccgtcccagagttttgtctgtacgggcatactgcagacgtgccagttgatgaattaa

SEQ ID NO: 5335 - DNA, 492 bp, Enterobacter cloacae
aggacatttaaattgaacagaatgacaggactcgctgttttatgcctctcgctgatgggatgcagtgccgtgccatcagaaaacagtgcgcagtacctcagaacggaaatgcagtcgccagtatcaggggcaaccataattaccgtaactgcggacagccttatgaaacaagacaatacacataacgctatactgtatgcacttcgaccgatgcctggaaaagcattcacctctgagctggacagaaaatttgccgcagcgacgatgtatattgatttgtctccgggtgaaaaaagcagaacggccgagatcagtggtgagataaattactatgatcacgagcgatacgtgaatgctcgcctggtaggagacagtatcaggacaataccgattgcaccaaagaccatcccgcttacactgaataaaccattctcaatcaatctgccacaaggtattcactattcagtcatgctgacggacagccagccttaa

SEQ ID NO: 5336 - DNA, 411 bp, Enterobacter cloacae
aggaaacaatccatgtccaatccagttatttcaggcaatggcatcttctctcacgtctttatcggtgctgtagatgttcaaaagtcggctgagttttatgacgccactttaggtgcactcggtatcaacaaccttggtccttttggtaatggctgggtgttgtttggccgtgacaagccggctttcatcattgcccgtcctggcaatggtgaagcgccatccagcaatggtgtgacaattggctttgctgccgccacgcctgctgaagttgacgctttccatgccgcaggcctggctgctggcgggactgatgaaggccaaccgggtcctcgtggtcatctgccaggtgcttatgctgcctacctgcgtgatccggctggtaacaagatctgctcctataccttcatctga

SEQ ID NO: 5337 - DNA, 195 bp, Enterobacter cloacae
acgctgactaccgcaggcaggactttttcaagcatcggcgcaaggctgggaatggcttcttgtccaggcacctgcgaaggcagtgccgcactggcggggaaggacgccgagagagataacccgacacttaacgctaaggcgctcaacagctggttttttttcttcatcgatgctgactctcgtatcctggaatga

SEQ ID NO: 5338 - DNA, 216 bp, Enterobacter cloacae
tgttatgaaagggagagattttatcagatttcgttatcggaaaacatgcctggtcaacgccgcgcaaataaccttaaaagtaaattaaatgttatcaaaatgatgttgttttggtggcgtggcagggtgtattgtaaccccctcttaattcgttgttgcctacagcccgatagtattcaggtgaaggtgaaagacgtgcgacctcaaattctttag

SEQ ID NO: 5339 - DNA, 234 bp, Enterobacter cloacae
gtcgtccccccctacgcccatgtgaaacgcatcaagattcaaccagcagccagcctcttcccgcagcaagtgctgatgcgttgtctcatgcagctgccgctggctataacggctcagggagaaatggaactgtccctgcaactgatgggagccaaacgtcagctcgcgggtgtcgcagcgcaaaccgttctccgtcgggaagatatacggcgtctgcatctcttccagcggtaa

SEQ ID NO: 5340 - DNA, 234 bp, Enterobacter cloacae
acttctgaagaagagaaaatgaaacaacaactatcgactgccagtgactacaacgaggcctgcaatctgttacgttccggctacgtgaaacatgttcgtcttggctggaatgtaggaagtgatgagttctttcgaattgcgtctgactggtgtgataccggtgcaaaaataaagaaagaaggggataatttcattatttcgctgaaaggcttcccgattcctcctcaacattaa

SEQ ID NO: 5341 - DNA, 285 bp, Enterobacter cloacae
attaaacacgtgttccgaaaggatgtgacaatcatggttactgcggttttaaacgttaaaattgatgaagcgctaaaagaaagacttcgccactatgcggaagacaataatgagaatttaagcgtgaccacagagaaactgctgctgctggcatttgaagcagtagaagaggcgggagtatcggaagaggatgttgataatcagcatacggaagaagagagcgtaactccatttactcctaaagaaatcaaagcactacgtaaacttctgaagaagagaaaatga

SEQ ID NO: 5342 - DNA, 216 bp, Enterobacter cloacae
acagttacgaaacagttgataaaggtcgctactggcggtgcgtttaagcatgtccacttccagttgcgacaacatatccatagagccaagcgggctaatatgtgtaatcaagtgagctccttatgggacgattatcgtctttccctgttgattacaatagccctggcttatgacgtttcacaacacttcgggcggaataccgcccgcatattgtga

SEQ ID NO: 5343 - DNA, 261 bp, Enterobacter cloacae
agtatcttccaccactttgggcttatgccccaaaccacgttccccacgcccgtcaatgttgtgttcctgcacggtgagagaaccggtcactccttcatatacttttcccgtcactataaaacggcttctggccgtaccaaaaccaaacacaaatctctcattctgattaccctacaggtgctgtacagaatgaaccaggcgaaagctatgtttcaggagtgcaacaatgagtacattaagccacgcggcgagcagcgctga

SEQ ID NO: 5344 - DNA, 243 bp, Enterobacter cloacae
cgtttcacaacacttcgggcggaataccgcccgcatattgtgaaaatatttatcttactggcgcacaagtcgtccggtggcaggcacaaaatcggtattggtgcgccacgggttgatatccagaccgccgcgacgggtgtagcgggcgtaaacgctcaacttttcgggctggcagaaacgctggatgtcgttgaagatgcgctccacgcactgctcgtggaattcgttgtgatgacggaatga

SEQ ID NO: 5345 - DNA, 183 bp, Enterobacter cloacae
ggtaatcagaatgagagatttgtgtttggttttggtacggccagaagccgttttatagtgacgggaaaagtatatgaaggagtgaccggttctctcaccgtgcaggaacacaacattgacgggcgtggggaacgtggtttggggcataagcccaaagtggtggaagatacttcacggaattga

SEQ ID NO: 5346 - DNA, 234 bp, Enterobacter cloacae
tccactttgcttcatcctgaagccttcctgcggcgtcatcctgacgtgtccctggtaagaaacgccatcatcctgatgttcgtttctcgtgtcggcatcctgtcgacacagatagaatccgctattctgcttcgtcttacaacccaccttgtgagcaatgtaagccaggcgaaacgggggatttcctttcagaaaaccactaacttattgaaagagaagttaatattaatctga

SEQ ID NO: 5347 - DNA, 210 bp, Enterobacter cloacae
tgcccggaagcagactcgcccaggaacgttaacccttcaacccatttcacacgcgcttgcatattcactcactccaacgttgcattttttatgacagattacgtgtacgttacatttctcgcaacggaaggcgacctgcgtcatgctgaagcgagacaccaggagacacgcggcgaaagctatgctaaaacactctggatgctacagtaa

SEQ ID NO: 5348 - DNA, 243 bp, Enterobacter cloacae
cagattacgtgtacgttacatttctcgcaacggaaggcgacctgcgtcatgctgaagcgagacaccaggagacacgcggcgaaagctatgctaaaacactctggatgctacagtaatacattgacgttacacatgtatgcagaggacatcaaactttactggctgcgaaacgttacgacagccgacttcccaggtatgggtaagaattcgattgcaaccccagagtccggatgcatcttatga

SEQ ID NO: 5349 - DNA, 207 bp, Enterobacter cloacae
cgaaagatggctgtacgtaaacgctttatcgcgggcgcaaaatgcccatcctgccaggcgcaagatacgctggccatgtggcgtgaaaataatatcgatatcgttgaatgtgttaagtgcggtcaccagatgcgtgaggccgacaaagaagcccgcgatcatgttcgcaaagaagagcaagtgatcggcatttttcatccagactag

SEQ ID NO: 5350 - DNA, 264 bp, Enterobacter cloacae
attttttttcaggatcgcatcatttttttagccacagaaatactcttctctattagcgctattctcgccattaaaaaaaagaatctaaccgtaaactttcctgagttgaggccgataaccccactattcgttctacgtgtcgttacattaaggaataaatatggcaagtatttctacgttgggagtcggatcaggtttgcagttaggcgacattctggacagtctgaccgctgcacaaaaagcacagctgacgccgatctctaa

SEQ ID NO: 5351 - DNA, 222 bp, Enterobacter cloacae
atgaaacagtcctcattaataaacaccacgccgggcttgtgggcgtcacaagcggctgcgagttcttcaacggtgtgtgcatcgttgatgtctctctttctaacccctctgcttgctaagtacccggttaaccctagccgggtgtatctgcataaatccataatgatcgttgacatggcataccctcactcaatgcgtaacgataattcaccacctgcctga

SEQ ID NO: 5352 - DNA, 465 bp, Enterobacter cloacae
ggaaaatggtcaatgaaaacgttaatctctcttactgctctcctcggactagcctctgcttctgcctttgcagccactgcaccagagtgcgtaaaagctgataatcagcagattgaagcgctcttcgataaatggaatgcatcgctccagacaggcgatgcccataaggtggcggataattacctgagcgatgcggtattgctgccgacaatatcaaaccaggtcaggctgacggataaggaacgtgtggattacttcgaggattttctgaagaagaagccgttcggtaaaattgacagccgcaccattcgtctcggctgtaataaagccattgataccgggacatatacgtttactttcgcggataaaacatccgtaaccgcacgctatacctttacctacgcatgggacggaaaagcgtggaaaatctcatcgcaccactcttctgcgatgccagaagggtaa

SEQ ID NO: 5353 - DNA, 795 bp, Enterobacter cloacae
aacgtcggtttgggaacatcagccatacttaatgcgcggtccaacgagacttacccagctgatggtgtgctaactgtaggacagtttgggataggcgcggattggttgcccctgactactgattttaagactattgaaaaaggtggcatttatgctggcggtggcgctacaggagttaatttctttaacccgtacgcgcctgttctcgtcatgtgcagatatgccacctccgcaatgcaagctctacaggctgataacactacccttgcattcaacgtgaaggatgcaaatggctggaggggttgggttaagctttatagcgaatacaatacaattcgcgccagcgacggaacgctcaaggctgcatcgccggtgatcaaagtattttcagatggaacataccagactaacgatgaatctgagggctgcactgtaacccgtctggccacaggccaatatctggtggaagggtgtcaggggctgaactcagacgcagcatggggcggcatcgatggaggttttgacatccctaccgatcgcaacaagcaaccgcttatctggctggattatgaggttaacgccgttggttcggtactggtgaaaacctatcaccgtactcaccctgatgcgcctgcattcgccagaaacgaactggaaggcgtgggtgacggtgatcctgtcgacattccccgtgaccagtttgtgtcggtacgtgtcgaaatgccagccgattctttatacaaccaaaaaatcagagcagcagagctggccatgactgctgatgcgggtgaataa

SEQ ID NO: 5354 - DNA, 186 bp, Enterobacter cloacae
tgcctggaaaactccagctcttttgctgccccttattactgggatgattctcagctcatcacccgggcccagaagctcaaactcttcgtgtccgatattgcgacgatcccggaaaataacaaaatccagccccttcgcccgagcttctcgcagataagcatcaaagccatcaatggtgttagatag

SEQ ID NO: 5355 - DNA, 339 bp, Enterobacter cloacae
cctgatcaacaacgcggacgaagcgcgggaaaagtctcaacccccggcgtaaagtttctgatgtcgcttgcgctccggatggggcgcacgctctcagagcttcggcacaatatgacggcaagcgagcttctgatgtggattgagtacaacaggcaaagtccggttggcgatattcgcggtgacattcaggccgcccagatcgtctctgccatctacggttcgcagggggcaaaagtaccgctggacgatgcgatcctgcgctggggtggtgaggagcaatcagaaccgaatgacccgtttgcagggcttgaggctgcacttactgccgcgacgcagtga

SEQ ID NO: 5356 - DNA, 351 bp, Enterobacter cloacae
tgctggggaaccaaaatggaaattttactagtttcaattgttataggcttaattccagccttaattgctcaaagcaaaggaagatctttctttgcatggtgggtgtatggtgctctgctatttataattgcttttgtacattctttggtaataaagaaggatgttgcggcagaagaaaaagacttaattgaaaacgatggtatgaagaagtgcccattctgtgcagagttaatcaaaagcgaagctattaaatgtaagcactgtggtagtgatttagcagtcgattccccaccggttaagactgatgaagaatacctcgaagaagccaggcaaaaggtctggaaacaataa

SEQ ID NO: 5357 - DNA, 222 bp, Enterobacter cloacae
ggtgggaaatcttattgcggaagctgctgcctcactgtggtgaagagggtgctcttcattgacgtcctgtgcgacaccgataagcaaccggtattcagcgtagacgaagaagagcaggtgcgtgaaatctacggccccgtccattcacgcctgctcaaacaggcgcttgacctgatcaacaacgcggacgaagcgcgggaaaagtctcaacccccggcgtaa

SEQ ID NO: 5358 - DNA, 447 bp, Enterobacter cloacae
caagaggatctactgaaaggaatgatgagagatgtgtgggggcttaccgtagttgaatttattgctatcaagcggaatcttgagaatatttctgatacatggtcagatctctgggcaatgttgtatctgagtcaggctaagcccggacagcttcttggggcaaagtttgatgatgtgagccatgatattcttgttctttcagccacaaaaggactgagggaaagatgcattgctcttaagccaggagttaaaagaattctccactcccgcagggagaagtatcctgaagatgtgtttttgtttcagagccattcacatcgtaccaagacaactccaagaccggtaacgttagttgcatttaatgcggcactgaaaagggcatctattggagtgaccgcaaaaacagtgagtagtaaaagtgcttattatttaacgccactaagatga

SEQ ID NO: 5359 - DNA, 393 bp, Enterobacter cloacae
gggttcagatcgggagaatcacgggaacatggtaacgggaggcctcttacggagcctcttttttttcaggaggactggatggcggaatatggagttcagacatgggacgcctcaggcaaggtaaacaactatggcgttaagcctgtcagcgtttgtggctatctccagctggcccagaaccagaaaacaggctcttacaccgtagcgcttccaccgggttgcaggctgacctattttcagagcatgaacggcgatcagtttggtacgagtcggaggaagatcaccatttcggggggaacagcaacagtgtcagcagcaggtgataccgactactcagcagggactgagcctgcggcggcggcttatctcattttccagatcgagagggcataa

SEQ ID NO: 5360 - DNA, 672 bp, Enterobacter cloacae
atggcggagtatggcgttttactgacgaccacgagcggggaagtatgggtgaccgctaacagctcgccaatcgctctacaggcgcgaaagacagcggcacttcagggaacatcggggtttaataccaaagtgacgcacacattccccgcaggtcagcctgttgtcgcgttcgttcattgtacggttgaggtcgaaatcacccagacgataagcggtaacaccatcacgattgattttctcagaccgaatgcaaccggcacagcgtacgtttattttttctctattttcccgcagacaaagccagactacgggctggccgtgtgggatgcttcagggacgctgattttaacaaacgaaacgcgcacgctgagcgatgttgtcaccctcggtaccgccggggtggatgccagctcaggatacaacatcaatacaactctggcggggaagtgggcctgtatgcctgccatgctggggctaattaccggggttgtatccgccggcggtcagccgcaaccctactcggccatatacaagagcatggcaaagcttgagggaagcaatacgcggatattcgccaggccgcagacaacccccggcggcaaccttcagaacgttgcgtattcgaatctgaggaacgtgattatggccattaactgcgccaactatgattga

SEQ ID NO: 5361 - DNA, 1347 bp, Enterobacter cloacae
gcgccaacacgttcaccagcaccacctgccactaacccattcaattttgaacaaaccccgctccggcggggttttttattgcctggagaaaatatgctttataacaccggcactatcgccattaacggaaacaccgcaaccggcaccggcacaaacttcactgctgctggttctcttattcgtaacggctgtaccgttattgcaatgaccagccctgtgcaggtatttcagattaccaccatcggcagcgcaacaagtctcaccgtaacgccagcggctaacccagcagttcccgccggaacccgatttgccattcttctgagtgacagtctgagcgtggatggtctggcgcaggatattgctgaaaccttcacgatgtaccagcgctacatgagcgggttcgctgatgtaatgaacgggacatctgatgtcaccatcactatcaacggcactgtcgttaccgtgccgggtcaaaaatctctggcgaagaaaggggctaacagcgacattaccagcctttctgggctgaaaacagctctcagcattgggcagggcgggaccggggcaacgaatgccgctgacgctcgcacaaacctcggtttagacaaaacagtaaataccgaaggaaaccagtccatttcaggagagaaaaacttcactggccctttgaaaattaccgcagcatatccacaaattactttatggtcgactgcccagccaaacggcacttacggccgggtagttacattcggtagtgagggtaacaaaaccttcattgctgcacggcaatgggaaggcggaaataatacttgcgtgacctatctgcccacttttaaggacggttatttcacattctggacaacctcaaatacgacagtaacttctgacggaaccattaagcaggcttctcccattgccagaatcgttaagtctcaggaagagaaccggcgtacggatgttgaaaatgatggattcacatggtgcggctgcggcacggttaacgccgaggcagagggagtatctatttctcgccttgacacgggggtttacgaactcaccggttcggcaggcctggcgtctgatggatggcagttactgccgccaatggaccctggcggcatgggcgagatgggggttgttgaagcggagcaaactgaaagcggcggactaattatccgcctgtataagcagaaatacatgctgagcgatggcggcgagatcgtcaaaacgaaaggagaaccaatggacgtgccggtgagtagctggatcgatgttcgcctggatatgccgacggattcagttttcaaacgttcacagcagcgtctgcaaagtgatgaagagagttag

SEQ ID NO: 5362 - DNA, 207 bp, Enterobacter cloacae
aaatcgagacataattctgacaacaaggggtgggtcaaaattcaatgcaaatcccgggtcaaatttgggtgcaaatcaacagatatcgacaacctctcgcgcaaccaagacatcgcggtcggactgcaagtgatcttgaagccacgggcccgtcccaccccgacatggacctcgatgcccgaacggacgttagatttcgagttctag

SEQ ID NO: 5363 - DNA, 234 bp, Enterobacter cloacae
gccacgcaggttcgggtggcagtcgagccgcagcttggcgcacccctgcgttcgcgcggcatggcggcaagcctcgatcagcgcggagctgacaccccggcccgcatgtgtccgtcgcaccgcgagcttgtgcagatatgcggcctcccccttgagggcgtcgggccagaactcgggatcctcggccgacaaggtgcaacagccgacgatgccgtcgctgcaactcgcgactag

SEQ ID NO: 5364 - DNA, 324 bp, Enterobacter cloacae
cttgccaacgctgtctcgcgctgggtactgcggttcaaccaccttgctttgcaaatacttgcgaacggtgttcctggacaggccgcttcgtcgggctatttcccgaatcgacgcaccatcgcgaaaatgccagcgtcgaattgcgctcaatatcgccacgtttatcactccttgatttctcccgccatatccagacgggaaacagtgtcatacgtgggtcaaatttcgacgcaaatctttaccctaagttggggtgcggacaaaatcttggactactttaggagtagttcatgtattcgtatgaagatcgccttcgagccgtga

SEQ ID NO: 5365 - DNA, 1161 bp, Enterobacter cloacae
aactgtgcagctggtttggcatcccgcgtcagagtcagtttgcagatgccatttcacagcgaatttttggagaaaattaaaatgcagccacatgacacatttaccggctcataccagcccggtgacgtggaatttctgctaaagccggtagtcattgagatgacgccggttgagcaaaaagaagagctgattcagtcagggaagaaacattattcggacatgctcagtcaggagccagcgccaacacaatggcatcttgatttgtttcaccgggcgctggatcggggcgcagagagacttgcaaaagaagtcacacagctcgctattgctctggccgaacgcttcggtgatgagcccattgtactggccagtctcgtcagagctggcgtgccgctcggcgttatgctgcaccaggccctgcgtgacatggggaaaacctcatggcattacggtatcagcattatccgggatcgtggaattgacggtgcagccctcgacgtcattgaagagcgccatggtaccagcggtattgtctttgttgacggatggacaggtaaaggcgcaattaccggagagcttgtacgcgcactgaaagatcgcccgggctatcctgagcagccgcgactggttgtcctggccgatccctgtggctgctcctggcttgcagccagtgatgatgactggctcattccttttggcatcatgggtgcgccggtatcaggcctgatctcccggtcagtatggtcctctgaaggattacatgggtgcatggtttgcgagcatctcagtgaattcgaatgcagccggatgcttgtcgataccgtcgcccatttccgtaagaagttaaccccgtcatccctcgctaccctgagctggaatatggagtcagcccgggtcttatggcagacaagtcgcgacgttatcgcgttcctggccgatgaatttaaagtggacagcgtcaatcgtattaaacccggtattgctgaagcaacccgggctgtattacgtcgggtaccggaccatgtatttgtgcgttctattgacgacccggacgttgccttgcttgtagggcttgctcgtgaaaagggaatagttgttacagaaatggggggaaccctcggccagtatcgggctgtaaccattatcaagaaggtactctga

SEQ ID NO: 5366 - DNA, 1665 bp, Enterobacter cloacae
cttcgacgtaaacagagggagaggttgatgtcgcaaaatgctttacttgaagagaagattatccgcttagttctgtctgagctgggccaccctgttgaaggtgagcggcttttacttctatcgcaggacccatcccttaccgaagaaattatgcggcttaaagagcggattgagagccttgcacagggtttatctgcgcgggttagcgaaggtgataacgacgcagagattgccgcctcgtcagcatccagtctttccgatcagcaacaaacggtcgtaagtgttgctgataacccgggcattgacgctaccgatacatcagcactgcaacccctgccagaaaatgagcctcatcctccgttctggaagctgatgccttattacgaatttgataaaccagcacagagggaagacgaaaacctgtcttccctggtattaaaacccgggcagataccgacaggccagcagcgggccagcttagctgtgccacctgccgttcccccgagagctaaaataacgatccccaacgcccgcgcaggcgaacgtttctcttcgccggttgctatcgttctgggtgagggccagcaggctactgtcagggacgttgtctttccccggaacattggcctgtcttttgacaaagaacaggagttgctgacaggtactcccaccgaaagcggcgatatagagctttcagtaatctggtcatgcacgtcgcacgacgaatgtgaaacaaaacagctatttataatcaatcccgatccgagaagcctgtggaaggtggtagagccaccagcagacgctccctaccctaagtcccatctggacgctgctggcctggtcaggggtgatatacgtattgctgccgccagtcgccggggacgctctcatgagcatgccggaagcttcagagatgacgacttctacatcaaccactgccaggaaacaggatggtctgtcatgctggtcgcagacggagccggtagtgcggtaaattcccgggaaggctcccggattgcagtcaaaacggctggcgattaccttttaaatcagctcagtggtgtgaaaggcgtccatttaaagcagcacatcacggcgtgggaagggagcgatcagcaggcaacaataaacgccatgcttcatcattttaaacaggcagctacgctcgcggtcaacagtatccagaacgaagccatttgtgcagaacaacctgtgaaatcctattcaacaacccttctggcaactgtagcgctacgaactgataacgagctgtttgcggctgcattctggcttggtgatggtgcgataggtgcatacagcccttccggtaaagtcaggatactgggaaatcccgatagcggagaatacgcaggacaaacccgtttccttgaccagagcattatcgcagacccctcgtttagcggccgcatcagcgtgggtaaatggaatgatgtatctcacttgatcctcatgacagacggcgtctcagaccctctgtttgagacggataatgggcttcgcagtgacgaaaaatggacccgtctcgttgatgagctcaaccctgtccttacagacgccagtattgcgcctgagaggttaggcgactggcttaactttttctccacagggaaccatgatgaccgcactattgcggtgttgtggtaa

SEQ ID NO: 5367 - DNA, 228 bp, Enterobacter cloacae
ttcgaaaaacgcggcgtctgtccggaactgctgccgggcatctgcctgagccgtggcgagccgtttttcatgttcttctgcttcaaacttccagtttgcatactgttcggcccaggccgtccgttgttgctggtaccggtgctgtcgaagggtattctcacgctccacatcaatcagctcctgctgccaccggcgaagattttcggcgtggcgctcagctttagctga

SEQ ID NO: 5368 - DNA, 741 bp, Enterobacter cloacae
cgcttacatctgttcgtaaaggttaatgatttatgtgtggccgtctttctggacagggatcgtagcatttctgcgaagttaacctttgaccaccttcatccttccgaaagagttgccgcattgcgtatcgatcttcctgatattgaatatgaaatcagtcaggtgcagctcgggcgacgtaaaacaacatacagtgagtgcattgaaagcctgatcattgatgagaccagttcccgggaatggctatatcatccattaatgcatgaacttgaatctgaacctcttcaggagtatcggggacgggagccttcagaggaagggcctcttcttcagcgccttgctgactgtaagatgaaattgcctgatatccttccgggcagtcataacgcgctagtcaggttacagcaggatacgattgtatgtctgtgtcggttaacggttcgggcttatgacatcgctcagaccgatgaatttcctttgttccttcgctatttcaggttgcactgcctggaaaacagcgaacatgtcagttacgaaagactgatctgctggcaggaaatgatttcaaaaacccaggaaggccagtccttgacacaaaacgaacttgaatatcttcatgagattgtccgcatcgccttatacaatcaccggcttaacaatgtcagtatttcagatgttaaaaaccatgacacaggaaaggagagcagcagggtagagccacaaaactattcactcttataa

SEQ ID NO: 5369 - DNA, 261 bp, Enterobacter cloacae
acacgcagtttcagatccggattgtcctcgtcggcaatcagggttttcacttttttcgctgctgcttcggtaaattccagcggcaacgctacgtcatcactcatcttatgctcccatgaatactgcgactgctattgggcaaaaatcacccaattctttttgtcattatctaataccctggtaattcattcaagtattctgcttcagggcctgttcagcttcctgtttcgccaaggtacgggcaagaatggtggagtatag

SEQ ID NO: 5370 - DNA, 207 bp, Enterobacter cloacae
cgcggcatagtcgttgagcatctgctgtgcagcctgtccggcgcgttggggggtagggctgaagggcgcgaggtcacggagggtttgcgacacctgttcgatgctcaccgcgtccacccatttaaccgttattcccagcgaagagagctggtttacctgccgttcggcattaccgccgcgccaggcgagtaccagatcgggctttag

SEQ ID NO: 5371 - DNA, 972 bp, Enterobacter cloacae
atatgcatttctcgaggtataatgaaaattccgaaaaagaagaccggacacttcatcttatcggcccagacaaaaagagaaaatgctatggataatcacatctcatccagggctttgctacatcgaagggatgtcattaaaaacaacccgcgatttggtgaagctataacagaacactacagaattaatgatgtcatttataaaaaacaacccttgttctacaaaacgatgcttcaggaatcacgcttcaacataatattgtccatgtgttgttttgtttttggcaatcaggctgagtcagtttcagagattaaggcgctatgcacccgttacaatatcgccagccctaacagtgttatcgcgatcattaccatacttaaaactaccgggcgaataaagacctggcgctgtagtgaagatcgccgaaaaacaaaaattgcgccgacggaaaaaggactcgatgagcttaaacgctatatgtccggggcgtttacgcctgtcagcattctttatccggcattcaacattaatgttaaccttctcgacaatgacattctgaggcacaactttttccggcgcgccgcagagtaccttttccgcggattaacattcaggaaagtgcttccggaggtgggtttatttattgataaggatggtggacgaatgattatgctctatctctatttgcaggccattaaaaacaaaacagcacacggtgccataatagcgtattcagccagcacgctggcaaaagaatttttcgtctcgcgtattcacgtcaaccgcattatcaaatcggcgcaggaggcaggttatcttaaagatcgcggcgatggccggatgtcaatttatccggcctttatcgagcttgtcgaaaattatgccggattatattttgcctatgtcacacattacatcaatgtggtaccaaaagaacgacgccatgctgtcaacatgacgcctacactctga

SEQ ID NO: 5372 - DNA, 510 bp, Enterobacter cloacae
aaagaggaggccaatatgcgaataatcctaatgctgtgctgctttttggtacaaagtttaagctgggctggcgaactgccaaagcctgtgggcaaacccatcttaaccattaacggtaatatagaaaatacgaacgaaaatggaaatgccgtttttgatattgccagccttgaaaaactgggcatggtgagtttccagacgacctctccctggtataatggccgcacgaagtttgagggtatcccgatgcgcaaactcatggagtatgtgggtgcaaagggttctgtcctgaatgtgattgcactcaatgattacactaccgtcatccctctcagcgacttccagaaatacaacgccatcctggctttaaaggtcaatggcgaatatatgcgcatccgcgataaaggtccgtcattcatcgtctacccttatgacagtcttcctgaactcaataatcagatttattactcgcgatcggcatggcaggtcagcaaaatgaagattgaatag

SEQ ID NO: 5373 - DNA, 276 bp, Enterobacter cloacae
ttaaacaggttttccagtatgaatttatcccgtcaggaacaacgtaccttacacgttctcgccaaaggtggccgtattgtgcacgtccgcgatacctccggccgcgtcaccgccgttgaatgctatagccgcgaaggactactgctggctgactgcacgctcgccgttttcaaaaagctcaaaaccaaaaagctgatcaaatccgttaacggtcagccctaccgcattaacactacggggctgaacaacgttcgcgctcagcctgataatcgttga

SEQ ID NO: 5374 - DNA, 336 bp, Enterobacter cloacae
tcatcgatctcttcttcaacaaaaatcggcaacaccagatcgtttaaggtcagtgttgtctcttcaaacatggcgcgcagtgcgggtgacttgcgcaggcgacggggacgtgcaattaaatcggtcatggtatgcctgatgtttgtggaacaaagaggtatagtgtacctgaaagcagggagcggtgttttactaaagttgtcttttagattttcgaaatcgactaatatacgctgcatgtatttagtctatattataaatcttattctgatgttcagcgtggcgtgtaatattggtgaggcttctatattggtttgggattataaatataaatga

SEQ ID NO: 5375 - DNA, 768 bp, Enterobacter cloacae
cgaaaagccaataacataccacgatgcccggcgggtttcgcggccttctgccataatattttgagggatgctgaaggggggcgcgtgaaaggaaaaggtctgtttattcttattgttattgccgggatcgtcacggtgggctaccgctggttgccgtcgcagtacaaccctttcgtgccgcttacgcttgacgatccgcccggaaaaataacccagtttaaacttcggcgtttaaccccccaggcgtgcgaaagcctgttaacgcaggcgaaccaacgtcggcttatccgtacccaggcggtcgctgacagcgccggggagtgtccactgagtaacgtggtgcgcgtacgtgattttggcccggtcagtctgaacagcagctttcttgccagttgcccgctggcgttaagttcggcgctgtttgtcagccagcaggcccggccgctcaccaaaacctggacgggaagcgagcttgcgcgtattgaacatctgggcagctttgcctgccgcaatatctacagccgcccggatgcgcggcgcagcgaacatgccacggcggatgcgctggatatcagcgctttcaggctggcaaacggacagcgtgttaccgttctaaacggctggaaagcggaaaagacgcagccctggctacaggcgctgctctcggcaagctgtggttattacggtaacggtctgggaccggactataatgccgcccatgccaaccatttccatctgggaatgcgcggatatggattatgtcgatga

SEQ ID NO: 5376 - DNA, 351 bp, Enterobacter cloacae
ttatccagcgccggcgcgaatatattcctcttaacgggatgccctgggcctggtgatcgaatggtagatcgtgaatctacaacggcatttatcaaagataatcaagtttgtgtggtgtcaccactggagccacaggaacggatcactgctatccaaatcaacagtgataatagcgactctcttcacaatatttttgatgacaagcctgtttatgtaccgaagggtgagtgtcttcctgtattcggatttaagtttacacctggagagcggtataacttcgcgtatgacgtccaatctgctaaatcaggggcgtatttagtcactgctgaattttcttatcccaaagaataa

SEQ ID NO: 5377 - DNA, 195 bp, Enterobacter cloacae
cggccgacattaactatggtaaaggagaggcttatgtttcgttggggcattatatttctggttatcgcgttaattgccgccgcattgggctttggtggactggcgggtaccgcggcatgggcagcgaaaattgtcttcgtcgtcggtattattctgttcctggtcagcctgtttacgggtcgacgtcgcccgtag

SEQ ID NO: 5378 - DNA, 213 bp, Enterobacter cloacae
cgatacaggcgtgacgttaaacgcgtgacccttgaggctatcccgccgaaaaacaccgataaacatatgtggatcggctttaacctgagtcaggatctgcccaacggcatcaagaacatttctgtcgcccatacagccttcagggagctggatttcaaagtactgaatacccgtcgcgtaatgctcgaagtgaaacgtgcagacggctcgtga

SEQ ID NO: 5379 - DNA, 189 bp, Enterobacter cloacae
atgaaacatctgggtaaacatttactgatgactttttcgctaatggctacgctttttacgcctgcctcatggtccgccgatgagtgcctgctcaccctcaccccggtgctgagtgaccgccagtttaattacgtaggtgatacggtgacgctggaaagcaatttgatgtgggaagtgttgacgaagtaa

SEQ ID NO: 5380 - DNA, 207 bp, Enterobacter cloacae
gttaattctcatcatgcaaaaatcttacgtcacctgagctgtcttgtcggcaaacctgatattcatcgcataagccggaacttgctggtcaaatattctggtattggcgaattacagagtgatatcccatttttttattttgttatgttcctgcactttagtgagttttcttttcttccgacagaatacattttgtctacattataa

SEQ ID NO: 5381 - DNA, 534 bp, Enterobacter cloacae
aaggcagccatcatgtctactcgtcgtttttccactaccgcacttgccgtagtgttggctttaacgtttgcaacggctccggccatggctaatcctggtaacgggaatggcggtggtcacggaaacggtggcggacaaggtaatagcggcaatcatggtaacgggaactctggtaaccatggtaataagcacaataacggtcaggataaccctgggaaatcggataagagctttaaaaacagcaaagatgtcggtaatgatgtggatgctcgcgtaagcttcgatcatgcccgccatctggccctgaattacggcttaacgggctacgactctctgcctccgggtattgcgaaaaacctggcgcgcggtaagccactgcctccgggcattgcgaagaaaaccgtgccagccgatatgctgggtcagcttccttcctatccgggctatgaatggcgcgtggtaggttacgacctggtcctaattgcgctgagtacagcgattgtgacttccgttattaacggcgtctttaaatag

SEQ ID NO: 5382 - DNA, 255 bp, Enterobacter cloacae
gccgtaattcagggccagatggcgggcatgatcgaagcttacgcgagcatccacatcattaccgacatctttgctgtttttaaagctcttatccgatttcccagggttatcctgaccgttattgtgcttattaccatggttaccagagttcccgttaccatgattgccgctattaccttgtccgccaccgtttccgtgaccaccgccattcccgttaccaggattagccatggccggagccgttgcaaacgttaa

SEQ ID NO: 5383 - DNA, 207 bp, Enterobacter cloacae
ggaagttcagatttcgtgcgcatcatgccactggcaaaaacaaagtcaatccaccgattcaggcgtcacgcacgttatgcgccttgtcgatttaaaaaactcatcctgctaatgcaaagcctgctactgatattaattatctatttgtttttatttatttccgggaatttttacaacgaaacatcagtcgaaaaatttcatgaatga

SEQ ID NO: 5384 - DNA, 225 bp, Enterobacter cloacae
ctgaaatcacgcgttaaaaagcgtacaataaaggctccacgcaagtggggcctttttaacaccctcgcttcatcagtctcttttgtccgctatctatacttaatggataacagccaaaacagactcgacatagcctttgagctgtgcatctacataggcccccggatgggccaaattcggagatatcaccgcaatgtcaattattggtcgtattcactcctttga

SEQ ID NO: 5385 - DNA, 195 bp, Enterobacter cloacae; identical to SEQ ID NO: 4816

SEQ ID NO: 5386 - DNA, 198 bp, Enterobacter cloacae
gggcgtagctcagttggtagagcaccggtctccaaaaccgggtgtcgcgagttcgagtctctccgcccctgccatatagaatcctttgcttcggcaaaggatttttttttgcctgcaaaacagctcaacaccttcctgaagaataagcagcctgcgtttccgcaggcttttgcgttaatccagtatgctggtttttaa

SEQ ID NO: 5387 - DNA, 192 bp, Enterobacter cloacae
ctccaccatcttttactgcgaacacaagaaaacttcagagtgaacctgaaaaggtgcactgcgaagttttgctctttaaaaatctggatcaagctgaaaattgaaacgacacacagctcatgtgtgttcgagtctctcaaattttcgcaatcagaagtgaaacatcttcgggttgtgaggttaagcgactaa

SEQ ID NO: 5388 - DNA, 363 bp, Enterobacter cloacae
gtcgctgacccattatacaaaaggtacgcagtcacaccacgaaggtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacagcaagtgtgttttcgtgtacgggactatcaccctgtaccgtcggactttccagaccgttccactaacacacaagctgattcagactccgggctgctccccgttcgctcgccgctactgggggaatctcggttga

SEQ ID NO: 5389 - DNA, 225 bp, Enterobacter cloacae
ctaccgtttccagtagttatccccctccatcaggcagtttcccagacattactcacccgtccgccactcgtcagcaaagcagcaagctgtttcctgttaccgttcgacttgcatgtgttaggcctgccgccagcgttcaatctgagccatgatcaaactcttcaatttaaaagtttgatgctcaatgaattaaacttcgtaatgaattacgtgttcactcgttga

SEQ ID NO: 5390 - DNA, 219 bp, Enterobacter cloacae
gggggacaagggagcgcttctatgaaaaataaagacgagcagacaggattagttgggctggcgattggtgccgccgttatcgggctggtttcatcccagaagatcatcaaccgtgaaagtattgtcgatgaactggtaaggctcggcaggcagaagggggatggtgtcgaagatgaggtctttttaaaagcggctgagttagtgagaaaaggggtataa

SEQ ID NO: 5391 - DNA, 426 bp, Enterobacter cloacae
gcgatggctgacattcgtcatgcacagtgtcattgtggggcggtgaaatttacggttgagctgacggacggcctgaataccgcacgtcgatgtagctgctcgttttgcaggatgcgtggggcggtcgtggtttcagcgcctttgacgggcattaaggtgacgcagggcgcggacacgctcacagagtaccgtttcaacaccggcacggcgcgccatttcttctgttcgatttgcggtatttacacgttccaccaacgacgttccaatcccaatgaatatggtgtgaatgtcgcctgtctggaaaatgtcacgccattcgacttcccggaagtggcggtaatggatggagtaaatcaccctatggatggcgacagcggggtatttggctatctctctttccgtaaagaacagacgaaacagcgatga

SEQ ID NO: 5392 - DNA, 195 bp, Enterobacter cloacae
cagcacagacgtattggcctgacaaataacgaatcactatcaggttattctaaagccgtacatttcgctggttttagcatcaccccgcagaaaccgatttgccttaaggttcattattcgtcaagcacaaccatcacgatcaatgccgcaagaaatcgtcccttttatcgtctcctccgccgtttgcttgcttag

SEQ ID NO: 5393 - DNA, 1359 bp, Enterobacter cloacae
agaagtctacaggaccaaatcgtggcaaaaacacttttacgcagcggtaatctggatgattttcaggccgttggtggcggcggacaggccgtttttgaatcagcgctgcaaatccgcgaagcgcttcggttgcgcaaacaacaggctatcgtcgattgtctggccatcccccaggtctacgacggcggcgatcgcgttgactggtactccccggttgagggaaccgtctccagctggaaggcggcggatgaagatgatcgttatcgcgccctacgctatctggaaaacacgctcgccagcgtggagtcgctgagtaaaaaatgccttcagtcaccgaaaacggcgcagcaactgtttggctctctgctctcaaaagcctttcagtttcccggtgaaaactttgttttcctggtggatggcaaaccggttatctgcttctggggtttcgtcaatcttaacgagaacgcgcgcgaggacgtgctggactgcctgcgcgaatcgttggtccctgaacctgagccagtggtgattaacgagcctgaacctgaacaggagcaagaaccggccccggtagtgacctttgagcatgccgacgcgccgcttatcacgcctgtggcttccgtccgtatcaccgaagatgaactgtatacgccagagccggtgcgcatgaacgccgcgccgccagagcccgcaccggtggccatgcagaaaaaacgtcgctcccccctgtggttgctgccggttgccgccgtcattattgcggccattgccaccccgctgctttggccaaaacaggccccgaccgctgcgcctgttgccacaccagcgccagtgcctgtcgccattgctccggcccccgtaaagacggtcgagccgcttgagctgaaactcccgctgcaccaggctgaagtggtagagccgaaggtgaaaacgcctgcaccggcagccgaaccagtggtcattaccgcgataccgaaagatgcgatggtgatggaggcaaaccaggtcaaagcggggttaacgcgcttcctgaatggcacctggcgcgcgtttctcgatgtgcaggatccgctcaccggcaaaccgccgtcgctgcgctaccagatccagaacaataaaggtttcgcccgggttgtgcatggcgacaacattgtctgccgggtagacgtcttttccggattacacagcaaaggcgagctgttgatcaaaacgcgcggaaacgctcgttgcaccgacggttcacgctatccgatgccggaagtgacctgtaaggcaggtgccagcgacgtggcggaatgcaccgcacgttacgatgccaacaccatcgttcctctgacgttcaagaaagcaggtgtctga

SEQ ID NO: 5394 - DNA, 2247 bp, Enterobacter cloacae
actgaatactctggccgatcgccgacacagcggcagccactactggatcgacagcgggagcgtatacctcaaatgactgcgacgactgccaccactcaggccttaatcgggtggatcaacgagacgcgacagcacgccccgatgctggataacgaagccgacgccctgcttgcccgccttaacgcactaagcgcgcgtgaagaggcgctcgatcgcgcccttgtcagccagggcagtatcggcctatatggccactcgcaggccgcgaaagcgcacctgctggctgccctgtgcggcagcggggacgaacggctgaacgtaacgccgggtcaacgcacgtttgattacttctcgcatattaaccccgggcatgcaccgaccaacatggccgtgcgtttcagcagagcgtcccgcgaggtcgcagacgacgcgtttcccctgcgcctgcgcctggtaacggaggccgagctggtgcagctgtttatcgcgcgcaccacgctggatccgcagatccgcgcggtggataaatcggtgattgaagcacggcttgagaagtggcgggcgctgcgtcaaccgcagagcgtgccgggaatgacggcgcgggaagtcgcgaccatagcccgattctggcaaagcgtagtacccggcgctaagcagcatattgatgatgccctgtggcaccagtttgctctgctggttccgtcgcttgatctcagcacccgcgccagcgtctggtctctgctgtggggtgagcagcaggagttaacccagcagtggcttaaattcgcccaggtgctgcatcaaaccagccatgccagcgcacttgcggcgccgttgagtctgctggtggacagctttggtctaccctgcgaaggctttcttactcacggggcgtttaccgtgccggaagcacaggaaacactgcttcatccgataaaaaacggcgagctgcttaacgccattagcctgcccgttgatgtactggcatctctgacccgcgaagtggtgctgcccgttgagaactgcgtgctggataacgttgacgtcattgatattccggccattcctgaggaaaacacgccgctgatgatgcaggcaaaatgcctgtggttgctggagcattatcgtcagcacattcagccggatgtactggttatctgcaatgcaacggcgcatcaccagcagaccgcgaaaacggcaaggctcctgcaaaactgggtcaaagagacgcagccggttgaagaatccgcgttgccggggctggtctgggccattacccctcatgatgcgcggtttaccacaaagcagaatctggacgaagcggtgcagcagttgctgggccagccgggtctgcgctggggcacgcttcaggcgctcgatagccacagcatgcagcgagtgattgagtggctgtcgcaggctaccctgccggcacagcgccagaagcgtctccgcgcgctgaaaaggctgttacaagagtcgctgtcgacgctgatgcgcccatatgtcgcgcctctcactcaggagccaggcgcagggcgggcaatggccgaaaaaatggtccgaacgctgcaaggcagtgccgctcgtcatggtgaactgcttgaggggcttctgccgccgttaaacgcgtttgagacactgctgaccgtccaccagcctcgtgaggaacaggtcaacggcctgtttaacgatgttatcgatctgtttgcggaagagacgcaggaaaatccaggcgcgttgcagaccaaagacaaagcgcggctggcccataacgtgtgggttaaccatcttcgtcagtggagtcgcaacgacgcggcggctgcccgtctgggcctggacgcagaggtattacagcagattgcggatgtgctgatcgttaccagctaccggctggatctgcctctgcaactgcaacgcattgcagaaaaagataaaagcagcgccgcgcagctgcatgccgcgacaggcaatttcattagctggcttggctatgaactgacacccgtctctgaacggcctgcaagccggatccgcaaaggtgagccaatttttgtgacgcccgttgtgagcagcgcttcaccccgtcttacccgacttggcgagcagcctgtccatgcggcgacagcctatgtttatgactggttggttgcgctctacacccgcgcgattgagaacgtggattatcagtgtccgtatgacgttcagcctgcggcacggaaagccttgtctgccttgctgtcttaa

SEQ ID NO: 5395 - DNA, 3009 bp, Enterobacter cloacae
cgttcaagaaagcaggtgtctgatcctatgctggttaatctttgcgactataaacagagcgtgacgctgattgctaacagcggcgtgcagtttctcgattttggcctgactccgcaggacacctccagcaacgggcgtttcgtgcgtaaaacggcaaatggcccgctgttgcgcctggattttgatctggttaacggccggtacacgctgcctgccaccgatggcgggcagccggaagtggtcaagcctgaaagcaccattccactgcataactccctgaacgtgctggacggcgtctggctgccgctccctttcctgcgctttaacccgccgcggacgtttgttgatggtccggataactgggcgcgcgtccaggtacgaaagctttcaactcccgacgcggctggcaatacgcaccgggtcaccgtcgcgctcgacagccagattgcagagcatgcaacgtctgccctgtcgccggttgaaaacgatatccttaacggcacgcgtttcgcgctcgcctggcgcgacagtgaggttgagagtttccttgaccagacctggattgacggctggctgcgcgaagcctttacgcagtttgccgacggggttgaaaaacgctccgagcgcgagctgcatcaggccatgcgaagctttgaatatcaggcacactggctcaacctgctctccatgctcggggaacaactcaccgtgccggaagtgaagtttgtcacccataccctgagcacccctgctatttctgtcgatctgatccttgacgtaggcaacacccacacctgcggcgtgattattgaagatcatggtgatgccaacgacggcctgcgccagacggctgaacttcaggtacgatctctgagtgagccacagttcctgaatgagccgctgtttaccagccgtcttgaattttccgaagcgcgttttggcaagcagcacttctcggtggaaagcggccgggaggatgcattcgtctggccgtccattgtccgcgtgggtgatgaagcgcgtaagctggcaatgcagcgtctgggcacggaaggcaacagtggaatttccagcccgcgtcgctatctgtgggacgagacgccggtggtgcaggactggcgctttagccagatgaacagcaaaacccagcgcgaaccgctggcaactgcgtttccgctgatgaacctgatgaacgacgacggggaaccactctttacgctgccgcaggatgagcgtctgccggtgttctctccgcagtacagccgcagcaccctgatgacgcacatgctctgcgagctgctggctcaggcgcttggccagattaacagcgtggccacccgcttgcggctcggcttcccggcctctccccgccagctgcggacgctgatcctcaccctgccttcagcaatgccgaaacaggagcgcgagattttccgtcgccgcatgttcgaagccatcgccatcgtctggaaagcgatgggctggcacccgcaggatgaagattttgccagccgcaagcagcaggaaaaaagcgtggtgccggtccctgagatccagatggagtgggacgaggccagctgcggccagctggtgtggctgtataacgaagccatttcccatttcggtggccagaccgaggcctttttcgcctccctcgcccgtccggatcgcgcgcctgagcctggcgtcctgccggggcgtgcgctgcgcgtggcctcgattgatatcggcggcggcacgacggatatggccatcacgcactatcagttagatgatggttccggaaataacgtcaaaatcaccccgcagctgctgttccgcgaagggttcaaggtcgctggcgatgatacgctgctggacgtgatccagcgctacgttctgcccgcgctgcaaacccagcttcagaaatccggcatagccgatgcctcccaactgatggcatccctgttcggtgattccgggcggatcgatacccaggcggtcctgcgccagcagacggcgcttcagctttttatgccgataggtcacgcgatcctggcggcgtgggaatcgagcgatgttgacgatccgctggccgggctgcatgccacctttggcgacctgcttacgcaaaaaccgacgcgcaacgtgatgaattatctccagcaggcgattgaccatgcgttgcctgccggctcagaacactttgatctgttcagcgtaccgctgcacgtcagctttcgggagatgcgggacgccatgctggcgggtcagttcacgcttgccgccccgcttcatgcggtatgtgaggcgatctctcactacagctgcgatatcctgctgatcacgggacggccgggctgcctgccgggcgttcaggccctgattcgccacctgcaaccggtgcccgtcaaccgcatcgtctggctggataaatatcaggttcatgaatggtatccgttcagccagcagggacggatcggcaacccgaaatccaccgctgcggtaggagcgatgctctgtagcctggcgctggatcttcgtctgccgcgttttaactttaaagcagcggatatcggcgcgtactctacggtgcgctatctgggcgtgctggataacacgatcaatactctgcgggacgagaacgtctggtatcacgatatcgacctcgataaacccggcgcgaaactggacgcccgtctgcacttcccgctgcgcggcaacgttacgctcggcttccggcagctggccaatgcccgctggcccgcgacgccgctctataccctgagcatcaactctgccgagctggcgaaagccattgcgggcgacggcgtactgaacgtgcgcctgaagctgcgtggcggcactaagcaggaaggtccggaatctttcgagctgagtgatgcctggctacaggacggcacgccagtgccgccggatgccctgacctttaaactgaatactctggccgatcgccgacacagcggcagccactactggatcgacagcgggagcgtatacctcaaatga

SEQ ID NO: 5396 - DNA, 1971 bp, Enterobacter cloacae
aactcaactttttcctgtctgatcgtctttataaaccacctttttaaattttctcaactggaggtttattcatcgttcatgcctgtgacatggctaacatttctgcaccttgcggattcactatgctttgccgcagttgattacgagggcgaaccgatgtgggcggcaaacaaagaaaaatcaaatccgttgtcttcacgccaggaggtagtggcgtcgttgaatgcacttttacaggcgctggacacgcaatttccggcgaaccgttcacgattcccgctgggcgacacctgcgcccattacacagcggatattgcgcagatggagggactttcccgcgcgctgtgggggctgtttccgctgatggcatctggcgaaagcacgccgttcagcgagaagtaccttactgccattaagcttggtaccgacccgcaaagcagcggttactggggtgaaaccggcccgtacgatcagcgtctggtggagatggcggcctacggtctggggctcgctctgatgggggagacgctcaccgcgcgctttaccggtcgcgaggtgatgaacctgcacgcgtggctcaaccaaatcaccgaagcgcagatgcctgacagcaactggaactattttgccattatggttcagctaggctttaagcgcgccggcctgccgtacgatcaggacgccattgaccaccgcttcgcgctgatggacgcctactacctcggcgacggctggtattccgacggtcccggccgcccgaaagattactacatctccatggctttccatttctacggcctgatttacgccaccctgagtaacgacgaggcgagggcgaatgtgctgcgcgagcgctcgcgcctcttcgcggaagactttatctactggtccgccgccgatggcgcctcggtgccgtttggccgcagcctgacctaccgctttgccatggttgccttctggagcgcggtggccttttctcagctggacgtcttcaccccgggcatcgtgaaaggcattgtgctgcggcatctgcgctggtggcagcagcagtcgattgtcgatcgcgacggcattctcaccctggggtttgcgtatccgaacctggcgatgtgcgaggattacaactcccccggttcaccgtactgggcgctgaaaacctatctgatcctggcgctgccggaagcacacccgttctggcaggcggaagaacaaccgctgcccgcgcttgatgaaaaacatgtgatcccgcatgcgcagcagatcctgatgcattcgaaagattcgcagcacgtcgtcatgctcaccgccggtcagctggaactgaacaactacgtcaacaccgaagcgaaatacaccaaatttgcctactccagccgcttcggattcacccttgagcgcgggcgttttggcctgaagcatgccgcctgcgattccatgctgctgctggcggacggagatgactatttccgcggtcgtcgcgagtgcgaagaggttcgggtggatgaaaattacattttctcgcgctggtcgccgtggcgcgacgtgcagattgcgacctggcagatcccgttcggggagtggcacctgcgcctgcaccgtatcaacagcacgcgcactctgcaaaccgtcgagggcggctttgcggtgatgaaaaccgcccaccaggtgcgcgaacgcggttgttatctgttggctgaaaacggcagcagcgtcattgtcgatctttcgccgatcattcagcgccagccagacagcatcgtcacgccgccgaacagcagcattatgtttgcggagtgcgcctccattccgctgttaaaagctgacctcccgcaaggggaaagctggctctgttgcgccgttctggctggcggaagacagctcgctgcggcgacgccgcagctgaatataacccatagccgggtcgtcattagcgaacccggaagcgaacgtaagctgtcgttcacattataa

SEQ ID NO: 5397 - DNA, 1236 bp, Enterobacter cloacae
cagaaacgtcaacacgataaattacgccgtcaaagaaggaaccgaaatatgttaagtcgtatcaaagaagaacgtctgcctgttatcgctgcgcccgttgactcccgcgcattcagcgatgaactgaattcggcgcgcagccacgttctggacctgattagccgtcatttaacggagttcggcgacaaattcccggcggaaacctgccagaacggtttttatccgctgactgacaacgtggagtggaccaccagcttctggaccgggcagctgtggctggcgtgggagatgagcggcgaggaaaaattccgtgcgatggcggaaaaacacgtgcgctcgtttggcctgcgcatcgccgggcgcaacgacaccaatacccacgatttaggcttcctttacacgctctcctgcgtagccgcgtggcggctgaccggaaaccgcgaggcgcgcggcttctcgctgctggcggcggaagccctgctggaacgcttccacgagaaggcgaagatcatccaggcgtggggcgatctctccgatccggagcaggccgggcgaatgatcatcgactgcaacatgaacctgccgctgctctactgggcaacggagcagacgggcgatccgcgctttgccgacgccgcaaaagcgcacgtcatgcaggcggcgacgtatctcattcgtgacgatgcctccaccttccacacctactatatggatgtggcaaccggcgcaccgcgctacggcaacacccagcagggctacgccgacgactcctgctggtcgcgcgggcaggcgtggggcatttacggtttcctgctgagctatatctataccggcgacgaaacgatgatcgctctgtcaaaacggctggcgaactacttcctcaatcgcctgccggaagactacgtctgccactgggatctggcgctggtgggcaccgacgcgctgcgtgactcttcctcggcggcgattgcggtatgtgggctgctggagctggtaaaacacctgccggtcacggatccggatcgcgaacgttacctcgaatgggcgaaagggattatgtccacgctgacaaagcactatctgatgggcaaagaagagaagggcaacgggctgcttaagcactcggtgtatcacctggcgagcaataaaggcgtggatgagtgcgcgagctggggcgattacttctacgtcgaggcgctggtgcgcttcacccagagctggaagctgtactggtaa

SEQ ID NO: 5398 - DNA, 567 bp, Enterobacter cloacae
cgtctgaggctattggttcacgtcgcgcagaggaacagcatgaaaatcgcttgtcttggctggggctcgttaatctggaaaagcggcgcgctaccggtagccggtgagtggcaaaccgacgggccttctttgcccgtcgagttctgtcgggtcagtgatggcggtgaactggcgaccgccatctgtatgaatgcccctgccgtgccggtgctttgggcatggctggaggccacaacgttgagcgtggcctgccgcgctttgcgtgagcgcgaagccattcccgaggatcgctgcgatggcattggctcgttgctaatcaccggacgcgacacgggtatcctgacaacatgggccagggagaaaggtattgaagcgatcatctggaccgggctcccgccgagaagcgcgtcacaggaaggcagggttcctgccgtggacgaagccatcgcttatctcgacggcctcagcggagagacccgcagccatgcgcgggactatatttgccgcgtgcctgcccagcttgatacgccctaccgacgcgccattaaagaggtgcttgggtggtga

SEQ ID NO: 5399 - DNA, 195 bp, Enterobacter cloacae
ggtcggctaccatggcgtcatcatcgacaattaacacatttatcacgcgatattcctctcgctatcccaggggatctgaacaaaaaattgggtaaatacgccaggttcagactcgacggtaatatctccgcccagattctggatctgctgacgcgcaaggaacagcccaacgccgcggttttcaccttttgttga

SEQ ID NO: 5400 - DNA, 249 bp, Enterobacter cloacae
agctgtctgtccagcgcactggcaaccgtttccagatggttacgctgggctggagatataagcatcttccagtaccacaacttcgcgccaggtcaggagagtggaaaaaatcaggacaacgataaaacagaggttaacaatcaaactgggattgctacgcttatgcagccactgcaaaaaagattgttttacaacaaaggtatcgtgctgcacacacactccctgattgtcgctcaccatccgatatga

SEQ ID NO: 5401 - DNA, 201 bp, Enterobacter cloacae
tcaggcgaaacacgcgggaggcaagcgcttcgtcatgggaaaagagtttcaggaggatgggcgagcccatcagaacggcggagtagctgtaaacgcgatggctatcaggcattgcatgagtcctcaggtgtagccccggcaggcaccgcgccgccggggaaacaggagccttaccgtgttttcgaacgcatagccgcctga

SEQ ID NO: 5402 - DNA, 183 bp, Enterobacter cloacae
cgcttacccggcctacactctccacagcaatacttaaacgttgctaaactatttattctctgcacactggtcagacccgccttttcctgcctaaaaccgtcattctcttcaagaaatctttacctgcctttaactattgagacgaatccgatcgactcaaaatcctggcatgcctactattaa

SEQ ID NO: 5403 - DNA, 216 bp, Enterobacter cloacae
aaattgtgtgacgggatcaaatttgggggagagatgcggtctgacgccctcaccccgaccctctcccacggggagagggagaagggcacgaatcgtaggccgggtaaggcaaagccgccacccggcaaggggttagaagcgcgaatctaccgcagacgccagcatctccagcagccgttcgctgtcttcccagctcaggcacgggtcggtgattga

SEQ ID NO: 5404 - DNA, 282 bp, Enterobacter cloacae
acaacatcacgctcgggatgggcaaaaacgacggggtataaaatggcacgagtgaaaacaagtctgaaactgtttggcggggatacggtagtggtgcgttgctcagagcgttgccgcatccatctgataagttcgaaaggacagaaacaatcgcaggcagatatccttaccgtccaggacgataaggcctggctgacggtgccttacaccggcacctgggatgtgctgatcgacagccacagccagtcgctcgaacattccgtaagttacgtggcggcataa

SEQ ID NO: 5405 - DNA, 384 bp, Enterobacter cloacae
ataatgaaacttactaatcgactgaaaaagaagttattagtccttgatggcattgacaatgatttcatagagtatggaaaggaaataacatgccctgaatgcgagggggtaatagtctactctatcgtaaactcatatgagtttgacacgctcacagaagaagtaaaatgctttttggttaagaaaatgagaggtgtgaagcttgatagtgaacataagaaatatagctatgatgaaagccaattagatgtttcgaaaaacacatgttcaaagtgtttaaaagagttttccgctatattaacgtataaagaagtgcagccagcccgataccgggtatatcttgtggggctttttgaaggtgatttgaagcagatcaaactttaa

SEQ ID NO: 5406 - DNA, 183 bp, Enterobacter cloacae
gttcaaaagcgccaaaaaaatgataactataaccggtggcaaaaaaggaactgtatcagcagttatatcaagcagtttaaaaaaggctacgaggaaaaagatgactacggtttacattgtcatattgacgtatataaaccccttgaggaggttgacgcaacgataccttctcatgttgagtga

SEQ ID NO: 5407 - DNA, 228 bp, Enterobacter cloacae
ataccctgtattttttacttagttttaccctttattataatttttatgcctgaggcttataatggcctatctctgttaaatattaatttaataacaattacttgcatttttatattgttcatttctttctgttggctggcaccctcacgtatcgtcgtccacacttatcttttagccaaaagagaggttaacgatgccatacaaatcgaaaagcgaattaccagataa

SEQ ID NO: 5408 - DNA, 186 bp, Enterobacter cloacae
aaaccaacgcatggtggatatcgcccgtgcgctgcttacggtgaaaaatttgtggaagataccccctggggagtagttgcacagtcagtgggcaattcatgcctgattgaggtgcgtaatacagcgctcttcttgcagaaaccccgtaacgccggggatgaaaagctggcattacctttgcattaa

SEQ ID NO: 5409 - DNA, 336 bp, Enterobacter cloacae
ggtttaccaatgattgaaaatctcatttgtattaaagaaaaagacctgcttcaatgggcgtgtggtgaaagtaacatacttgttagtgtgccatttttaagctatgcattggtcgacttaacacgccagttagtctttgtgttaagcgagcctaagccattatcaaccgttttgaccatcttcaatgtgcagggcgaaaaactattttggtctgcccctcctgaaggtgcgactttctattacttaacattcaacctgtcaaaggaagtgatcgttgtctgtagctatccagcaaaaaaaatggctggcatgattggttttattcctgggatatga

SEQ ID NO: 5410 - DNA, 429 bp, Enterobacter cloacae
ttaatgaaaccactctactttttacttttcgccctgtctccgctcgcggccgcagaaaatatttatgcaccgggtcaggcggcacttaaattcaatcaatggtatatagcgcagttagatcagaacaaaccacccgtactcaatccagacattatgaacgagtacgtagcctcagggaccattgcagcaattaaagaaatgtactctggcgacagtaacgataaagatatgcccgatgcggatatgtttatcaaagcgcaggactgggatgatgactggaatcagataaccgtcttacattctgattttgacgccgtttgcacaaacgtctatgtcgcatttggtaagaagcaagatcatgttattgcagattgtctcgttgaagagcaaggaaaatggaaagtgcgatcggcgacgctaattaagtaa

SEQ ID NO: 5411 - DNA, 345 bp, Enterobacter cloacae
gttggagtcattaccgcgaaatcacacgcgcaacccagcagcacgggttattgtgctcgttacgtaacagaagcgatcagagcgggtggtcgattaaaaatccccaacacgcgtctggcaaaagatatggggcgcacattagtcaatgcaggctttcacctggtatatgatcaaccccatgctggtgacgtcgcagttatccaaaatatagttggtcatgatagcggtcacgtttgtatatacgatggtcaacagtggatcagcgattttgtgcaacgcaccatgtatcctgggcaggcttaccgcaacatacaacctcattacgaactgttcaggcatgattaa

SEQ ID NO: 5412 - DNA, 234 bp, Enterobacter cloacae
atgaggagatttaccgctgacatcacttccggtgggcaaagtcatcgctttgccgttattttaatgagaatagtaatcattaatcagttgaatgtggagtatttctttccttcaaagccttacattcacgaaatgtgcggttatagttttcataacatttacaaaggatttaacatatatacacaggttccagttgatttggttcgaatttttcttaaccggtttactccatga

SEQ ID NO: 5413 - DNA, 675 bp, Enterobacter cloacae
aattaccgcatccacattgacgggatgccccacatgaccggaagagtcgattatcatcttgaaaaatacctccttaccgaagccggcgagcccgaacgtttgacgcgccagtgggccgaggtgatgcgcgagtgtcatgaccagaaatccggggcagaagagcggctgcgtctcgcgctgctgaacgtggattatgtgaccagctttgagcttcccttccggttacttcttacccgtgcaccgcagctgattgatggcatcagaaatgagttccagctcagtcaaaaaaatgtcctgttcaacggcaagcggtttggctgcgtttacagccttaaacaggatttgaagggcattccagatgaatttacctaccacctgaatacccgtattcagcggatcgatgcctccggcggttcggaagtgccttaccggcaaatcgctcagcaggtgaaagccccccgcgagcgcctccagctggcgctggaacaggggcttgcggtcaccgcgcttgacgggcttttctggtttggcctccagcgcatagccgccgacgtgcagcggttaaggaagacggggatgagaatagtgacgtccgatacggaggtgttcgacacccttaccggaacaacacggcgcattccggtttatcgtcttgaggacgctgccgctacttag

SEQ ID NO: 5414 - DNA, 249 bp, Enterobacter cloacae
tgtgaggtgattatgagcgacgttgttcttctggtaccgaatgactgggttagcgaaaaggttctgattgcggttaccgggctcaagcccggaaccatcctccgggccagaaaagaatgctggatggttgggcgggaatatgtgcacgtttcaccggacggaaatccgaaaccttccagcgagtgcatgtacaaccgtaaagcggtcgatgcgtgggtggcctcaatgaaaaacaaacagcctgggtga

SEQ ID NO: 5415 - DNA, 186 bp, Enterobacter cloacae
attctcagtaaccgcgccggggaatgtttaagcggggctaacatactgaacagtatgaataaaatatggcaagcggaccattatttcttctggagggtggtaaatgaaaagaaaacttctttttatctgcgcgggtacagtgctgacggcggcgactgtcggtcaggcgctggcagtcaccagtag

SEQ ID NO: 5416 - DNA, 1002 bp, Enterobacter cloacae
gctgcaaacctacggtccgctgacctgtcgggaggcgccgtgagacgcctgttaatcgcgcttctcctgctgtgctccggcggcagctgggcggcctgtaccgtcagtacggtgaatgcctcgtttggcagcgtcacctcgttcgcactcagcggcaccggggaagtggaaacgacgggcacgctggtggtgacctgcgataccgttctcaacctgttaaccaacgactcggtgacgctgaattacacttcggcatccgtctttgcgaatagccgggcgaccatgaagcgtacggacaacgcggctattaccgatgtcattcctacgcgcctgtgcggggcgtccggctgcggcggaaacagtgaaatacaaatcagcaaagcctatacctggagcggaaacacgctgctcgggctgctgggttcaaggcgctacaacattcccctttatttccggaccgtaatggggcagaacgtcaccgccgggccgtatcaggtgttgttaacgttcagcattaactacaacgtgtgcgccgttggcgcggtcggagcgtgcctgaccccgcaaaccggcacggcaaccacctcgatcctcctcaacatgaccgtcaccaacgattgcagcaccatgaccacgccggacgtgaattttaacagcgcgccgctggtgcaaaattttcccaccgtttcacagtcggttgccgtcacctgtaccaaaggcagcacctacaccataggcattaataatggggcaaatgccctgaacaacgtgcgtcgtatggtcagcggcagcaacttcatgagttacgacatctacaaagaggcgaccagcaaccgctggggtagcagcggcagcgagcgctgggccagcgccagctcatcgcaggtcagtacggacgggcttttacgtacctacaactacaccgccaaagttctgaccagccaggccacgccgcctgccggaacctacaccgacacgctgattgtcgacgtcgcattctga

SEQ ID NO: 5417 - DNA, 186 bp, Enterobacter cloacae
aagttcagcgcaacgaggtgctcgtcaactaccgctaactgcctgccttttcaccagtcttcaggcatttctgaaggctggctcgcaaaattgaccttcccttttgatacaaaagaaacgctgttttataaatcagtgacacgcgtattgacactctttgcatttttgccattcacccctttgtga

SEQ ID NO: 5418 - DNA, 234 bp, Enterobacter cloacae
atcacctatcgagtcgactttgtagatgatccccacctgctgacatcttctgaccagttgagggttgaaaacaaatgtacactcgtggctctcagttctgccgtattcgcgcagctgaacatcgatttgatgcttttttccaaacctggtcatttccgcctgattcctcaggacgctgatcgcaggctgaatgaggtgtatcactctgttggtactggcctcagttttcggtag

SEQ ID NO: 5419 - DNA, 1395 bp, Enterobacter cloacae
agcaggagaagaaaaatgaaatggatgaatgcggttgtttatgcagcactgctggccatggccggtccggcattcagcgagggcgcgccagcggaatccccgcgggattatgcctacggcctgtcccttgatacctctgcctcttcgccgtggtatcgggtcatgctgccgctggcgatttatcagcagagcacatcgcccgatctgcgcgacgtgcgcgtgtttaatcagtcgggagagcctgtaccgttcagcctggttactacgacgcgtccgcagccggcaccgaccaccacggcgctgcgcctttttgcgcttaacgcctcgccgggcggggaagaggacagcggcgataaaattatgctacgggccagaaacggtgtggaaattgtgctggaagggcaacacgctgcggctgccggacagcactatctgctgaccctgccggaaaacgcgacggaggttccgctctctcagctccagcttttctgggacacgccgcagggctcgtggcaggggacggcatcggtctattacagcgaggatctgaaaaactggtataccttgcgcgaagagatgcccctgctggacgtgatgagcggacgggagcgcctgaagctcgaccgcatcgataccgatctggtgttatcacctgaggcgaatcgctatctgctgctggtgctgaacacgggacgttctgccctgacgttaaccggcgtcaacgcgattaacgcgcctgcgccgccggaatcagagcacattagcctggcgggagagggggagcggttatccgaaagcgaagccgtgtggcgctggaaacatccgcagcctctgagtgcgatcgccttcatgctgaatggcgacggcgttctcccggcagaaatagcctggcggggggcggataaggatcggtggcatacgctgaaaaaagaggtgatctaccagctcggcggcaaaacggctgaacctgttccgctcccgggcgggctggtcgaggcggtaaaaattaagaccctcaatgcgcgactgcccgagaacctgccaggcgtgatagggcagcgcgtgcgctacgatctggtgtttaacgcgcaggggaaggggccgtacctgctcgcgtgggggaacggggctgcgaaaccggcgagcgtggagacggatatgctgatcccgaccgaactgcgtaaaacctacgatctggcagccttgccgatggcggatacgctggaacctgtcccgctggggggcgaggcgcgtttaaccgcgacgtctgcggctgagcaggaaagcagaatgaaaacgctgatggtctggggcgtactgattgcgggggtgatggtgcttgcgggtatggcatggcgcatctggcgcgaggtaaaaaaagacggcgcagcataa

SEQ ID NO: 5420 - DNA, 2637 bp, Enterobacter cloacae
cggatcgtttacggtgaaggtggaaacatggacgagctttacatccttggctgtttgttcctggtttttgcgctggtcgtggcacccgtgctcgcggtgataggctttaaccgaagcacggcggcgcggcaggagatcgcccggcttcgccagcgcattgaggcgctcgagcagcgtagtgtggctgagaaagcaccggagcaggtgcagaccgccgcgccggtgaagacgccagcgccggtgtcagaggccgctaacgcacctgtcgatccctggcgtcccgaaccgcccgtcactgaagcagagcctgtgcctgtaccggcggcaaaacgtccttccgcctttggcggcatcctgtcctcgctgacgcgctggtttatgcagggcaatccgctggcaaaactggggattgtactgctcttcctcggcctctctttcctgctgcgctataccgttgaacattcactgtttccgcttgagctgcgtcttgccgccacggcgctgtttgccatggttctgctggccgttggatggcggctgcggcacaggcagcggatctacgcgctgatcctccagggcggagcgaccggcgtgctttatctgaccgtctttggcgcattccggctgtggcagatgctgccgatgacgctggcgtttgtgctgctggtggtgatttgcgcggcgagcgtcgggctggccgtgttgcaaaaggcgctgagccttgccatgctggcgagcctcggcggatatcttgcgccgctgctcctgtctaccgggggcggtagctttgtggcgctattctccttctatctcctgctgtccatcggcattctcgtcatcagcatctggcagcactggcgcgagctcaacctgctcgggctgctcttcacgtttggcgttggcggggtgtggggactgagcgactaccagccggaagactatgttatttgtcagctgttcctgattgccaatacgcttatttttggcgtgtttagcgtggcgctgtcgctgcgggcgcaggaaaaaggcaaacagattattgacggcgtactgctgtttgctccgccgctgattggttttgggatgcagtatggcatgacgtctcactggacgtacggcccggcgttaagcgcgctgggctatggtgcgttttacctctcgctggcgtttctcgcgctgcggcgttacccctccatcggacgaccgctggttatggcggcgctggcgatcggcggcgggtttgccacgcttgccattccgctggcgctttcagcgcgctggacggcgatggcctgggcgcttgaagggctgggtattctttggttgggcgtgcaacagcagcagcggcgcatgagctatagcgggacggcgttgctggtgctggcgctcggcagcgcgatatgggcgcaaatggacggcgtcacttcgctgagcctcctgcttattttcgcagtgctcagtctttgctggctggctgcggcctggctgtggcagaaaatcgcgctgccgggcagctgggcattgctggccggtgggttgctgttctggttagtggcgttgctgggcgcgtcgcagttgttcctgaagcaggagttatcgcttctggcaggcgtgctggcgctgacggcggcgtcgacctggggatggcggcaggctgccgctcgtctggcatggtgggagctggatgccagcaaatggctgctgtggccggtgatgctgctgatggtgctgtatcaggtctcgcaccagcagattctggcggccggctgggcaaatctggcctgggctatcgcgctgcctgccgccctgatgctgctgcggcgcgacgaagataaacttctgccgcgcatctcaatggggctgcatctgtcgctgttgtggatgattttactcgcccttgccgccgagctttactggtttgcccgctccctgccatggggcatggcggcctggggaagcggcattgcgatggctgtcggcggtggggtgattatggcgctctccgcggccgtacggcgtcgcgggtggcctttccgggtatggcctgcgctctacgcctgccttgccgcgatccctgtggttgtggcgctggtggtattgctggtcgtgaccaatttccaggacggtgtggtctatcgaaagacctggctgccgctggtgaacccgcttgaggaaggggcggcgttcgcgctgctggggctggtagtattttatcgggcagtggatcgctactatccggcatcgcttgcgcagtcccgaccttggcccgctgttgtgctgatggcgcttggcttctggtggctcaacggcgcgttgctgcgtgcgctggcgtggtacggcgaggtggcctggaacatggaatcgctgtggcattcgcggcttattcagaccacctttgccctgttctggatgttctgcgcgctggtggtgatgatccgcgccacccgtcaggcctcccgtcatcagtggcttggcggtgcggcgctgctgggggtggtgatgctcaaactgatgctggtggacagcgcgggcggtggcggcctggcgcgcgccgtcgcgtttattggcgtggcgatcctggtcctgattgtgggctatttctcgccgctaccgcctaaagcaggagaagaaaaatga

SEQ ID NO: 5421 - DNA, 219 bp, Enterobacter cloacae
actgatcttatgctgtattccggccctcattctgggggctatctttggctatctgccgtggtttttactggtggccgtgacgggattgctcgtctggcatttctggaatttactgcgtctttcctggtggctgtgggtcgacagaagtatgacacctccgccgggaagcgggagctgggaaccgcttctctacggcctgcaccagatgcagatgcgtaa

SEQ ID NO: 5422 - DNA, 204 bp, Enterobacter cloacae
tgtaatttacgcagaatagaattacatctttgcattttaattcagagggataagatgtgcggcgggtgcttaagactttctgtcttgagcattgttgagggacagaaagtagaaagccccgggaaattttcatttacccgaggctactccctcaactccaacaagttgagagtagcctcttattctttttttgacaaggagtaa

SEQ ID NO: 5423 - DNA, 783 bp, Enterobacter cloacae
tcgataaaaagaacgtcggcacgtataaggggtggacggttaaatgatccttttccctctcccgcagggagagggaactgttttaaaggagtcaccatgaaacgctccgacatcaatgaaatcctcggccatactcggcagttcttctccatgcacgacgtgcatctcccgccttttgccagctttccgccgacaaaatggcagcagcttgaccaggctgcatggcaggaggtgtttgacctcaggctcggctgggacgtgacggcatttggtggcaacaacttcgctgcacaggggttaacgctgttcaccctgcgcaacggctcccccaacggcgtgccctatgaaaagtgctatgccgaaaaaatcctgcacgtccgcgacggccaggtgacgccgatgcattttcactggcgcaagcgggaggacatcattaaccgcggcggcgggaatctgattattgagttatggaatgcgggcgcgcatgaagagaccgaaaacaccgacgtgaccgttaccgtcgacggctgtcggcagacgcacgcgcccggcagccagctgcgcctcacaccaggggagagcatctgcctgacgcccggcctgtaccacagtttctggggtgaacgcggctttggcgacgtgctggtgggcgaagtgtcgtcggtcaatgacgatgaacacgacaaccactttttacagcccatcgatcgctacaacaccatcgaagaagacgaaccggcggtgctggtgctgtgcaacgagtacaacctgtttcggatataa

SEQ ID NO: 5424 - DNA, 351 bp, Enterobacter cloacae
ggccagttcacctgcgagtctggccttatgaaacgttactctaccgctctgttattgggtctgctgactttaaccagccaactggcgcatgccgatgtgattgatgacgccattggcaacattcagcaggcgatcaacgatgcctacaaccccagcagcagccgtaatgacgatgacgacgatcgttacgaccgcagccgtcaaatcgacagccgacagtacgacgatcgtcgtcggcagctcgaagacagacgccgccgtttagacgagcgtcagcgtcagttggacgacgacaggcgtcggttagaagaggacgagcgcaggttggaagacgattacgatcgcggctaa

SEQ ID NO: 5425 - DNA, 240 bp, Enterobacter cloacae
aagtcccttccaacatcaatgactttaaaagttgagtcaatcgctattttttgcaaaaagtgttggacaagtgcgaatgagaatgattattattgctctgcattcaggaagacctcctacgggaacctgaaagcacgacattgctcacattgcttccagtattactttagccagcttttagctggctttttttttgttatggttagactcagcaaccttcgaaaaaggactgagccatga

SEQ ID NO: 5426 - DNA, 219 bp, Enterobacter cloacae
ctcgatgcggtcgacgcgcagccagttgtcgcacatatcaatcatggtgcgaatcagcgcgctggccacgccgcggttatgccactctgcgccaacgcatataccgaaatcggcaacgtggctgcggcgtggtcgctgggcgacatcaatggtgaggtggcctaccacgatatcatcaatgcaggcaaccagctgtttaatgcccggctgttcgcctag

SEQ ID NO: 5427 - DNA, 237 bp, Enterobacter cloacae
aggcaccggcaggcgctatgccctgcgcaacggcgagtatgtggatgcgtattatatggcgcgaatgaagtagtttgttgccgggtggcggcttcgccttacccggcctacgtccgtgtcgttgtaggcccggtaagcgcagcgcctccgggcaacaaaatcaataccccgccgttaaatcatccaccgaacgcgggtccgacgcgccaaacagcgcgccatccggtccgaccataa

SEQ ID NO: 5428 - DNA, 195 bp, Enterobacter cloacae
ggatgccggcagcagcgccggcaggaaaacaagggaggtcagtttcatgaatcgggactccgtcagactgaatcgcctgacagcgtgcccgtggttgctcagaaaagccgcattaaattctatatccggaactacaaattaatcagatgggatgatttgctaatgagtaggttcgagagtgtaatttatgactga

SEQ ID NO: 5429 - DNA, 285 bp, Enterobacter cloacae
ttaaaccgtcctcccggaatgtcaacggtcaaaatggaaaacgtgatccgtaaaaataaaagggcaccgtttccggtgccctggggtcagtgccttaacctgcagtcgtctcatctgtctccggggaaaaatcccgacgcggttttcacggagtgcatgcgtcttacaggtcagttagtgtgcaataacttcctgccaggcctgctgcgggtaaatcccgttatagtttaccttacagcaccgtggccagcggggcacctatgcatcaaagcctggcaacaatag

SEQ ID NO: 5430 - DNA, 381 bp, Enterobacter cloacae
gaaaactcaacgttaaacagagggaaaatgaaaatgatgaatactgttctgaaggccacgttaatcactgcactgattagcggccctgttcttgcggtcgacggtactggcaaagtccagctttcagacctgcatttcgcctcagcagcaaatggtttgcagcaaattgaaggcacgggaacaaacgtgtcaggtgggcctgtgaagactgtaattgtcaaattcaacttgcttcagaatggggcagtaataggaaatacggcagcgatggctgaaaatctggagccgggtcagcaatggaagctacaggccccctacgacagcataaccaacaagccagacagcttcaaagtgacagaactgacggtatttaataactga

SEQ ID NO: 5431 - DNA, 741 bp, Enterobacter cloacae
agagaggcgttagacatgtctgatggtaaaacaaagggcggaacaaccgcttcacgagcgggggccctacagtcctctgttaatatcctgctccatacacattatgcaatccggctttgggagggcaggaaacgtgatgctccggacgagacaggggtgaaaaaaaagaggcctgaaataatcagcatgccgcaagccattgcgcgagctggtaatgcttcccgagactcagcggcagataatccctatgccgatatggctctggtacggctcgaagaagccctgcaacgagcaacacttaaaattaatgaaaacgtcagttcactggatgccatattgtcagccgtacccaaaggggtaacgctctcggaagttgaatcagccgatccgttaaatgtgagcgttttcagccgttcaccgttaggataccggtgcgtatggcttctggttggatatgatcagttagcaatgaaagctttccaggcttttcattacggactgatttcgcgttcgcaacgtgacgctatcctggacaatggtggccatgctgttcgtcaggtctatggcgtgattcagccttaccgaacacttgcagtgactcgccgtgatattgcagaaaaaaccacgcaagggcttgttgccattgagcgaaatggcgaacctgatccggatgtgttaagcggtaaaaaacgttcttcgttctcacctccgcttaaaaacaccatagcagaggaggaatga

SEQ ID NO: 5432 - DNA, 549 bp, Enterobacter cloacae
cccccgacgggaaaccactcccgtcagggcagatggtttctccgtcgtacctatttttacctccatggagaaaacatcatgtctgcaaacaacacttctgcatctgcaaaatctgagtacttcaacctgactatcaaaggcatcgggtatctcagcaacattcgccaggttaaccatcagaatggctcgttcctcagctgcgtaatcaatgcactgagtggtccgactgataatccggcctacgtccgttttgacatttctgtcgcaggtaaagaggcaaccagccttatcgcccgctgccagaaagccgtcgatgaagacaagaaagtcctgttgggctttaacctgagtaacccgtccacggacatatttacgctgaacaagggcgaccatgccggcgaacagcgcgtcagtctgaaagcccgcctgataaaggtggactggatcaaaataggccaggaaatggtttacaagactgaaaaatctgactccgtgccgccgcagaatggctctgtcgcacaacaaaactacgcagaaaactcattctga

SEQ ID NO: 5433 - DNA, 699 bp, Enterobacter cloacae
gggctgttttatcactgtacaggaaaaatccggatgaaacgtaacacctctcacaacgtattttcaccaggcaggcttgccactgttcttcccctgctgctccttgcgggctgtgtttcccagccgcaaaagttgcagcaacgtgcgcctgccgacccgacacccggcaccaccgtcacccgcaacgttcagccggtctctccggacgagtatgcgcggacgccggaagtggtgcgctacgatcgttatctgctggtcagtaccgatccgcaggcggcccagcgtgaccctctctcgcagattattgatattcgcatcccgtcatccctgcatcctaccgtggtggatgcgctgcgttacgccctgcgccagtccggttattccctgtgcgcgaccggctccgccaacggcgtgctttaccgccaggcattgccggcagtccagtaccagctgggcccgatgcgcctgcgtactgccctgcaggtcctggctggtccggcctggcagcttgaggtggatgatgtacagcgtgtggtctgccacagcctgcgcgacggctaccagttgccggtctcccagcttccgccgccggtcagcacctggtccgcgcctgcgccgtcagcggtgtcacaaccggccatcagcgcacctcagtccgtccccgttaaacctgtcagcggagggtttctgagaaaatga

SEQ ID NO: 5434 - DNA, 636 bp, Enterobacter cloacae
atgggtaatcgcagcgttctgaccggcgcgctggcgctgggcttactgatggcggccgtccctgacggccatgctgaccagacggtgccggagggttacgtccgcgtggccatggcgcacggcgtgcccccggaagcgctttactcggtatcactgagcgagtcttcgcgcaaacttccccgcggcgtgcggccatggccctggaccatcaatgtggcaggcaaagggtatcgctatgagacgcgtctgcaggcctggcaggcgctgcaggtctttatgaagcgtcacgcgcttaagcgcatcgatgtcggtattgcccaggtcaatctgggctggaacggtcatcattttgcctcgacgtgggaggcgtttgacccttacaccaacctgaacgccgccgccaccattttgcgtgagtgctgggcgcgtaagccaggcagctggctggatgcggccggctgctaccaccatcccgcaggtggtcagcctgctgcacgttaccgcgccattgtgagaaggcatctggcaaaaatcagccctacaccccgcatttctgcgccggcagctgaagcgccccgttcggttgctgcgctcacccccgatccaggcttcgtctggactgaacccgggagataa

SEQ ID NO: 5435 - DNA, 411 bp, Enterobacter cloacae
acgttaagtcaggagatgaattccatgcaccattctgagtctgttgttgcccgcctgcgccgtttcgccagtcgtacgctgacccgcgccggtacgcttgccctcctgggctggctcacctgcaaaccggcctttgcggacttgccaagcgttgaagcgcctgagtccggaggcggaagcgggctgtccggacaaatcaagggctacctgcaggacggcattgttatcggggggctggtcgtggcggccgttgcctttatcaacgttgccattgccgccctgcacaccttcaccgaagtccgcaatgagaaagccacctggaccaaattcggggccattgtggtggtgggtgtggtgctgctggttgccgttatctggctgctcggcaagtctgccgacattctgctgtag

SEQ ID NO: 5436 - DNA, 369 bp, Enterobacter cloacae
gagcctgcgacgatgcagaccattcgttttttacctgaccgtctcaacagtgagcccgtggtgtttcgcggattcaccacccatgagatggggctggcagcccttgccggcgcgggtgcgggtctgctcctgtcactgccgtttatcccgcttgccggctgggttgttgttcccaccggcctgctggtcatgccgctgctgctcgtctggttcggcggccgctggatggccaggctcaagcgtggtaagcccgagaactggctctggcagcgactggagactaaaaaacgccggctggggatgggcaatccgaaactgattgtggatgcccggggctggtcagtgaaacgtaacaggagagcttcatga

SEQ ID NO: 5437 - DNA, 474 bp, Enterobacter cloacae
atttcactgcagcgaactggaggcggcaaaacgcgtcgcgcagaatctggaccgtctgcgcggtctgacggagaaacaacaggagcctgccacggtatgatgacactgaagtaccctgaacccgccattcatgagcacagtggcggtgcgcttttcaccctgtcgcctcagggggagcccggcgtgctcccggcgacacatcagcatctggtgaggctgcgggcgatgctcaggcagcgcctgaccgggccggtcaaaatgacgtgtcacccgcaccgggtgggactcagcagcagcgtggccatctatcttgagggaaagctgaagcaggcggtgaatattcttatcaccgtgacgggacagacgagctggccgcaggaagaggagtatgcgcatccgcgctggtatatcacggtgccggattcggctgacctggtgtatctgatgctgtggattaacgggcttgacgtataa

SEQ ID NO: 5438 - DNA, 195 bp, Enterobacter cloacae
cggaggttccctatgaaacactctccacaacgtaatgcagctattctcaatcttcatgcccgtactatgcagataaacggcactgtcgatgaaaaggttgagcagttgcgcaaaatgtttgctcagagttcaacacgaactaaggatgacaggaagcaccgtggggatcgagaaaaggtatattacgaaggctga

SEQ ID NO: 5439 - DNA, 489 bp, Enterobacter cloacae
tttgtagttccggatatagaatttaatgcggcttttctgagcaaccacgggcacgctgtcaggcgattcagtctgacggagtcccgattcatgaaactgacctcccttgttttcctgccggcgctgctgccggcatccttactggccggcacggtcgtcttcactgacagtcagcatctgccggccaacctgccgcctgacgtgccggtggtgcttcttgatggtcctgaccggctgcaggccgacatgttcggggaactgcctgcagacccgcagcaggccgaagcacaagtcaggcaagttatgacgtctcctgcctggcaacaaaaacagctgcaactaaacgattcttatcgacaggtggtccgggcctgggagctgggcatcaaaaaagtgccagcagtggtatttgatgaccgcgatgtggtgtacggcaccacggatgtggccgtggccacttccctgcgtaaccggggaggtggtcagtga

SEQ ID NO: 5440 - DNA, 327 bp, Enterobacter cloacae
cgggatgattctcatctcggactgtcgtgttttatccacgacggcacagagcattttcgcgacatggaagtgatcgaaggcgattttttctaccgcgttaggcaggtggatacgggctgcgctgatataagcctgattcatgtccatcgacagggttttgatggattcgatctgacggtcacccaggctctagaggtaacccgccaggctttcaaccccgcgatcatccctgagctccagggcctgtccctgtgtatcagagataaccgtgacgtactgatgaccctttttgaaggcgacctcatcaacacagaggtgacgtgctga

SEQ ID NO: 5441 - DNA, 570 bp, Enterobacter cloacae
cagaggaggaatgatatgattcgccctgtgttcctcctcacctctttctttttactgagcggatgcgcaacaacggactgggctgcgattaataaacaggtcagcgataccgctgcgaacctgaaaaaaacgttaggcggcaacgatagcggagaaagtggtgggatgccgctgatgagcccggcggggcaacaggccatgaagtccgtcgataaaacgttctccgtgccggtcgatgtggataccgcggcggcccgcctgaagcgccattacaaatttatctccacacaggagcttgaggcactgcggcaggccacaaatgacggggactggaaagcggctgctgaagatgatgcgcatcccgtctgggacgccatgccgggcagctactacaaaatgggctccgactggaacggacgtgatcacctggatatcgaaatcgagaaaaacgggtccggcagcaggctctatgttgtctatcgttcatcatcatcacagcgtctggccgggtccggcgtcacgaagctgatgaatgatgtccgcgctgttgcggcgggtgaaaaacgctga

SEQ ID NO: 5442 - DNA, 270 bp, Enterobacter cloacae
tccggtcagcatttaaggataactgacatgcctgttatactgaggatcaacggtttccggttctttttttattctaatgaaggtaacccgctcgaacctgcacacattcacgtaatgaaagcaggtagtgaagccaaattctggttaacgccatcagtggtactggccagtaacgatgggtttaattcacgggtattaaaagaactgacggggatcgttgaagataaccaagcattgtttctggaggcctggaatgactatttcagctaa

SEQ ID NO: 5443 - DNA, 765 bp, Enterobacter cloacae
cggccgcctgaccgtgctcagagcagaataacggagcgaataatgaaactgaaacatacctttttagccgccatgctgctgagtcccccgaccctggccgcgaccacatcaggacagacggatgtcagccgacaggaatcaacacaacgggcggactccgctcagcaaaacctgcagcagcaggccggacagtggggactcagtaccgacgattatcagcgttatcagcagctgatgaagggaccccggggtatccagtcgccgggtctcgatccgctttccaccctgggtattgaggcgcagacgccggcagagcgccgtaagtttgctgaaaagtgggtgaaggaagagtttgcccgcacccagaaagagcttgatttccagcgtgaggtgaacgcggcctggcagcgcctgtatccgggcacactgccggtcaatatggggaacgcctccggcgtggcgcacgacagtggtggccggctggcgctgttcgtcaggtcaaaagactgcgccacctgcgacgcgaaactgtctgccgtgctggctgacaaccggccggtggacatctatctggtcgacagccagggcagtgatgatgcgcttcgcagctgggcgcgggaccatcacattcccgtggaaaaggtccgcaagcgccagatcacgcttaaccacgacggcggacggtggatgcgctttggtaacggcctgatgccggttttactgcagcaggcgggagacggtaaatgggtaatcgcagcgttctga

SEQ ID NO: 5444 - DNA, 783 bp, Enterobacter cloacae
acgtgccggtcacaggaggggcgaatggctgaggtaaaacgtcccccacagcagcagacactgccggaacgcaagcacggcattctgtataatctgctctggggctggccatgggccctggtgggcgtggtgctgtcctcgctgctgctgagcctgctgattgaatatatcggcatcgccttcttctggccggaagccggggcggcgcacagtgaagcggttatgaataccgagctggggtggctgtccacagagttcacccgcagcctgctgctgtctgagccatcggtgacggttgtgcgctgggtgaccactgcctatcagtgggcttttgtggacagtggttttctcgactgggtccggcagcagtatgcgcaccagatgcacagtgacaatgccgtcacccgagaaatcaacagctggagcggctggcttgccggctacctgcgtgagtacctgctggccacggtatggataagcattatcaccctggtacgcgtcaccatcctggtgctgtccgtcccgctgtttgtgctggtcgtggtggtggcgctggttgaggggctggggcggcgtgatctgcggcggtacggcgcggggtatgaaagttcgtttgtctatcatcatgccaagaagctggtcaaaccggccgctgtggtgcccgccatgctgtacctttcctggcccacggcagtctaccccaatctgctgttgttgccggcgactgttctgctggggatcgccgtaacggtgaccactgcgtcgttcaagaagtatctttaa

SEQ ID NO: 5445 - DNA, 264 bp, Enterobacter cloacae
ttaccggcgggagcggccctgatgtccatgacatccgaacaaacgaacgcgtttaaagccggctccggcagtcttgatgtgaacatccttcatctgctctgcatcggggcattgctggcgtttctttttttatgggccgcgtgggcgctgtcggatgtctggaccggctggagtaacaccaaagtgcgggacgcggccctggggcgttttgccgtccgcaccgtgctgctgttgcttgtgtgtatctggatgtttgccagttaa

SEQ ID NO: 5446 - DNA, 978 bp, Enterobacter cloacae
accggagaagtcaggagtgtttcagtgatgagtaaaaacccccactaccgcgccgggctgatggcgctgtccttcgccctgctgcccctggcgacgctggtatcacgtcctgccggcgcagatgagctgatgaaatgggagcgtattccgctgcagatccccctgaaggtggggcaggagcgggtggtctttgtggacaaaaacgtccgcgtcggttttccgccgacgcttaacggtaaactccgtgtgcagagcaccgggggaaccgtctacctgaaagccgacagcgcctttccgcagacgcgggtgcagctgcaggatgtggaaagcggcgaggttctgctgtttgatatcgccgccggtgaaaaagggccgactgagccggtgcggctggtctacagcggtgatgtcagcacgcttagtcacgccggcgatgcggccggtcagccaggtggtgcagatcgggctgcttccggatcaggctcatctgctcccaccggcagcgatgacggcacccaggccaggcgtaaaaaaatccgctacagcgcccccatcccggtgctgctgacccgctatgccgcgcagagcctttatgcgccagcccgtacggtcgaggcggtcccgggtattcatccggtcaatcctcatctgccccgacgtgtcagcacgctgtatccctctgaaccattaacggtcacgccgctggctggctggggcgtggcaaaccgtagcgtggtggcactcaggctcacgaacaccggcagccgtaaggtcgttctggatccgcgcgcgctgcagggacagtttgtgtccgccaccttccagcaccgctgggtcggtccggccggcacgcctgaggacaccaccacggtgtatgtggtgaccgccggtcgtccggagagcgcattcattgctgagccgtctgcattgcgtaaagcgacccgcacggtaaaacaggaggcccgccatgcagattaa

SEQ ID NO: 5447 - DNA, 2946 bp, Enterobacter cloacae
cacgcctgtgccgggttacagcaccgtgttcccgttctacagccagacgcagtatgccatgcctggcgagcgtacggaggccctgtaatgctttcactgtttacgcgtagtaaatccaccgaccggcagacgccgcctgatgatggccagtctgttcaggcagatgaaaccctgaccgcggtcgtgaagggccggcaacccctgaagcgccccgggaaaatgacgcgccaggatgaggagaaggtttatcatgccagtccgtccatcattgactttttgccctgggccgaatttctcgatgaagagcagtgtctcctgctggatgacggcgtgtcggtgggggccgtttatgatgtgacaccggtggcgaccgaagggcgaaccgaagagcgcctggagcaaatccgggactcggttgaggatgcacttcaggacagctttgatgaacatgacgtgaatccctggatcgtgcagttcttctgccaggatgaggacgacactgacgcgtacctggacaggctgcgcggatatgtcaaaccacatgcacagcgcacggcgtttaccgacgcctggctgggtgaaatggagcgccatattcgcagtatctcccggcctgagggactttttactgactcgctgattaccggccagccgtggcgcgggcagcagcgccgcacccggatggttgtttatcgctggctggggaaaagccgggatccgatgccgccggtggcgatgctcaaccaggtgtgcgaccgggtcgttaatgccctgggcggggcggggatccgctgcacccggcagaacggcctgcaggtgcatggctggctgctgcggctgttcaatccgtcaccggactgggtggagaaaaccacgctctatcggcaggctgcttacgcagacccgcgcgagacgcctgaaggcaccgtgccggtcagcaatgattttgccgaaaccctgtggttcacgccgccggtctccgacccggaaaacggcgtgtggtggattgacaacaagccacactgcgcggtggcggtggaaaaactgcgtacaccgccggagccgggcaccctgaccggcgagaaaagccggggtgaaaagaaaattaatgccctgatggatatgtttccggaagggaccatggtgtgcatgaccgtggtggtgcagccccaggaccggcttgaagagcagtttaaccggctgtcgaaaaatgcggtcggtgagaataccgagtcgggccgcgtccgccaggatgtgaagacggtcaaagagtatctgggcaaccggcacaagctgtaccgggcggggatcaccttcctgttgcgcggcgatgacatgaccagcctgaagcgcaagcggctggagctgtccaccgtattgctcggggccggtctgcagccggtacggccggagtttgaagaaggtccgctgaacagctggctgcgggcgctgccgatgtgctttaacccggacagcgacaaaaaacactggtatacccgtctgacctgggttcagcacctggccggtcttctgccggtgaccgggcgggaaaccggcacggggcaccccggcttcagctttttcaaccgcggcggggataccctgaccttcgatccgctcaacaagctcgaccgcacccagaacgcgcatctgctgttgttcggcccgaccggggcgggcaagtcggccacgctgtgtgccgcgctctctcagctgatggccgtccaccgtccgcggctgtttattgcggaggccgggaactcgttcggcctgctggccgacttctttgacagcctcgggctgacggtgaataaaatcagcgtcaaacccgggagcggcgtcagtctgccgccgtttgctgatgctcacaaactggtggaagaaggcctggccgcccaggccgtggatgagagcgacctgccggatatcgacacggacgacgatggcgaggatgacaagcgtgacgttctcggtgaaatggaaatctccgcgcgcatgatgatcaccggcggcgacccgaaagaagaggctgaccttaagcgcgccgacagggcgatgatacgtgaggcgctgctgatggcggcacatgccacgtataaggaagggcggcagatgctgccgtctgacctgcagaaggcgctgtacgacattgcctctgacaacgatgagggcgtcatcaatgtccgcaatgcccagcgcaaggcgaaagcggcggaaatggcggaatccctgggcatgttcactcaggccgggagctttgaagcggagctgttcaaccgcgaaggggagctatggccggaagcggacgtgacgctggtcgacctggggcatctggcgcgtgagggttacgaggcgcagatggccctgaccatggtctcgatgaccaacatgatcaacaacatcgcggagcgtgaccagttcctgggccgggatattgtcttcacggtggatgaggcgcatatcgtgacggtcaacccgctgctgtcgccgtatatgaccaaggtggtcaagatgtggcgtaagcttggtgcctggctgtggctcgccacccagaaccttaaggattacccggatattgccgaaaaaatgctgaacatggcggaatggtggatttgtctgaccatgcccccggaagaggtgaaagatatcagccgtttccgcgcgctcacgccggagcaggaatcggtgctgctttccgccagtaaactgtcgggttgttatacggaaggcgtggtgctggcgaaacggatcgaagcgctgtttcgtgccgtgccgcccagtctcttcctggcactgggcatgacggaaaaagaagagaaagccgaacgccgggcgctgatgaatgaatttcactgcagcgaactggaggcggcaaaacgcgtcgcgcagaatctggaccgtctgcgcggtctgacggagaaacaacaggagcctgccacggtatga

SEQ ID NO: 5448 - DNA, 633 bp, Enterobacter cloacae
acggcactgtcgatgaaaaggttgagcagttgcgcaaaatgtttgctcagagttcaacacgaactaaggatgacaggaagcaccgtggggatcgagaaaaggtatattacgaaggctgagtttagcgaagattttgtaaaagccagtgaagactttaagtacggttatgatgttatctctaaagtaaatgtcaaaactggccagtcaatcttgcgctacgcagtccgtctccagcagaaatggaatgatgagaattgtattctcatttatgatcatgacgatgacaagctctggggcagagtaaaggcatctgactcaaaagatgatgccggcataagctggtatcttggtttttttcatggacgagttgaagcatggaaaaacgatcccctaattgtaatatcgtttcgtgatgaaattatccctgccccgcaaggatttgataagggatttgagctggcggttatacatgcaatcagcgatcacccaaccctcttcggggaaaattgggaaaagaaacttccagaacacatgcgcgaaaagcgtaaacaaaatgctcatactctcaattacttcgtggatgtaaacagttctgattctgacggcagccctgatgagtcatccccaacttaa

SEQ ID NO: 5449 - DNA, 1557 bp, Enterobacter cloacae
gtacgcgatgtttaccggtccgggagtctgaagatgacgacaaacagctatcttgagtattttctcacgctgctcggctgggtgatcaataacggtctgtggaatgtcctgctgagcaccggcctttttgtccttccgctggcgtttaaggtggtgggtatctggctcagggtccgtgaagagggggaggatgaaggcaacaaggggatgctgtcgctgccccgtatcgagaacgcgctgtatgccggcttcctggtgatgattgcctgctgcgtaccgctgattaatgtcagcctcagtacgatgcagtacgacacaacccgggcaaagagctgtggtgtgtggacgcccaaagcgccggatgaaagcggctatgccggcgtggtcaccagtctcaacgaccagacggctgcagcaccggtatggtgggtgctgattcataaactctcaaaaggggtcacccaggcggccgtggcgaccattccctgccgccctgacatgcgtcagatccgctttgaagtgcagcatacgcgtatcgacaacaaagcgctggcgcaggagctgcaggacttcactaacgactgctattcggtcgcgttgtatctgtggaagcaacaggatcagggccagacaaaggacaaaaccacgctgcgtgatatcgaatggattggcagcagtaccttcctgagccggtattatccttcgttgcagtccaaactgccccgggctgcgttcccgtggaccgacagccgggacagcggccggcccaacaccggaagaggcggctatcccacctgcagcgagtggtggagcagttcggacaccggactgaaagcacgggtgaaggaccaggccgaccccgatatgtggctgcgtatctcggccgcaatgaaaatgtcaggctttaacgacagtgactatcaggaagccgtcatccgtcgtctggtcagcccggaaagcctgacggtctcacagaatggtcacgtgtatgccggctatggcggcaacgccgattttaccctggataatgcagcggcacgcgtggcggctattggcgggacatctctcggcagtctggcggcgttcccggcgttcgatgcaatgcgacaggcgctgccaatggtgcaggctatcctgctgatggcaatatatgtcatgctgccgctgattctggcgtttgcggcttacgagttcaagaccgttattacgctgacttttgtaatattcgctctgaacttcctgacgttctggtgggaactggcgcgctggctcgacagctggctcctgacagcgttgtacagttcagatacacacagccgctttaatatggcgggactgcagaacagctcagatgacctcattatgaatctggtgatgggagcgatgtttattgtactgcctgccgtttggctgggagctctttcgtgggcaggggccagcgtgggtgtcgctgttagcgctgcctttcaaaagggtactgaaactgctcagaatacaggcgggaaacttggagaagctgctggtaatgctatcggcagtaaagcaaccaaagggtag

SEQ ID NO: 5450 - DNA, 786 bp, Enterobacter cloacae
acctgtcagcggagggtttctgagaaaatgagcgaacagcaaccattccatacggatcccgcgccggcccgtaaaagattcagctggcgtccccgccgccgcctcatctggggcgctgccggcggtgtggcgctggccggcattctggcgctgggctacaccgccttcagcctgggcatatcggaccttgatgagcgccttacacgccttgaatctcagggcagtactgcggccactgttgagacagtcgcggccctgcagtcagatgtgaccacgctcagagccggtctgcaggatagccagaaaaaacttggtgagatgcagcaggagctgagcgcagcagcgaaacaggccggcagcgacgacgccgtgcgtcagtcattgcgaacccttcaggacgcccagcaggggctggaaacccgcctgagtgcgctgactgagcagctgacagcgctgaaatcacagccggcacccgcacccgccgcacctgtcgccgcaccggtcaaaaaaaacgcgcctgctgcaaaaaagccccgtcccgctgacacacgtcgtgctgctccgtcccttcgcatggcccgcaatgcgccttttgtgctgacgggtgtggagaagcggggggcagagtcctgggctgccatcgcgccccggggctacagcagcctgtcgcaggtggccctggtcggagagggcgaaaccgttgccggctggacgctggtcagtgccggttatggtgaggcgacgtttcgggttaacggccgcctgaccgtgctcagagcagaataa

SEQ ID NO: 5451 - DNA, 540 bp, Enterobacter cloacae
acccgggagataaccctgatgaaaacgctgtccttactgctttttaccctccttcccctgaccggccatgctgaactgaatgtgattgctgatctgggcggtgaagatgctgcgccgtattttgaggccgttaataaacagcccggtatgagcacgggaaacgacacaacatcttcacccccgtcacccgtgctgcagggcgaggccgccatgctgccggtattcacgccggagttgcgcccgggcagcattgccgaccggccgctgcagctgcccggcatcggggcgttgtttctggtcggggatgatgccctgtcccgtgaatggctgaaggctaatgccggtgagctggctgaacagcatgcggccgggatgatagtcaacgtcacggatatggctaccgtgcgtgagctgcgcgagctggcacccggtgtcagtctggccccggcttccggcagcgagctggcccgtcgcctgcagattgcgcattatccggtacttatcaccgataccggcctgacgcagcaggttaagccgtaa

SEQ ID NO: 5452 - DNA, 537 bp, Enterobacter cloacae
ccattctcgccgggcaggacgtccggcagtatctctgaggaatcatttatgcacatcatcctgaacagcctgcgctgcgctttgtggcttgtgttctgtttattccgtcatgccgttttcgtgcctgccgctttcggcggtgtctgcctgctcgcctggtttgttttcggccatccggtcagtgacctgaacgaccagttgcagaaagaggcaaaggcatggcgcaccgcgccgcccgggcactacatgtgggagggatgcccggtgcctgataatgcggctccgcctgatgcaaagccggcagcctgtaccgtcactgccgtctccacagaaaccgcggcgaacaattacctgctgtcattgcgggccgtatggatcatttttttcattctgtcgaatgtcctgtatgtgctctggcgcttactggcggatgccctgcgttttcactctcagccctgcagggaagccggctccgcaaaggggacgtatacccgcagggccgacggtaaaatcataaaggaggcagacgatgagtaa

SEQ ID NO: 5453 - DNA, 405 bp, Enterobacter cloacae
cccgacgcttcctcttccgcatcctgtccgcaccccttaatccttctggaggtgcgtatgaactcacatcgtccggccatgcggcgcaaccgtcgtgtcccgggcatcactggtctggtattgctgacctttctggcatcagctgttgcacaggcatccgagaaagacgagcttgcgtctgttcagcgtcagctggaccaggttcaggcgtcgcttgaacgggcccgcgtggcggctgcacaggccgacccggctgaccgtggccgctttttctttgattaccgtcaggccacatccgatctcaacaccatccgcagcggcattgaccgctatctggagccctcccgcgcgcaaccgcgtgacccgtcttatgtggccggtaattaccggcgggagcggccctga

SEQ ID NO: 5454 - DNA, 672 bp, Enterobacter cloacae
caggagagcttcatgagccgttttcgccatgcggtaaaagaccgcgaccagcatattcagacgctgcgcatcgcctgcgccgtgcttgcctttttccttttattcacctgtgcaggctggatgctggcacccagcaagctgaccgtgcataacccaccggatttacgtaccggcagtacgcggccctggtgggaagtgccgcccccgacggtctactcctttgcgttctatatttttcagcagctcaatgcctggccgaaaaacggcgaggtggactattccgccaaaatcaatgcgctgtcgccgtatctgacgccgtcctgtcaggatttcctgaaagcggatgcaaagaaacgcggtgacgccggggagctcaccgaccgcgtgcgcgtggtgtatgaagtgcccggtcgcggttaccagtcacagagcgtgaccgtacaggatcgcgatcactggattgcccgcctggacgtggtcgccgatgaatatttccatgccgagccggtcaaacgcgccctggtgcgttacccgcttaaagtggtgcgctgggaaggtgatgcggagcgcaacccgttcgggctggcgctggactgttatgccggtgtgccccagcgtctggaggcggcaccgcctgcacctaaaccggagaagtcaggagtgtttcagtga

SEQ ID NO: 5455 - DNA, 702 bp, Enterobacter cloacae
cgtgatccctgcgtcttctgcggctctgttgctgcgacccgtagcgctgttgcctgccggcgcacctttactgcgctggcgcgatggccagcttttactggatattggcaggttctccctgccgctcagtgcccgggagtgtgccgtttcgtggcgcagcccgaaaatcccgcgccggctttactgcccgcgtatgacattacgggagctggggcacctgctgaatgtcagtgcgttcgtttttatctgcggcggttacgatccggccgcctcacaaaggagataccggtaatgtacagaacggttttcattctggccctgagctgtgtaatgctcagcggctgctcaacctccaaagaggaaatgctgccggcgggcgataacaccatgcttgaactgtggaacggggcggacggtggcggcagtacttcccgtcagtctgcggcggcccgcgacacgctgcgacgcccgctgacgggcagcgaaacgcaggcggacgcgcagggcgaccgcagctacagccgtactcaggaaagcgaaatcacccagcagtttccccggctgcccaaccccgacatggtgatgtacctgtatccccatctggcagacggtaacacgcctgtgccgggttacagcaccgtgttcccgttctacagccagacgcagtatgccatgcctggcgagcgtacggaggccctgtaa

SEQ ID NO: 5456 - DNA, 1008 bp, Enterobacter cloacae
ccggggaggtggtcagtgatgacaacaccttcccgcatcagaaccacggtttgctcgctggcggttgccactttactgggtacggcaaccgcgccggcagctgttgcagcacttaacacggcgcagattattgccagcgccgtgtcgcaaaactgtatcagctggcgtgtcagtggcatctgttactggctgttctgcaccccctttggctgcaaagtgcgcacgtcggtcaaagtcactcacttcattccccagacagtcgtttcgacctatgtcgcgccgggcggtaacccgtggcaggaaatggcgtttgtcagccagaccgccggcgggctggagagtgccgtgaccagcgggctttccggtgtttctgccggaggagccaatccggccgacatgaaaaatcccggccagcgcaagtccgccgttcgtttcaagtatgccgatgcgattggtcacccggccacctccctgattggcggcagtattccgggctattcctgtgacaccgcagccaccccgttaatgccttacttcctgagtacgctggattcggcggcctggcgtacgggcgtgccggagtccctgtatccggaagcgcttgtgcccggccagcgggaaattggcagtcaggccgcagcgaatatgtggggcaacgtctatccccgttcggggtttgtcagccagaccgatgatgacaaagcctctgccgtggtggcacagcgtgtggcagacattatcacccgcgtcgggcagccccatgtttatcaggtgcttaagggcaaccgccatgacgggtactggccaccgggcgaggtcacggaaaacaccggcacgcgcaatcacaaatggcagcggctggctccccacatgacacagtcctgtgccgtcttcccggacgggagccacaccgccgcgagcgataacaacgaagcctttgcgctctggcagccctacagctgctgcaaaaagcgcgggcagaaatttctgggcagcactgatatctga

SEQ ID NO: 5457 - DNA, 231 bp, Enterobacter cloacae
aaattattttcatctttcttttcattaaaactatttattgaagcatctttagagctagatcctatatgtgttatggcagcaataaaagtccataataaaactgcgctgcagcttatcaagaaaccgcctgctataagtgcaactaacgaacaaaggacagctaaaagcagcggtatgtggcctaaccacttcggcagtttgtattgtttagccagtatgacgcagcgctga

SEQ ID NO: 5458 - DNA, 204 bp, Enterobacter cloacae
agggactatagcggattttttgagcaattactaattactgcttcagtgctcagagttactaataaattctctaatatcatcgggttaatttttttcaatgcgttacgacttgtcatcattaaaaaagcatcattatactgtgcttatatgggtcttccccgatcatggtgggagactcataaccccatgtttaacctgccgtaa

SEQ ID NO: 5459 - DNA, 186 bp, Enterobacter cloacae
cacaaatatattcttatttttaaaaaccagatctcgatgcataattattccatttattttccatgcgtaacggcttcccttctcagccaacagttaaagctgacctttttacaactcgcttataaaaagtataggggtattgtttatgccatggataataagtccaatagtgatccaagtttttaa

SEQ ID NO: 5460 - DNA, 183 bp, Enterobacter cloacae
tgttttatatcaatttttagcactgaaaaagattttaagaaaaacttcatcaattcatggttatgcccgttaatacaaataacgccaagtcaaaactatctgcttcagggtatgtctctggactggccctacaaacatcaacggctcccattgggagccgtctttttaacaactactgcatag

SEQ ID NO: 5461 - DNA, 450 bp, Enterobacter cloacae
cgcagttcggcaaccttcctgatgaagaggcctggctgctctccgttcacttcgaagtcgcgaaagacaacctttaaggagcaacacatggaacagattacagtcgtgattggcgatcgcctgggtaaagggcagaaagtggctgcgggtgtggaaaaagccggcggacgcgcggttgtcgtaccgggcatggcagcggatatgaagctcggtgacgtgatgaaagcagaaaacgccaccttcgggatctccttctgcggcagcggcggcgcgggcgccatcaccgctcagaccaaatatggctacaaggccaaatacgggatgcgctccgtggatgagggtgtgaccgccatcaacgaaggctgcaacgtgctgggctttggctttatggataaagaagagctgggcgagcgtctggtacaggcgtggcagaagaaatacggcgcgtaa

SEQ ID NO: 5462 - DNA, 789 bp, Enterobacter cloacae
aagggcagactgatgttcttaattatattaataaaatcgctcatcatcggcggcctggtaggcgtcggtgtcggggccggggctgcacgcatgtttcatgcgcctaccactcagggtatgggcgcgtttcgtacgttgggggaactgaactcctgcgaaggggatccggcgtcccacttctcctttgggttaggtttcttctttaacgcctgggcctcttccgtggccgcaggtgccttcacacaggacgttgaccaccgcatcatcccaaactggggtgctgccgcgctgatgatcaaaaaccgtaacgtcggtgaaacgctgcatgacccgcgcaaaatggcgattgcctgcggcatcatcggcatgattgtcgtgaccttccttaacctgaccgcctcctccgtgcccgcagcgcttcaggtcaccgccgtgaaggtgctggtgcctgccgcgaacctgctggtcaacaccgtgatgccggtaatcttctggctggcggccatcgacgcgggtaaaaaatcgggcttctgggccaccatctttggcggcgcggcacagctgatcatgggtaacgccgtaccgggtctggtactgggtattctgatcggtaaaggcgtggaggagagcggctggaaccacgtcaccaaagtgatgatggcggcgatcgttctgctcttcgtgctgagcggcttcttccgcggcttcgacatgaagatgatcgaatccttccatctgaccgtgccgaactggctcgacatgatccacaactcgctcagcggtaaataa

SEQ ID NO: 5463 - DNA, 642 bp, Enterobacter cloacae
atggaacagaataaaggtttttggtatgccgactggtcgttcccgatcttcgttggcctgctctcctccggcgtgtttgccgggacgcacatgtactacctctacggcatcggcgcgtttaacgaagtggccttcgtggcgatgctgaaagcgggcattgataccggcgtttacggcgcggtggcggcatttggcgcgagcttcctgttcgcccgaattatcgaagggtcgctggtaggtattcttgatatcggcggggcgatccagaccggcgtgggcctcggcgtaccggcgctgctgctgggcgcggggatcatgttcccggtgaccaacttcattgcctcgctgattaccggcctggtgattggtctggcgattggctacgtcatcatcctggcgcgtaagttcaccatcaaccagagcaactccacctacggcgcagacgtgatgatgggcgcgggtaacgcctccggccgcttcctcgggccgctgattatcctcagcgccatgaccgcctccattccaatcggcgtcggttccctggtaggcgcgttgctgttctacatctggcagaagccgataaccggtggcgccatcctcggcgcaatgattttgggctggctgttcccggtcgccctttaa

SEQ ID NO: 5464 - DNA, 768 bp, Enterobacter cloacae
cgaagtattaggacaggagaaaaacgcatgaaactgacccccaacttttaccgtgaccgcgtctgcctgaacgtgctggcaggctcaaaggccaacgccagcgccatctatgaggcggcggaaggccacgtgctggtgggcgtgctctccaaaaattacccggacgtggcgagcgcggtcgcggatatgcgtgagtacgcgaagctgattgataacgcgctctccgttggcctgggcgcgggcgatccgaaccagtcggcgatggtgagtgaaatatcccgccaggtgcagccgcagcacgttaaccaggtctttaccggcgtggccaccagccgcgcgctgctggggcaaaatgactccgtggtcaacggtctggtctctccgaccggtaccgtcgggatggtgaaaatctccaccggcccgctgagcagcaacgcgccggacggcattgtgccggttgaaaccgccatcgccctgctgaaagatttcggcggcagctccatcaaatatttcccgatgggcggcctgaagtgccgtgacgaataccaggcggtggcggaagcctgcgcccgtcacgacttctggctggagccgaccgggggaatcgatctggagaacttcgaggcgatcttgcagatcgccctggatgcgggcgtgagcaaaatcatcccgcatatctacagctcgattatcgacaaggccagcggtgatacgcgcccagaagatgtgcgcacgctgctggcgatgacgaagaagctggtgaagtaa

SEQ ID NO: 5465 - DNA, 225 bp, Enterobacter cloacae
ataaacttatgcacactgggtaagtacgaggttctggtctatagtcattgggcatcaaaatttgcgctcaggacagtcgggccgattgtggcaccgcaagagcgtatgattcgcaggagatacaagaatgaaaattttccaacgctacaacccgcttcaggtggcgaagtacgtgaagatcctgttccgtggacggttgtacatcaaggatgttggcgcttttga

SEQ ID NO: 5466 - DNA, 459 bp, Enterobacter cloacae
ctgttggctgagaagggaagccgttacgcatggaaaataaatggaataattatgcatcgagatctggtttttaaaaataagaatatatttgtgttatttatgttagctaccataggatatgggatttggcgcatgcttggtgactttttttaccttgaacagactatagtttatcggcatgccgtagctgataagtctatgttgtatatcacggaaagcagcgcgggtgcgacgacttctttcgtatataaatattatctttacacggcacaaaagaccgatgaagtttttttagaagacattaaaaatggttatgaacctttccttgtcaccaccgatcctggcgtgaaagttagcattgaagacagaacgatttttcttaaagtaagcggggatatttttaaatttaataatatcgtaggctctgcctttatttatctcaattcgtcccccttctaa

SEQ ID NO: 5467 - DNA, 372 bp, Enterobacter cloacae
ttttattccagagccattaacggggtaagacgagtgattaacggagcggtaatgaacgacgttggggaacaggcggtgcaaacagaacagctcgcgaagaccatgcttcagcaggtctacgccctgctggcccggcacaacatcatccccaacgcggtacaggagcagatgctgacctcccacgttcgcgcaatggcgcaccggtccgtgaccggcgagccgctgccggaggttgaagcagagctgttcgacgaaatttcaccagattcaatgcaacttgcccgtgaagtggtagcgcagttcggcaaccttcctgatgaagaggcctggctgctctccgttcacttcgaagtcgcgaaagacaacctttaa

SEQ ID NO: 5468 - DNA, 357 bp, Enterobacter cloacae
agaagagctgggcgagcgtctggtacaggcgtggcagaagaaatacggcgcgtaagcatgaaagaacagttcacaaccacggtgagagtgaaggggaagggcgacgccaaagcgcgcgcctttgccgacgcgctcaaccacgttcaggccgcggtgatgaaagcctcaccgcatatcttactgcgtattgagccacaggatgtgcaggtcgttcaggcgcaagaagcggtgcgaaaagaagcgtttctgttcttctttctgcgccgggaaagacgcacctacagcgtggagctggatgtgaccgtcaacgtgacagccatcaatctcgaccaggtggatttcgtcacgcaacgctga

SEQ ID NO: 5469 - DNA, 240 bp, Enterobacter cloacae
ccactggtgctgatctctccaggcgacgcaccgggcgggggcaacagcagagagaagattagccagcgcaccggcatccggggcgattgctgccagacgcaaacgcagcgcgttcgccagcgtcaacagggtatcgacctctctgttttgcgctgcggtaacctgaaaagtgttgctgaacgtatcctgcgcgtagtcaaagcagagcgtatcggcgggcatctccagctcacgcgctaa

SEQ ID NO: 5470 - DNA, 201 bp, Enterobacter cloacae
tcgagaagatcctcaataaagcggtggccgaccataccgttaccgatgatagcggagtctgactttgatcattattgcctcgatttcttttcaataattgcctacgttaacgattcagcaggggcacttattgatgcaaatcagatacgccttcacataccccttagggggtatatctatgatttgtcaggattgttataa

SEQ ID NO: 5471 - DNA, 279 bp, Enterobacter cloacae
gagaagaagctgatccatgtgagcttgatgcgattgctgttagtcatgtctggcctgttaaaagtaaagaaaaacgcaatgactgcgtttgagcgggcagattttagtcgcgaaagtgatctaattaaatcttttcagaaaattttgagcacaattgcaggttttaacgtgatgcagatcacattatattgcggggtgaacaatcgtttgcgcggtaataattgtttcaatttggtaaaattaggtaaaagactggtctgggttcatactgctctttaa

SEQ ID NO: 5472 - DNA, 183 bp, Enterobacter cloacae
ttggcgtcagaacagttcgtgcgtctcgccgttatcaatgatctctgtacccacctcatgcaccgcctgcgtggttggctgcgtaccctcgatgaaatactcggcacggctattaccgccattcgcgagctgtccagtgctgcggtcaatattgatcgtgacaatgcccggcggaggcgttag

SEQ ID NO: 5473 - DNA, 399 bp, Enterobacter cloacae
gagcgctatattcatagactctttatttttttaaccgtctcggcaaatgctatgggcaagtttattatttacatgctgaatatattattctgtggttatgtactggctacatgcctcatttctttggttagttttgataactgggaggaccgtacaatcgcaataacaatcatattaggaagtgcacaacttattgcgacattacttaatcgggcattgcctcataagttacatattttaggggggatagctgaactgatagaaggtccgctattagtgattggcgcaattgtatgtctggatgtgtttgaaccctggcctatgaagattattggaatgtttgcgtgggttatttttatgatgtttcggccatcatttacgaaaaggaataaagaatga

SEQ ID NO: 5474 - DNA, 213 bp, Enterobacter cloacae
cttatcgcaaccaacgaggaggtatttatgacgattcgcaacaatcggacagaaatttcgctggctcttggtgaagcggttttagacatcgtgcaaaaaggccatgaagtatcgcgagaaaatctcgcccaggcgatgaaaatcaaagcggagaaagagcgcgacgacgagcggcttcttaactactggaaggcgtgtaatatgctggtttga

SEQ ID NO: 5475 - DNA, 450 bp, Enterobacter cloacae
cgctttctggggggcgctgggctgcagctgctttgcattctgatgaaaaacaccactatgccgccccggatcgacctggggctgttcttccttcgcctgaccggcagcctgctgctgctgtacgtccacggcctgccgaaggtgctgcacttcagcgaagagctgacgcgcattgaagatccgttcggcttcggtccttacgccagcctgatcccggcgattgtcgccgaggtgatctgcccgctgtttatcattgcgggcgtgtacacccgcctggcgtgcctgccgattatcgccgtgctgctggtggcgatgctggcggtccacccgaactggtcgattgccgaagggcagtttggctggctgctgctgattatcttcaccacccttgccctcaccgggccgggccagtggcggctgcagcgtaaggcagcggagaggttcgcatga

SEQ ID NO: 5476 - DNA, 303 bp, Enterobacter cloacae
catgtaggcgggcgtgccgccagacgcggcaagccgggactgggagaaggcgtcggaggtgccgcaggaaagaccgaagctgcacagacggcaggtggcgtcgtgatgaacgaagatcgccccgggtttgatatcgccgtggatcaggttgtgctgatgcatctggcgcaggggaccgcagatgcggatcgccatctcgataaagcgggcgatcccggaaatcgccttacctgcccggcacgccagcagttcaaagcagaatggcgcgtagaccagcgcaaaacgtccgcggtactgggttga

SEQ ID NO: 5477 - DNA, 303 bp, Enterobacter cloacae
cgccggttccggctcgctaattcccgtcggcgggctggtccctcatccggctcgccgctgcctctttctctggagttcacaatgagtactgggctgatatcccttgcggcaggcgtattgattggcctgatgtatgccgtgctgaaggtgcgctcccccgcgccgcccgcgctggcgctgattggcctgctggggatgctggcgggtgaacaggcgatgcgccatcttttatcccgcgataatccggctgccgtgcaggtgacggttccccacgttcaacacccgaccggagcgtcatcatga

SEQ ID NO: 5478 - DNA, 360 bp, Enterobacter cloacae
tcgaattgcgcggggcagcgacaaactatggtagagaatattgagcagcgcatctacgccttagtcagacgctataacggcgtttatctaatgaataacgaagagaagcaaaaattactgaatgcaaaaactgatttggatactgacatgcagcttgatgtcactgaagcagaagatttgatggacgagttttttaaagaatttaatgttgatagagggaattttaacataaacacctactatcctgatgagcctttttcatggaatccattcaaaaaattcccagtggtgatggttccagatttcactattggaatgcttatcgaatccgcaaaagcgggcaaatggttatacgactaa

SEQ ID NO: 5479 - DNA, 462 bp, Enterobacter cloacae
actatggacacaacagaagaactaaatgaaacgtatttttatgctggcagaaccaatcttaccgcggcaggacttttttttatgatctactgtgaatcaattgccgatcattttggtattgacgatgtggcaggaattgctgcgttatacagtggtgctaataatcaaacgactagaaagaaacccgcgggagctacggaaggaacgtcccgagcctcgaaagccatgaggaactatttcaaacaggcgaaatttccttatggcattaagctgcctacctgggttggtgggtacactccgtggacagtaaagtgtcgaatggtatcgaaagtgagtgcgtttgttggcaggacaataccgttaataggcatagtgatattagtcgctgatgtatcactaatcacctatgctgcaatacgtgattataatcgaattgcgcggggcagcgacaaactatggtag

SEQ ID NO: 5480 - DNA, 318 bp, Enterobacter cloacae
tccggctgccgtgcaggtgacggttccccacgttcaacacccgaccggagcgtcatcatgaaggcctggattatttcgctggtgtgcggggccgcggctggggtactttacgccctgctcgacgtgcattccccggcgccgccggtcgtcgcgctgcttggcctgttcggcatgctggtgggtgaacagctgatccccatcggacggcgtctggtgagccgcgaaccgctgaccctggcctggtttcgtcatgaatgcgtaccgaagatcagtggtaccgcgcccccagcgcccgcgaaggaaagccgcgacgcgtaa

SEQ ID NO: 5481 - DNA, 327 bp, Enterobacter cloacae
tgtttcaaaatgctaatagagcgtttaagccttaatttatgcgctacagttaatttcgtgcaacaggcaaataaccgaaacaggagaataattatggtagataaaagcgcaattaaggatcacactcaggttgtcgccagctgcggaacgcacgtcggggttgtggaccatcttgatggtgagcgtatcaagcttgcgaagagcgatccggaatcgggcggcaagcaccattttattcctctcggctgggttgataaagtcgaagataataaagttgtcctgaccaaaaaccataaagaggtttttgctgagtggcaggaagcataa

SEQ ID NO: 5482 - DNA, 645 bp, Enterobacter cloacae
ttcagtctttttcatttacaggaaattattgacccgtccatgatgaaatacattagagatagccttgcattaagtgctttggttaaaagtaaaatggcgaccgatgatctcaaccagcttgaaacattaaaagaacagttaaaagatcggttcggcgttcctgtgggcgtccatatgacaggaattcctttggcagtgagcacgttactggctattttttgctacgccatgctgcaagtgtccctctggttgttgctgtttcgctggctcggcttacccgaatttaaggttatgatgggagtattcattgcagcgattgtatattgtctggtagtgatgagcacgatgtttctgactacacgaggttctttacctggatataaactgcatattttcgtcattacgctgacaggcataatgagcatcatttatttcatctggacggggatttcgcttttattcggccctgttgagaactacacaccgcaaataacctctttgctggggctgggatttttctttctgaacattatgtggatgaattcatcgattttttaccgctccattgcgctaacgctacataatcgggtctggcgtaagcagctcaaaatcgaggcaaggccaatgtcacacctcaaacgttga

SEQ ID NO: 5483 - DNA, 183 bp, Enterobacter cloacae
caacaaggagttttaacatttgatgctggaagaattgttgcagctaacctaatagcaggcaaggagacaaccgtcctaatattcgtttttaagattaatattaagagcaaagttttaaggttttcggattttctttatattgacaaaatagatcaccggaccatttattgcgatatttcctaa

SEQ ID NO: 5484 - DNA, 1059 bp, Enterobacter cloacae
acactattcggaacattcctaattttaagtgttaacaggacctttactcttgttttattaacaatcaacatttcacacggacggagagatgaagtgacattcacaggacaattttcaaaggatcttccagattacgcactcgcacgcagtcttggtcttgcctctggcggcgatataaatttcacagcacttgcaggtcaactggactgtagcagaaattttagccaggccgggattatctactcagacggtacacgtcagtggctagtacggccatcaagaaggattgctacaccaaacgaaagctcggttagtcatgtagtcataaccaaagtaaatgccgcattagttaaccctgttcaggcaacaacggcgacgattaattccccttccctggcaactgaaattggttcaacggccatttcctgcggagccgcaattcttactgttgtacttgcggcaggggccggtatggctatacctctcactgcagggtcttccggtgctatagccgctgtgattttagccggtggtgtagcaactggaattcaatgtgcaaatgggcttggccgactatcgttgattgctatgaatcatgatgattacgttgcgtggatggattcccaggagtggtatacagcaaccaacacagccctggatgcgatttctcttgccggggctgctgcgggtttaaaaagcgctgcattaacatatcgccttcttaaccgttcatcgtctgagagtttgctctccttattacaaaaaatgagccgggccgaccgtacgcgattaacagaggagattattcgtatccgcaatcccggcatctcgaattcaggtgtaaaagcagcaatgaaggcaggcgtgtatcccaaacgttatccgtcagaagcgttgcagttgctcttacagcgtgagttgctgaataccatttcaaattcttctgccttcgttggaagtgccatctcaggaaatatcagaaatccacagaatgttgcacaaacgggtaaatacatttttggtttaattcagtctttttcatttacaggaaattattga

SEQ ID NO: 5485 - DNA, 225 bp, Enterobacter cloacae
ctatatctgaaaaccatgaaaaactttgacaacgaaatgagaattttctctctaatattttctgtttttataattgagctcgtatcattttactttaacatatcagggggccctacggctgtaatgagtgctatcgttgtatcacaaagttttgtcggcgctcaatatttaaaagctcgtaatcggacaatcggcagtcttcaccaacggccggaaggtcagatt

SEQ ID NO: 5486 - DNA, 186 bp, Enterobacter cloacae
cctttgagaattcacccaaagcgctcgcgggctttcagcgttaagctgatttaccgccggtggggaatttcgccccgccctgagaataagcgagataactataacgctattgattaccctgggcaatgcataagcttcaaacaattttgtttaacccgcggcatgacacgctacaataggcactaa

SEQ ID NO: 5487 - DNA, 273 bp, Enterobacter cloacae
cttcacccgcgcgtcgatgagatcgacgatgtcggttctggcaagcaggtcattgatgaaaacgcgtgggattcttccggccatatgccccaaaaatttaagcgacttataaacgaaaacaagccgcgcattccttccggaagcacggccttacgactacaactctgtctgtcaattgagggctgtggccctcaacagattagtacagacgagtacggcgtgcgttttcgcgagccagtttcttcgcgtgacgtttcacagcggaagctttag

SEQ ID NO: 5488 - DNA, 363 bp, Enterobacter cloacae
atgaaaaaaataatcgtgctatcacttctgggcgtagtggttgcggtgggtgctgcggccagcatctattcaaatgaagaaccagaatatattcagtcagcaaaaagccgtgtcggatcgtatttaaccagcgattacggacgtgtcgaatgtaatagcacccaggtaagtgaagatcgctgggagctgggctgtaccaataaggcgagaggcaaaaccttccagttcgccgtttacccacccgagcaggcaccgtatggggtctctcgtgcgttttatctcgaagcgattaatgatgatgcccgccagagtgcagatcaggggctgatgcgttatctgcaaattaataccaaagcgggttaa

SEQ ID NO: 5489 - DNA, 312 bp, Enterobacter cloacae
ccaatattctccacgctcatatcgtacacgcgtgtaagatatatggtcataaagggcagcgttgccccgcggccaattgttaataacaatgacgatgccagcagcgctgcggttgagcgcctgattgatggtttcattttcctgcccgacaaatgcttatgcttttttgttgtgttattacaggattatcatgggatcggcagcttgtatagcacccaatttatccgcaagtgcttctcatcagtaccagaattaatgatcttctcgcggggctattttttctgttaccttgaagtgtttacaaaattttaa

SEQ ID NO: 5490 - DNA, 660 bp, Enterobacter cloacae
aaaggtgaaggaatacattatcggtactatccagtcactggcggttttttgatgaaaattctgcacttgttaaccggacacgtttcttacgagctcctgcaacacggaaaacggattgaggacgctattggccgtcatgacaatgacttattaaaccattccacacccgaactggagcggtatttttcacgcccgcttagtgagctgccacggaaaaatgcttatccggtagcgatattattaccgctatttctggtgatttttgcgtttaatttgctgccatttctccagacaatatccagtatgtcgccaacgctacatacactcagtttttttgtcccatcgctagcgatacttatcttcctgatgctcgcgagtgccttccttgcccggggatacacttcagggctatcagggtttttagcgcttttcatcatcctgctgacattaacggtactgcaatggcttcactatctgaccatttctgatggcagtagctggcagctgatcattgcaacgatcgctttggtaattagccgtatggtgttaaacagtcgaggctttgtgctgttcacgctatattgtcgttcgaagcgtcttgccacgctggctcgcatcatgcgcctaaagagcggcaaggataatgtgaggaacacatga

SEQ ID NO: 5491 - DNA, 234 bp, Enterobacter cloacae
cacgattatttttttcatttattcgatccaatccttagccagaaaaatcttattgtaaatgatttcccaataaatctagttgctctttgcataccagaaatgggagtttacaacgtcgatatcgcttttaagaatagtcttaagcgcgttttattgcgaccacaatttttgacactctattttctcaaatttaaagagtcgaataattactctatgaaattatccctacgatga

SEQ ID NO: 5492 - DNA, 231 bp, Enterobacter cloacae
aaagtgaagatagagtgtcgagtagcgctgcgcttacccgacctggaaaaccctaatcccaggccgggtaaggcgaagccgtcccccggcaaaaccaacaccttagtggtgcaacatctcctccaccacctgctccttgtacatctcattcgggtagtaggtcggccagttatccatctctttcagcagcgcctcgtgggaggtgttgcccataaagatatggaagtgtga

SEQ ID NO: 5493 - DNA, 189 bp, Enterobacter cloacae
cccgtcaaagaagtcaaagtgccaccaggcgcggcggaattcaccgtccgttaccacatgcagaccgcaggcgcactgctgttcgacaacatggcgaatggcctcgtcctcaaccgcgcgaagctgaccggcatcgatctcaccgctggcaaattgcagacgggcctgtttaacagagtccgggcgtaa

SEQ ID NO: 5494 - DNA, 222 bp, Enterobacter cloacae
aaaactgccgactacatcggcgcggtacggggcgtggtgtcgctgcatggaaatctcctctgtctgtcggcgttaattgcccacagtgataattcatttcttgaacatttagacttctggatgtctaaacgtcctaaaaagatgtcataccggctcgccgccgacaaacgagaaaatttcatctgtgttgaaataaattcatgttcacagggcgggcgatga

SEQ ID NO: 5495 - DNA, 339 bp, Enterobacter cloacae
atgcagcgcgccgggcagatgccgccgggcaaaatgttcaggcttcccgacaacgtgcagcagaacaaagtcctgctcaccgctggataccgcgtgatggacatcggcgcagtccgtctcgacgctcagacgacgcagaaaatgccccacggcttcctgcggctcagcagccggaaattcagtaacatagctcatgaatcttcctcatttgtggtgtttgtgttaacactactctatcccttaattcagaacatgaatgcgtccgcctatgccagaaaacagcaaaaagatgacaaacttaagacatccctcgccgcgcgcggtcgtgctggcatatga

SEQ ID NO: 5496 - DNA, 249 bp, Enterobacter cloacae
caccagaagaggatcgacgctgagaatacgccgagccatgaccagtattttacggttgtcatgttattcatcatagggacatcagactttaattatttaaggttgcgaggtctgccctcgttctatattgctgatgtgtatttattaaggagtacaaaagcgcacagtctttattcagactatttgcatcattacgcaaaattcaaaattattgttttttgggttcgtcttccgcgaacacatcaataa

SEQ ID NO: 5497 - DNA, 213 bp, Enterobacter cloacae
acaaccattgtttcaccatcggcgagagtctcttccgctgcgtgtgcgctctggtatagcgttgaaaaaatggcgagcgtaagtgtagccggggcaaatcttattatgttattcatcaactcatttccatttgttaaaaatgcgatgacgaatattaatgatagtcattctcattacaataaagtgacagcaatctccataaaatcttcatga

SEQ ID NO: 5498 - DNA, 252 bp, Enterobacter cloacae
agcctggctggcggtctttcttggctctgccctgttctggatggtggttgctcttcttgtctggaattactggggttgattatggtcatgacggtgcgtacagaagcgagaaaagagatgtgtcagcttcgtgacaatgctcacaaagcccgtaaggcgccagcaaccagcgtgccagcttcctggaaactgacgccacagcagcaggcctttattgatgtgttcgcggaagacgaacccaaaaaacaataa

SEQ ID NO: 5499 - DNA, 297 bp, Enterobacter cloacae
ctcctgatccatgatattgcctctgtaattattgtggtgacaaaagaagcataccctcagccgatccgcctgaccacgtcaaaaacgaggtttggccaccctcttttcaacacgttatttcgccagacacttaagattattccgaatacagaagcacccgttgcgacgatatatttttgcgttgtgtcaactcttgtaataattcacgccacgttcacattaggattattagctaagcgaactcccaacatccagatttatttctccctaaccagtggatttaccgtccgtttttaa

SEQ ID NO: 5500 - DNA, 426 bp, Enterobacter cloacae
gtccagttatttccccggagtgattcgatgaagagcctgccgttctttttcgctgtattaaccctcagcacattaacagcctgtagttctccccaaccagacaatgttgaaaaaattaatcatctgcaaattccactggtgttgccgggggaaaaatcgccgcaggtacagatatcgcatatcgcgtctctttatcaggaaaataaacagcagatcgagaccctaacgcgcagcgtaaaatcacagtatctacaggacaccaccgcaaaagaaatttttgttgcggacagtgccgttcaacgcgtctatgcctcgctgaccaagctggaacagctagatatggttaaccagcaatacctgaaagataataatgtcacgggcctgcaaaatattcatatcgttcttgaaccattattcaccagctga

SEQ ID NO: 5501 - DNA, 843 bp, Enterobacter cloacae
aatgaccagacacattttgggaaggagtctttaatggatattgcgttgcttaacaggggctggaacagaacatggtcagataccatggtgaatctagaggcccggaaactcgtcgaaacagcaaaccggctgtcagcattctatttgcaagatggtcttacacgtatcaagtttgtcgaagagataaaacaggttgcagataaagaatttgaaacagcacgacgagctaaaaccgatgaagaatgcattgcatgcatcaaaaatctgcgtgctgaaacagataatctacacgaacaagaacgcctgttaagaaccagagccgcacagctttacgcgaaggtcgagtttgttaaggaaaataataaaatcgtcggttatgttatatccgccgtaaacgtggtgctatcaggcgtggttctctttggtggctttatgatgttatccactatggggccgattggtatgctggctggggcagtcctgattgccgatggaatgaacggattaacgaaagaagtgctcaactttgatcagccagaaggacataaaccctcgcaaggtatcattgctgactccgcgatgcatacggcccagttcatgggatttaatcctaacacgggcttggctctctataatggtgttactctcggtgccagtgtgtacagcattgtaggactcgctcgaaaaactggagcctggagattatttcgctggcttccacacgattactatcgcaaagtcagcacaatgagcactcctaagctaacaatgaagattgtcggttatggtgttaaagcaaaagtgattttcgatctattgacaaccgaaaatggaaccagttaa

SEQ ID NO: 5502 - DNA, 372 bp, Enterobacter cloacae
ttgcttgcacaatcagcgattgggaaaacacttctgggagataagggacgagacgatatgaaagtgactgatgaggctttgttacgttcagggtttacgcagcccgaattgcagaagataaaaagcaacattgaaaaatatggaggaacgcttggagaggccataaatgacctcgctaggcgatttgttaccttggcgggagtggtggctgtgtgtgccttaatcctactgctacttatcgtcttcagctcacctgatagagcagttgcatgggggctggcgatgatctttggggttgccattatgtccttcgcgcagccgccggtaatttcctataaatcctggcgttaccgaaaaactatcaaggattaa

SEQ ID NO: 5503 - DNA, 204 bp, Enterobacter cloacae
gttgcacatttcctgtaccctggataccctgagattaatcctaataactcaagggtgagtatggctaccgggaagagaaagaaccaaaaggaatcacctgaagaagagttagatcgcttgctggatgagcttgaactcacagaggagcaacgggagtttatcgaatccatgcgggaggataagggcgatcccagtagtgagtaa

SEQ ID NO: 5504 - DNA, 219 bp, Enterobacter cloacae
tccgtgaaggagacgatggtcagcttcggcgatgccgcgccggttcgcgggctgttggggtcgttaaacaacagttttgccagctggtcgctggaagcgtcatctgacggtgcggcgaaaccgaacgttgataacgacagcagaagtaaggctattaaggctctcatgttattttccttttgcatcggacagggtgctcagcaccgcttcgcggcttaa

SEQ ID NO: 5505 - DNA, 570 bp, Enterobacter cloacae
gtcttaaaagcattttcacagagaaatcaaaaatttcggcaattaagcgaaacggtgacgactgccatggaaccaaaaaatgaaaaagtgcctgggataaaagagagttatcgtttactgacgtttgagtacgcatttcgtcaggtgggttttattgtgctgttagctattatcgtggcggcaattgccgggctgttttcaagcggtgtggtcagcgacgtggagaaaacaaacgatgcaaaatccctggctctgagctatgagcgcttcggtcgccgccagaccgaatcgcggatggcgctgacgtttccggtgacgtctgaggggaaatataccctcagcctgaccagcgaaagcagcgacgcgtatgagcccggcagcgtctggccacaaccggacagcatgtacagccgggggaataccctgtttctcgtctacgatcgtttacaacagaccgataaatttaccgttctattattcatcacgccgtcaaaagcagggaagtggacaaacagcatccgcgtaaacaacgagccagatatccgtttctggcagtttatttacccctag

SEQ ID NO: 5506 - DNA, 366 bp, Enterobacter cloacae
aaactaccaccagaaacgccaacttcgggtggcagactgaaccggtttggcgtaccgaccatatggaaaatcggcgcttcaaaagaagccccggttcagtccaccataatagaagatacggattataccgcagctaaaaaaagagtgaacgaaaccaatgatgttgcgttagcaacatctttccatatgtgtgtaatcaggacgccaatcccgacacctgattttgcaggtgcgccgccattttattactgtgaatttatccagcaactgacttcgaaagaatctggaaagcgcctcgcaaaattcctctgcggtctgttgccctcaccccaaccctctcccacggggagagggagaaaacactaa

SEQ ID NO: 5507 - DNA, 633 bp, Enterobacter cloacae
  unsure (80)
tgtcgaccatctgccttgcggctcagcgcagctatacaaccggggaatcggtctggttttcgtaccgcctccccagcctngaaaaacgtattcggcaaaacagcgttatggctggtcggcctttgcgccatgctggttgtcggcctgtatatgcacgtctactggaacctgcgccacccggcacctgaaccgatcaacgccagcgttgccaaaccggaaacgcagctttcggaaatgcattacgtgtacgtgagtaaaccgttcccgcatccgcagcctaaagttgcgccagtgcatgttgatgttccaccgatgcaggatctgccgatcagcagtgatgatgccgactggcagcaggcgcccgagggcgcggtgccgcacgatacctcgcgggataccttacccggaaccgaggcgcatgagcacgatatcgcccccgccagcacgagcagtgaagagtcatcattaacggaattatttaagcaggcattaaaagagcaggagcaggattattctcaaggaaaaattcccgcgccgccggttgacgaaacgcaggataattcacaagcgagtgtaaaaaacagtggaaatagccgttctcctttgagtgagaaaggagaacggcgggagtag

SEQ ID NO: 5508 - DNA, 186 bp, Enterobacter cloacae
cgtcctgacgtttatcctgtcgtctcccctttacgaatgcgctttccgttcggttgtaccgtgacgcttgggcaatacgctgagactgttttgctgcgttttaaacgcgcaattctttacttaattgaggaatttcggcattatcttgccggttcaaaacttggtagtgataccccagaggattag

SEQ ID NO: 5509 - DNA, 477 bp, Enterobacter cloacae
  unsure (187)
ttttcagcttttaatatggaaattatgaatatggaaaaccagtctatctcccagctctatagcgaactctccctcaaccccgatctcccaacccttgccgagcgctgcaaactgctcaccgaaatcctcctcgactgcaaatcacttccgcaaacgcagcccgtttgccgttgcttcggagcttacntggaagaggtgaaatccggcctcacagagtcaatgcgtgattttcaggtggttgaatttgaggacgacgcggagcaaccgcgacaaaaagagtggttgctggaagataccgaaacgaaatgcgactactgccgggcgttaaaccatgtgctgctggtatcgcatgttgaccgcgatatgctgccgcacctgacgggactgctgcatgacatcacccacgcgatggctgaagatttaatcgtacccatgaacccgtgcatgactatacatctgccgacacagccacactaa

SEQ ID NO: 5510 - DNA, 183 bp, Enterobacter cloacae
gagcgttgttccttcttccgcctggtgagcatattgaatttatatgcaatagaaatgattaagtattattttaatcacaaaaaaaagcggataacccatcaggttacccgctccatgaataccgttttatgcatttgcgtggttaattcctgcgctcaaacgctaacgccttacgctcgataa

SEQ ID NO: 5511 - DNA, 192 bp, Enterobacter cloacae
tcacacctgttaaagttatattttagatacatgtttaaggttatgcctgtgccacagcagagaaaagtgctttcttatactaagtggagggttattgatttagcgcaattttggcggcaggttcactaccgccaaagcagtatcaggctgagaagaacgccatcagaatgggtaccagcaggctcagaataa

SEQ ID NO: 5512 - DNA, 2325 bp, Enterobacter cloacae
ctgatgcagaacgccagcgctttgccgcaccgtaacgccctgcgcccggcgctgctgtgggccgcggtatgcctgatcctgctgggcgtgctgctgtcgctgctgcctggcgcgcggctgaacagcagcgtgctcgccatgctgccgaaacagacgctcggcgcgatccctcccgctctcaacgacggatttatgcagcgcctcgaccgccagctcatctggctggtcagccccggcaaacagccggacccgcgcgtggcgcagcagtggttaaccctgctgcaacgcagccaggcgctgagtgtcgtaaaaggtccgctggatgccgccgggcaacaggcctggggagatttcttctggcagcaccgcaatggcctggtcgatccggccacccgcgcccgcctgcaaaacggcggtgaagcgcaggctcagtggatcctgtcccagctctactccgccttttccggcgtgagcggcaaggagctgcaaaacgatccgctgatgctgatgcgcggcgcgcagctcgcgctggcgaagaacagccagaagatgcagctgatggacgactggctggtgacaaaagatgcggccgggaactactggtatctgctacacggcgagctggcgggctcgtcgtttgacatgcagcaaacccaccagctggtgaccaccctcaacgcgttgcagcagacgctgaaaagccagtatccacaggcgcagctgctctcgcgcgggacggtgttctacagcgattacgccagccagcaggctaaaaacgatatttccacgcttggcgtcgccacggtgctcggggtgatcctgctgattgtgtcggtgtttcgctccgtgcgtccgctgctgctgagcctgctctccattgccatcggcgcgctggcggggacggtcgtgacgctcctgctgttcggtgagctgcacctgatgacgctggtgatgagcatgagcattatcggcatctcggcggactatacgatttactacctcacggagcggatggtgcacggcgcggaacactcgccctggcaaagcctggcaaaagtgcgtaacgcgctgctgctggcgctgctgaccaccgtcgtggcgtatctcttcatgatgctggcccccttccccggcattcgtcagatggcggtgttcgccgccgcaggactgagcgcctcgtgcctgacggtaatgttctggcatccgtggttgtgccgtggcatgccggtccgcccggtccccctgagacggataatgcagcgctggctggacgcctggcgcgacggtaaagccctctccgtcgggctgccggtagcgctggcgctgctctccgccatcgggatcgccagcctgcgggtggatgacgatatcgcccggcttcaggcgctgccgcaggacattctggcgcaggaaaaaaccatcaccgccctgaccgggcaaaatgtcgatcagaagtggttcgtggtgtacggcgcgtcggctcagcaaacgctggagcggctggaggcatttaccccggcgctggcgcaggcgcaaaaagccggtgaattaacccgctggcgtaccctgccgctgaactcgctggcgcgacagaacagcgatctgcatctgctgcgcaacgccgcaccgacggtggtcaaaatgctgcaaagcacggggctgaacgccgtccctccgaacctgaacgccatgcctgtcagcgtggaagcgtggctcgccagcccggccagcgagggctggcgtttgctgtggctgacgttgccggacggcaaaagcggtgtgctggtcccggtcgatggcgtcagaaacagcgccgcgctcggtgagctggccacccgccatcccggggtcgtctgggttgaccgtaaggccagcttcgacagcctgtttgcgctctaccgctcgctgctgtcggggctgctgggcgtggcgctggcggtgattgcctgcggcgcgatgctacgcctcggctggcgaaaagggctggtggcgctggtgccgtccgtgctgtcgctgggcggcgggctggcggcgctggccgtgacgggccatccggtgaacctgttttccctgctggcgctggtgctggtcctcggcattggcatcaactacacgctgtttttcagcaacccgcgcggcacgccgctgacctccatgctggcgattaccctcgccatgatgaccaccctgctgacgctggggatgctggtattcagcaccactcaggccatcagcagctttggcattgtgctggtgagcggtatcttcaccgcgttcctgctcgccccgctggcgatgccgtctaacaaagagaacttaccatga

SEQ ID NO: 5513 - DNA, 312 bp, Enterobacter cloacae
ccgggtcatcggcgacgatcagcagcgtttcgccactctgcatgttacggacggttttacgcaccatcattaccggctccgggcaacggaggccctgagcatcaagcgtgtggtctgggctggaaaacaggtcggtcattttcttctcgttcaggtaaaaacggctgtagtttacgccccgctatcgccaatgcaaaccaggttaacgattgcgtgaaaattagccattgcaaagtgtcgtcaaagcagtatcatgcggcggctttattgggttccctcaccccaaatattaatcaaaaaggtacaatatga

SEQ ID NO: 5514 - DNA, 375 bp, Enterobacter cloacae
ctgcgcagctacaggagttgtttcatgaagatccctgaaatcgggcgcctccagcccgatccacagcatctggagataaccttttatcttgatcctgacctgctctggtttaagggacatttcgccgtacagccgctgctgccgggcgtggcccagctcgactgggtaatgcattacgctgccgcgctggcgccgggctaccgttttcacagtattcagaacgtgaagttcgccgccccgctgttgccggagaatacggtcacgctgctccttgcctggcagcccgaacgcgagatgctgacctttagctaccagcgccatgcgggtaacgagcgccacaccgccagcagcgggaagattcgcttatgtcagtaa

SEQ ID NO: 5515 - DNA, 183 bp, Enterobacter cloacae
agttgtaaagttttaaaaaaacacatacaaaacatgatgctaagtgtgtatcacacgctgttccaacattataccttgatgttcttgcaggaactgcaatttacaggaggaaaaaggtgtttttgtagttatctggcgttacgtgacagtgttggtcagatacttccacctcttcagagttaa

SEQ ID NO: 5516 - DNA, 723 bp, Enterobacter cloacae
atgaaatttacacttacccttatcgactggcaggcaagagcgccaggactcagcgatgccgacgaatggcaggcatggtcacgccggtctgacgccatcgatcccgctgcaccgctggcgaaactgaccgatctgccgatgatgaccgcccgccgcctgaattcaggcagcaggctggccgtcgatcttggcctgatgatgctgcgcaaacaccgcatcgatgccgtcgtctacagcagccgtcatggggagctggagcgcaatttccgtattctccaggccctggcggcagaacagcccgtttcccccaccgattttgccatgtcggtacacaactcggcggtcggcaatctcactatcgccgcgcgtcagcctgttgtctcttcgtcggtttccgccggtatggataccttccagcagagcttgtgcgacgtgctgagcctgctgcatgcgggatactcccgcgtattgctggtggatttcgacggtctgctgcctgatttttatcacgccgggttgccaccgcagatgcccgtctggccctacgcgctggcgctggtgattgaagccggaaatacgctcagctgtgaaacgcacgtcaaccgcacgcctgaagagcccgcgctgccgcaaagcctccagttcctgcgccattacctgcgggacgagcgccagttcaccctgccgggcgagcgcctgctgtggcaatggacgcgccaatga

SEQ ID NO: 5517 - DNA, 819 bp, Enterobacter cloacae
cagaacaacaaacgatttatcaggaagtctctgcgcttcttattacgctgtttgaaatcgccccggaggatattacccctgaggcacgtctttacgaggatctggacctcgacagcattgatgccgtcgatatggtggtgcacctgcaaaagaaaacgggccataaaatcaagcctgaaaccttcaaagcggtgcgcacggtgcaggacgtcgtggacgttgtggaacagcttcagcgcgacgcgtaacgtgcgttcgattcgagttcttcccgccctgacggggctgatgctgctggcatggccgtttttgatcggcttcgggctggcgaataatagcctgcacgggatactgcccgtgatggcgctggtgctgctgatgcgcgtctgccaggcccgtcggcagggcggccccctgcgttatctgttcgtaagcgtggcgctggccggcatagcgctttgcgcggcgagctacgtcctgcacgcgcaccagtgggtgctgttatatccggtggtggtgaatctggtgatgctggtggtgtttggcggttcgctgtggacggcaatgcccgtcgtcgaacggctggcgcgcctgcgtgaaccggacctctcccccgtcggggtacgttacacgcgccgggttacccaggtctggtgcggcttttttattatcaacggggcgatcgcgctgtttactgtattacatgccgatatccgtctgtggacactgtggaacgggatgattgcctatctcctgatgggcacgctgatggctggcgagtggctggtgcgacaacgggtgaagaaaaacgatgcttaa

SEQ ID NO: 5518 - DNA, 759 bp, Enterobacter cloacae
aaaccgtctgcgcatcgcctatcaaatcttcgacgcgcaaaccgggaaacgcaccaccaccggctacaccattcaggtggcggtggaagaagcaagccgggagatgtgctttgtcagcccggccattctgttcgaacgcatggggatcgcgccatgaaatggataacgctactcgcgctgctggtaagcccgctggtgaacgcggtcacgctggatgaactgcaacagcggtttgcggagcaaccggtagtgcgcgcacacttcgaacagatacgcacgatcaaggatatgcctcagcccctgcgctcgcagggggagatgctaatcgcccgcgacaatggcctgctgtgggatcaaaaagcgccgttcccgatgacgctgctgctggatgacaaacggatggtgcagatcgtcaacggtcagtcgccgcagaccattaccgccgacactaacccgcagatgtttcagttcaaccatctgctgcgggcgctgttccaggccgaccgcaaggtgctggaagagaacttccgcatcgatttcaaagacctgggcgaaggccgctggtcgctggtgctgacgcccgtcaccacgccgctggacaagattttctccacccttgatttgaagggcgcgatctatctggaatccattcgcctgaacgataagcagggcgacacgacggatatcgccctctcccgccaccaactgacgcccgcccgcctgactgatgcagaacgccagcgctttgccgcaccgtaa

SEQ ID NO: 5519 - DNA, 594 bp, Enterobacter cloacae
caaagagaacttaccatgacccgtttcattcgcctggcggcagtgatgatggccctgttgctggcggggtgtagccatacgacgaaccgcgatgacgcgcgccctcaggcctggctccagcccggcacccgcgtcacgctacccccgccgggcatcacgcctgccatccgcgcgcagcagttgcttaccggcagttttaaaggccagacccagtcgctgctggtgatgctgaacgccgacggaaataaagtgacgcttgccggcctctcctacgtcgggatccgcctgttcctcgccacctacgacgacaccgggatccacatcgagcagtcggttgtgatgccgcagctgccgcccgccagccaggtgctggccgacgtgatgctgagccactggccgctcagcgcctggcagccgcagttgccgaaaggctggacgctgaacgatactgacaccagacgcgaactgcgcaaccccgatggcaaactggtcacggaaattgtctacctgaaccgtaacggcaggcgcgaaccgattagcattgtgcagcacgcttttcactaccacatcaccattcaatatctgggtgactga

SEQ ID NO: 5520 - DNA, 672 bp, Enterobacter cloacae
gacgtatttatgaccaatatgattgccgacgaagccgtggcgaagtccagcgtgctctctgtctttgactttgatggtacgttgacgcaccacgacagttttatcccgttcctgcgctttgcctttggcaagcgctactttgctggccgactggtgcgcatggccctgcctacgctgcactgtgtgcgccgcaagctgacgcgagatgagctgaaagaggtgttgatcaaaaccttcctgacgggggtggatgagcactggttacgtcagcaggcggaagccttctgtgaaaaatactggaacaagctgatgcgcccggaaggtgtgctggccgtcgccaacgaggtcaattccggtgcggaagtgacgatttgctctgcttccccggcgctggtattgcagccgtgggccgataagctcggcattaagctgattggcacgcagctggaagtgaaagacggcaagctgaccgggcggatcaccggccacaactgccggtgtgcccagaaggtggcgaggctggagaaggtgtatggggatttgaacgcgtatcacctgcgcgcctggggcgacacgcgtggcgaccacgagttgctggcggcggcgcaggatccacactggcggcattttcatcatccgagcaagcgccgaaattcaccaattaagggttag

SEQ ID NO: 5521 - DNA, 717 bp, Enterobacter cloacae
  unsure (520)
aataaacgtatagcaataatgtacgggaacaacgagatcgtcagttatttacaggccaataaaatacttgcgcttaaactcgaccatgctgttactgcggtcggccagaacgtcaaaacacaggtgaatatgatagggaaaggcgccactcggctgttgtattacgcctcatgtttcactgatgaatacaatgatgtttgcctgagacagaagagcgaagacctacgcttcagagatgccgtttataaattagtaagcggtgtggatgtagtctatgaaatgcttagactgtattttgaggaagttttcaaatacaaaaatcctaaacagttagagtatattaaacagcggctaatggctgtaaatgtccacatcgctgcggttagccttaccggtgccgggtttacattagccgttgccgcctgcgttcgccttggattaaatatcagcctcgaattaagcgccattaccggaagatgggcttcccgaggtattgcttttattgggctgtatggggtantacagcaagccgccgatagcgcgcatcgtctgtacgttgaatttcccgcctggtactcggcactttatgctcaagggcttgaaatgctttattttctcattgagcctgtgtttcgctggacggacgcgacacgtgcgctatgggcatctgatgacgacatcgcggatatcatcaccaggttgatcagattacaatga

SEQ ID NO: 5522 - DNA, 732 bp, Enterobacter cloacae
ggatgcgagatgaataaaacgtggacccgtattgtgattgtcgtcattgcggctgccgccgtggcgttctgggtgtttttcgacaggcagcgcgccccggaacggcagatggataacgcccttaacgcgatgcccgcctggcaggtgattaaggagcaggagcccgcgctgcatcagcgcatcctcgaccagatggccgccctgcaaaaagcgggcgagccggagcagcagattatcgacaccatccagccgcagatcctgcatctgcagatgtcgcgcctgcagaacgccccggacgccaacgtggtgaactacatgaccatcaacatggagcagaccgccgccatccagaaggtgagcgacgacgcctgcttccgcttcctctacccgatggtgaagggcggcatcaacccgatgcgtatgctggataaagacctgatgacgcggcgcatgcaggccgacgccgacatgatgcgcgcggcctacggcaaaaaccgccacaccgtgaccccggccgaacgcgaggcggctgtcgaggatgtgcggccgattatgaagcaacttgccgataagtacggcgaggacatccagctgctgcagatgccggagaaagcggtgggcaaagagaagctctcctgcgatatggtgcaggagatgtgggccaaggtgctggcgctgccggagcagaaggcggcgagggtgatacggctggcggtgtctgagctggactga

SEQ ID NO: 5523 - DNA, 237 bp, Enterobacter cloacae
gcgcggctggcaggggattctatatatccgtgtgcaagtgcggaagacgcaaccgttaatgtggttaccgccagcgcaattttagagagtttcattcatcatccattaattagaatagagcaaggcagcgtcagtctattaatggagtggcggatgcgtcatttcccggagagagtaaaaatggtcgaaataaaaaaaggcagccagagctgccttctctttcttgaaataaattag

SEQ ID NO: 5524 - DNA, 1119 bp, Enterobacter cloacae
actaaggaacggacgatgccggttcatcatgctatctggcggataggggagcatccccagccgctcaccatcagcaaactagccagcgagcaactgctggagaagatgattttaaacgaccccactatcctctctgatcagtggatgatcatcggccatcaggaaaatacgctcgataaagggcgtatcgatctgctggcgattgcgccggatgcctcgctgatcctgattgagcttaagcgtgaccgcacaccgcgtgaagtagtcgcgcaggcgctggattacgcctcctgggtggatgacttaaccgccgaccgcctgtcgcagatttatgaaaaattttctggtggcggaaatctaggctcggcatttaagcaacgctttaataccgaactggaagaagagtcgctcaatcagtcgcatcaaatcattatcgtggcggcggagctggatccctccaccgagcgtattgtcgattatctgagcaagaatggcatctcgattaacgttctgttctttaaagtgttccagcacggtgacgaacagttcttaagtcgtgcctggcttatcgatccgagcgaaacgcaaacaaatgccgcgcaggccactgccggaacaagtgccaatgctaaggaaccctggaatggcgagttttatgtctcgttcggcgatccgcaaagccgcgtctgggaagaggcacgtcgatatggctttatcagtgcgggtggtggaagctggtatagtcagactttaaaacagcttcagccgggcgaccgcgtttgggtaaaaatcccagcaacgggttacgttggagttggtattgttcagagcgcagttgaaccagccagcagctttacgatcaaaacggaacacggcgaaatgcctgcaatagatgttcttaaatacagcgatctgtatcgccagaatgcagacgatcccgacaagtcagaatattttgttcctgtaaaatggctggaaacccggtccgagctcgaagcggtgaatgaggtaggtttctttggcaaccaaaacacggtctgcaagccaacgactcccaaatggcgttttactgtagaaaaattgaagcgctatttcacgcaatgggatacagagaaataa

SEQ ID NO: 5525 - DNA, 282 bp, Enterobacter cloacae
gtggatcttatgacgttgacgaataggactaaaaccattctccgatggggagggatttgcattgtcagcgtgggttacttcctcggactgtttgtagcctcgcaagcattcgcggttttctctgaaaatcagactcttgtctcaaatcctgttccattgagagagtattaccaagcggttgattcacttggtcaagctacaagcggtgtttttgatgcagcaatttatggtttcgtgatcagtgtacctctgatcctacttatcttcaaaaaggtgagatga

SEQ ID NO: 5526 - DNA, 210 bp, Enterobacter cloacae
ttccgggtttgccatggctcaatcctctttaaagtgcggcagatacttctattttcacacacggacgggtttgcctccacctttgttggaaagatttgtgaaacggggttgcaaatgaataattacacatataaagtgaattttaattcaataagtggcattcgccatgtgaggataaaatgtctgatctgtacaagaaacactttctga

SEQ ID NO: 5527 - DNA, 456 bp, Enterobacter cloacae
ccttatacaggcattattaaaatgaataaactcatttttcttgtgttattcagcacagccgcattgggggccgaagattttcagataccgatgcagcgcgcccttgaattcaatcgctggtacgtcaaacaagtgaacaacgatcgttatcccatccaacagggaaatgaaatcgatgagttcgttacggccagtaccatgaaaaaattacgtcatgcagacgatccccgttatgccgacgctgaattttacgaggctgatttttttatgaaatcgcaatatatcggcgaggactgggctgagaatgtggctattgattcgtatgattcagacccggtctgtgtaaacgtgaatatcacgtttggcaaaaagacccagcacacagtcattgattgcatgtttaaagaagatggggtctggaaaatccagtctgtcgccgctcgggataataattga

SEQ ID NO: 5528 - DNA, 258 bp, Enterobacter cloacae
agcgcaccgcgctggtgcataagcaaattaattatttactcagaacgcattaatattcataaagaaccgtttgcattgagtaaagcgtgcattaaatcgcttgatcccaaaagcgagctgcgtataatgcccgacaatttgccgggaggaagcatggtcaagcgtgtacgacataacgtcttaccgcgtctgaaatcagacgctggcctgccgtttttcttcccgttgctaaacctattcccagagcccctcatttga

SEQ ID NO: 5529 - DNA, 498 bp, Enterobacter cloacae
ccacaccaattatttctaaagcaagtagagggacctatgaagcagtacaccaacaaacttacaccagaaatgctggcagcttttgacgaatcaccatttacagccgaacaactcgccggaatgaacgacgaagccagttcactcatcgaaaaacaaaacgcctacaatctcgctcatcccgttacagctgcttatctgatcgctacagagggcagcttgacacgtaatggtgggaaagtttttagtgaatataacggacggcagatcaaacttgatgacggcacaatgctaaacgtgtctcgagttggcgatgaagtgcgttacccagatggaacatccgcgaagatcaccactggtgcgggaaacacaccaggcgaatctattgccctggttggtagctcgctggataacggcgatgaaattattagctgcccacaaaatgccggaagaagagtagtccgagccggggaatcgttgccagaaaactttctgaaataa

SEQ ID NO: 5530 - DNA, 219 bp, Enterobacter cloacae
gtggtcgggcgttcaaccttcgcaggccagggcattaagggaaggtcgcctgccggtgcggcaaaggcggaggcgccgagcataagcccggcggttaagagactgtaccgtaacatgaatgttccttatctgacgggccaaatacaggcaaaacattctgttaacatgcgctcaaattgtcgtcaagcgaatgcgccgacggagatcacaggttgttga

SEQ ID NO: 5531 - DNA, 357 bp, Enterobacter cloacae
cctactaatcgtgaatattatctaagtaactacaaaggagagtatatgcgcgataaatttattgatgcgattcatagtcgctctaaaatcatgttaactttttattcaaaagaagataacgcgacaatcacgagattaaccgctcctatggacttcggccctagccgtagagcacatgataaaagtgacaggtttcatttttgggattacgaaagtgataaaaaaaatcatgttctcagtttgaggcctgaagctattaaatctctagtagtaatcgctcaaaattttcacccgcaagagtttgttaactggacacccaactggtttatccccagagattgggatcaatactcttaa

SEQ ID NO: 5532 - DNA, 1152 bp, Enterobacter cloacae
aataaggcggtcactatggcatcggttaacagaggctgcacagttcacggtaagaacgttggtctacacggagataaaacctctacaggcgcacaatgtattgccgcccgccccggtatgtctgttatgggcttgtggaaactttacatcggcgataagaccactccttgcccgaaatgcgggaaagtgggggtaattgtgagcggtgatcctcgctgctcaaatagtgtcgcagtcgccgtggatggtgctgaaatcctctgcggttgtccacagggtactaattttcttatcgcacctggcaccgttgaggttaataccccttcctggactatagcgcctggagagccagtgcagcacgcacaggcagcgaagaagcaaaacagctttactgacacctgcaagccagaagataatccgttattgaacggcgtttacatctggactgaaaccacagacgcaggacatgctttcgtttccgtacatcaagacaattcgatttatctctatacctatggtcgctacggcagaacaggcccagggaatttaactggtgacggaattttaaactttctgcaaggtgaagatgcgagggtttactatagagcagagctgtaccggatgggcgcaagagcgtttcgaatagatgatgctgatccgacaaaaacaaggcagttctttgaagatctttggaataagggtgaaccagcgattcgcacatcggaaatgaaagaaacaacccaacgcagaggccgcacaattgatgagtacgacgtaacaggaaacaactgtaccactcactctgttgaagggattaagtttgctggttcaagggtattcgagcacaactacacatctactacgacgcagattcctatcgaatccgcagaagatttcacaatccctgtctcattgcagcgttatcttgagtcaaaaagttctgacttctcatcaatgacagttgttgaaatgacaggcgagtttaaaaaaatgtatcccaacaaggacaatttgccgcgataccaagagtcaccaaagggtaaagttcagcacatcgcagccgaagcagcggctacaggcgattcattatcacagtattccagcggtacttttggcggtgtattaggtggatcttatgacgttgacgaatag

SEQ ID NO: 5533 - DNA, 462 bp, Enterobacter cloacae
ggcaggggtaaactgttgggcgacaaaatgtggacagagccgaagcgccctgcgcagccagtgcagcaggcacaaacgttgattaagggcggaaccctcaattcggtagcagccatcatggtgcgtgacgatatcaagccgatgatagcgctggatttcatcgcgcgtctcggctatatcttgccgtgccatgacgtcgtccacgccgttggcagcgattatgctctgtgcggtgacggcagcatcgggcaggtaaagcatcaaaagcacctggcagcggcgctgcgaactggaaagcacagatggaatttcaagcgtcgtcatcatctgtcgggtatccagtgtgaatgtttgataagaatagctaaaggatgggcgctgaaaagcgcaccggcaggcctttcactcaggattgctggcgaacatcacagaatttttgacgtgaggaacagatgcaaatag

SEQ ID NO: 5534 - DNA, 345 bp, Enterobacter cloacae
cacgaattgataaataatttgactaggcaagaatgtgatccagatctacacttacggcacaggcgaaaaacttgcctcaggcatatcgcattaaataagtatgagaataaaattatgaaaaaaatcaaaaccgctacagcagcgatggtgctttccgcactttcatttggcgtatttgctgctgataatacgcaacctgccaatgacgttaacagcccaatcgggatcgctaaagcctctgatgtagaagcaggctccaacattgcccctggcactcagtctaccggccagtcaatgaatgatgcatttgatgtacataagctggtggcgggtgagtggtcctga

SEQ ID NO: 5535 - DNA, 291 bp, Enterobacter cloacae
aacatattccgtggatttctgtaccgcatagcgcgtctcaccatcttccgccagcaggacgccctggcgaaacggcgtaaagttcagcgtatggggtgccatatgaagctggaaagcctcgctttgacgcgtgatctgctgcacgacccgatagcgcacgacgggttcccgggtgggttccggcgcaaccccggcgagcaacgcccggagcgcctgatgcgtaggggtaaaacgcgtcaggtcgttttgcccgaacggcagcgcttttcccagctccagggtacaggataa

SEQ ID NO: 5536 - DNA, 186 bp, Enterobacter cloacae
atagtgaatatttttacgacaagcggcgctttgccgcatgaaaacaagaaagagtatgcagaggccaaatataattctggaattgtgatcgctcgcgaaatttatcggtcgtttacgccctgttcgagggcaaaacgcgccgaaatggtgcaaatattgcaccgttggcattatctgtcgcagtaa

SEQ ID NO: 5537 - DNA, 192 bp, Enterobacter cloacae
gatttatctctaagattcatagcctgctattattctgaatccattttgacgttaaaaagtgcaattataatttctaacgggcatttctttgtattgttttgttacaaacaggtgccagccgatgaatattcagccattttttactccccccttcagacctcaacgcacacgaacgaatccatctggctttga

SEQ ID NO: 5538 - DNA, 210 bp, Enterobacter cloacae
agaggggcggttgcccgcccctctcaggtgcgacttgaacctgaatcaccgaacgtatttcaggacagcatcaagcagttgcaatacagcaacaatgagtttgaggacaagtatgaccatatccacgacgctcatacgcgtctccttttggttaaaaggagcacgatgctggcgtacctttccgccgcctgtggccagcacctggattga

SEQ ID NO: 5539 - DNA, 459 bp, Enterobacter cloacae
cgagggaatgctatgtcgcgtctgttaattgagcctgttacgcctgatgaaccgggctatatcgccctgaaggcggagagtatcgcgttgaatttcaatatgctgcgcaggctggaagagaactggcagcggggtgaaaaccgctttaacgcgccgggtgaaaagctgttgggggcgtttcttaacggcaggctggtgggcgtgtgcggcctcaaccgcgatccgttcagccagcagccgcgcgccggacgtattcgtcatctctacgtcagcgaaaagtgccgtgggcagggcattggcaaacaacttttgaccgtggtgatggcggatgccagcatctggtttgattttcttaatacccatgcgccggaaaccgcgtacggattttaccatcgggcgggcttcaggctggtgtcagacgaaccccgggtgacgcaccgccttttttgcgcagtgtaa

SEQ ID NO: 5540 - DNA, 288 bp, Enterobacter cloacae
ctgcccagcaagatgcccagcacaagggccagcaggatctgccaggccaggctgactttcaaatttttcatagaaactgacttcctcaatgaaatctccgcaccatcaaaactgcatgaatatggagacatactgaaagggtatgaattgtgttgcgttggtttatgggattttttaacgcgccgtatgagtatcatttgcacggcatgctgcgcaagccttaaagaacaaggcatttcactgcaaaaagtgtcattgtcggtaatttatagcaattcgcataaataa

SEQ ID NO: 5541 - DNA, 225 bp, Enterobacter cloacae
cgccccgctgccatagctccctgccgcgacacccgttccgcccattgcgtcgctacgcgcttccgtccaggtattggctgctcccgcctgatttgccataaaaaaggagacagcgatgctaaccatcgaaaatttaaaatgttttttcacagtgtgctcgtaaatagtttgttattagttaaccctgtctgttatcacccaaacaggaacgaactattgctgtga

SEQ ID NO: 5542 - DNA, 258 bp, Enterobacter cloacae
ttggaatgcttaaacgcctggctctttgtgcaaccgacgacatgcagtgccatcctcacggaacagatggcaacgctctggcggcaaaccgatagcgaatgtggcaccctcttctaccaacaccacgtcattctggcggtagaccaggttctgacggatggcggggatctggatatgaatctgtgtttcgtgaccaagctgttcgacgacctgaacttcaccttccagcgtcacatccgcaatgtggcttggcagtag

SEQ ID NO: 5543 - DNA, 210 bp, Enterobacter cloacae
cttgaggaattatactcccccgcagagaaaatgacgaatcaaccaggacagatgtctccacagaggggtaaccttatgtcgcatcagcaaattattcagacacttattgaatggattgatgaacatatcgaccagccgttgaacattgatgtggtcgctaaaaagtcgggctattcgaaaggtatttacagagaatgttccgcaccgtaa

SEQ ID NO: 5544 - DNA, 240 bp, Enterobacter cloacae
agcggcgtgggtgcagaagcccgcgcaacaacggtactattaagcgagaacaataagcaggcggcgctgagcgccagtgtgatcttgcgcatattttcccctgaatattcagtttgttatctttttattttgagcggatggtcaaaaaactatccgaccataaccccagcgggaggggaaggaaaggagtttttacttattaagcggaataaaaagaagacgatcacaaagtgtggatga

SEQ ID NO: 5545 - DNA, 429 bp, Enterobacter cloacae
ggggtgaaaactctcactttatcatgttctgctaaaaacaccgagatccgccaggctgtgctatacctgacgcatcgcaaatcaggagatcgcaaaatgaaaagacctgactgtattcggcactggcgggacgtggaaggcgctgatgacgcaacgtatcctgacagcaacgaacgtttttctattggcgcgccgctggcccgcaaactgggtctcggccgcattggtattcaccatgaacggctgccgcccggacgccgcacatcttatccgcatgcggaaagcgacgaagaggagtttgtttacgttctggagggttaccctgaggcctggatcaatgggtattttatggaagctcgaacccggagacagcgtgggatttccagccgggacgggcgtgtgtcacacctttatcaacaataccgatga

SEQ ID NO: 5546 - DNA, 255 bp, Enterobacter cloacae
agggaaattgttatgaagaaagtactgtatggcatttttgccatatctgcgcttgcggcgacgtctgtctatgcagctccggtccaggtcggggaagcagcaggggcggcagcgacgtctgcgtctgcggggagttctaccgcagccagcaccagcgccgtaagttcagccgtgggtgtcgcgctggcggcaaccggtggcggtgatggctccaataccggaaccacgaccactacgacgaccagcacccagtaa

SEQ ID NO: 5547 - DNA, 486 bp, Enterobacter cloacae
aaagacctgactgtattcggcactggcgggacgtggaaggcgctgatgacgcaacgtatcctgacagcaacgaacgtttttctattggcgcgccgctggcccgcaaactgggtctcggccgcattggtattcaccatgaacggctgccgcccggacgccgcacatcttatccgcatgcggaaagcgacgaagaggagtttgtttacgttctggagggttaccctgaggcctggatcaatgggtattttatggaagctcgaacccggagacagcgtgggatttccagccgggacgggcgtgtgtcacacctttatcaacaataccgatgaagaggtgcgcttactggtggtgggtgaggccaataaaaaacataaccgtatctactatccgctcaatccggtgtatgccgcgacgcgcgaagaccgctgggtcgaccatccgcctcagttttttgggccgcacgatggaaaacctgggcgaaaataa

SEQ ID NO: 5548 - DNA, 1332 bp, Enterobacter cloacae
caaactatttacgagcacactgtgaaaaaacattttaaattttcgatggttagcatcgctgtctccttttttatggcaaatcaggcgggagcagccaatacctggacggaagcgcgtagcgacgcaatgggcggaacgggtgtcgcggcagggagctatggcagcggggcgttaatcaaccccgcgttgctggcaaaatctaagcccgaggatgatgtgacggttattttgccgtccgttggcgtgcaggtgaccgatgaagacaatcttcaggacgagattgataccattaacgacaaaatcaatcattacaaggatgtggttgatagtctgacccccattgaagttatcaccaatccattaggttcgatcaatcagttccagggcgcagcgaaagatctcgctgatgaactggactacctgaaaggcaagaccgcacacgccaccgcaggggcggggattgccgtcagtatccctaacgatgttctttccgtggcctttatggcaaaaggctatgcccatggccgggtcagctcttcaatcgatcagcaggacattgattatctgcgcggtatacaacgaagcgatgcggtggctgccggtgtggcgctggatgccgcgctaaacggtaccgatcagatcaccaaaaaccttaactctacggcgtctggtcgggcggcgattgtgtccgactacggtattgcggtggcccgtcagttcgatcttggcggcgttccggtttccgttggcgtcacgccgaagttgcaaaaaacctggctctataactacaccacctcaatctacgattacgacagtaataagtggaacgacagccgctaccgtaccgacgacactggcttcaacgtcgatgccggtattgcggctgatttcggtgaaaactggacggtcggtgtgagcggacaaaacctgatgtcgcgcgatatcgataccaaagatatccgcattcgcaacggacgcacgggagaggtagtgagttataaagacacctatcagatccgtccgctggtcactgtcggggccgcctggcataacgatctggtcacgcttaccgcagacggcgatctgaccgaaaccaagggctttaaaagcgaagacacctcccagtacgttggcgtcggtgccgaagtcacgccgctgagctggctggcagtacgcgccggttatcgtgcggatatgaaagggaacgacagcaacgtctttaccggcggtgtcggtttcgcgccgttcaacgccgtccacgttgacctgatggggctttatggcgaagacgagacctggggcgcaggggcacagttgagcatgacgttctaa

SEQ ID NO: 5549 - DNA, 192 bp, Enterobacter cloacae
cgtttacagcagtatgtctatggattatgcttgtgtggaacaataaatgtacccgcagaaataattcatcgcattgaattaattgccttttttggattttatattctttgttttacactcagcatgctctttgatttcgtggtcttattcttttattcagatatgagttattgcggttgctctctcgattaa

SEQ ID NO: 5550 - DNA, 399 bp, Enterobacter cloacae
ctattcagttcatcaaggatgaagaatgaaaaaaagtatgttgtcataccctacggtgaatattttcgcatgcgtttagccatgcttgagtacgatgacgatgatgaaaacgactgggaagacatcccttacgaatcagacatctacgataacgtaggtttaccgggtgaagtgtgcgacatcatgcataacgagaacgtcagcctacaggccgcctggcgcattttacgcggcatgtcccagcaggaggtggcggagaagcttggcatcagccagtccgccgtgtcacagctggaagcgctggactcccgaccgcaaaagcgcacccgcgaaaagctggcggcactttacggctgtaaacaggagcagatcagcctctatttaccgaaagagggttaa

SEQ ID NO: 5551 - DNA, 483 bp, Enterobacter cloacae
gaggacaacatcgtgacgctcgatcctgaaacagacttaaaactggagcgcgtggtggacgcaccgcgcgatctgctgtggctctgctggactacgccagagcacatcaaaaacttcttcattcctgctccccataaggtgaccgaatgcgacctcgacctgcgcgtgggcggacggttcaacaccgtgtttgaggtggacggccagcggatggataaccggggcgtattccttgaaatcgatccggggaaaaagctggtctttaccgacggctataccgaaggctggaagccggccgagaagccgtttatgacggcaattttgctcctggaagacgccggggagggcaaaacccgctatacggcgatagcgcgccaccccacgaaggaaatccgcgagcagcatgaacagatgggatttcacgaagggtgggggattgtgctggatcagctggtggggtatgtgaaagggcttaacgcttag

SEQ ID NO: 5552 - DNA, 231 bp, Enterobacter cloacae
attgagaagacacagagtgcaagcgctactgcgccagacgggataacgatatccttcctgaacatttgctttcctgattggttgggcgcgattaatttctgggggttattaaagcacaaaaagcgcccgcaggcgctttttggatatcaggaatttcgcttaggcagcgccgggaaccagcacttcggtggcgataataacgataatcaggccaaccagcaccggcactga

SEQ ID NO: 5553 - DNA, 480 bp, Enterobacter cloacae
atctctttaaaaccacttctctttcattcttttgcctgcttatactcggttcactttctcctgtccgacgatctcaatatgtacgccagctggacatatcgcctgcgctttatcaaaaaacatctgctgatgtttttgctggcgtttggctggctgttgatccagactcaggtggccgtcgcgtcccatcaatgttcaatggatttgcgcggcgaggtggccaccatccagcatatggagatgatggcgcaaccggggccgcattatgctgccggtgcttcaccgctgtgtgaaaaacattgtgtgccggatcaggtacaaaaagatcctgcccagccgcatctggtggcgctgcctgccgccatgaccctgaccttaactccgccagagtgctcgtctgcaagccattctgcgtggtccgttacccctcctgctgtggggccgccggcaacgatccgctattgccggtttcgggagtaa

SEQ ID NO: 5554 - DNA, 1242 bp, Enterobacter cloacae
atgagcatgcttcctacgccagaatacagccgcaatatgcggctgattggccatagcgaccagggcggtcgtccggatggcgtgcagctgatggtgcaccgcggctttgcgtatatcggccatatggtgtcgcagggcttttcgattgtcgacgtgcgcgatccaaaaaatccgaaacccgcgggctatgtccccgcgccgccgggcacctggaacgtgcacctccaggcgcatgacgacctgctgctggtgatcaacgcccgggatctgtttgccgatgcccgcttcgccgacgagaaggtctactacacccgtcaggtaggagagaccgtcagcgacgttcaggacaggggctggagcgccgggcttcgcgtttttgatatctccacgccggacaggccgcgcgaaatcggctttctgtcgctgagcggcatcggcattcaccgcatctggtacgtcggtggccgctgggcgtacgtgtcggcgctgatcgacggttttaccgactacattttcctgaccattgacctggcggacccgcgcaagcccgaggtggcggggcgctggtggctgccggggatgaaccagtccgcaggcgaacagccggactggccggaagggaaacgctacgccctccaccacgcgattattgccggggataccgcgtacggcagctggcgcgacggcggcctgacgctgctggacgtgaaggatcgcacccagcctaagctcattagccaccgtaactggagcccgccgtttggcggtgggacgcacaccgcgctgccgctgccggaccgcgatctgctggtggtgctggacgaagcggtgctcgataaccaggaagacggcgagaagctgatctggctgtttgatattcgcgagccgtcgaacccggtgagtatctctaccttcccgcatccggatgaaatcgactacgtggcgaaaggggcgcattttggcccgcacaacctgcacgagaaccggccggggagctttgtcagctccacgctgatctttgcgacgtatcagaacgcgggcgtgcgcgcatatgacatttccaatccgtatcgcccggtggaaacgggagcgctggtgcccgcggcgccggagaggatgatggatacgcggccgaatcgcccgcaggtgatccagtcgtgcgacgtgtttgtggatgcgcaggggattatttacagcacggattataacgatgggttgtcggtgattgagtatctggggtga

SEQ ID NO: 5555 - DNA, 879 bp, Enterobacter cloacae
acagtgagcagcgtgccagcttccgccagcagctgtccgaacaccataccgaacaccatgaattccaccgtcgttaagggagccgctatgaacatgaaaccgatcggtggaatgctgttgttgatggtatccaccttcgccttcgcccagcaatctttctccacacctgagcaggcggccaatgccctgacgaaggccatcagcgagcagaatgagagcgcgatggccgacctgctgggggataactggcgcgactatctgccacctgaaggggttgatccggaggcggtggctcgattcctgcgtgactggaagataaaccatcgtaccgaaatcagcggcgatattgcccatctgtcagttggcgataacggctggcaactccccataccggtagtgaagaaaaaagagggctggcaatttgatatgcagaaagcggctgatgagatcctgacccgcgaaatcggccgcaacgaactcgcggctatcgaagcgctgcacgcctacgtcgacgcacagcggagctactacgccatgaaccaccgctatgcgcagaagattgtcagcacgccagggctaaaagacggcctgtactggcccatctcgccgggcgaagcgccaagcccgctgggtcccgcctttagcccgccggagcctggtatgggctatcacggctatcggttccgcattctgtcggataaaaatggctttgcgatggttgcctggcccgtaagctatggtcagacgggggtaatgagctttgtcgttaaccaggaagacaaggtttatcaggcaaatctcggcaacgattcggcgcagaaagcgcaggcgctcgctgcataccacccggataaaacctggcagcctgtcaccccctga

SEQ ID NO: 5556 - DNA, 201 bp, Enterobacter cloacae
cgggacgacccacaacacatagggcgaacgggctgcggcaatttgacgctgagtttcctggtggataatggggtggagcagggcattaagccaggctttttccgctggatcggaaaatatgtactcacgcagctgccgacgattcagggtgccgtcagcctgtatcacacggcgaccaaaatgcgcttcgatggcgtttaa

SEQ ID NO: 5557 - DNA, 195 bp, Enterobacter cloacae
tgccgaaaaatttcctccggcaaatgcgcccgtcatatcccggctaacgggcaacctgtaggcctgctaagcgaagcgccagcaggcttcaaaggttactgctggttttcgctccagtcatcgctatccgagagatcgccttcgctcggaatgcgtttctcttccgccgcccattcgcccaggtctataagctga

SEQ ID NO: 5558 - DNA, 312 bp, Enterobacter cloacae
gcaggcgacggaaattcagaaggccgctcttgcgagcgaccagcagcgcgttgccggaggggggacgacagacttacggaactgcttccgggcccggtgacggggtgctacatcatgcttaacgattcagcaaattttttaatgttgcttttttgtaaacagattaacactgtgcagaaatcctgctatgctgcccgacgcggtatcgggcatttaccctacaaactgctgtctcacaggagcgtgaagagaacgcccgccgcatatgacaatgagagcgaggagaaccgtcgtgctagaagaataccgtaa

SEQ ID NO: 5559 - DNA, 189 bp, Enterobacter cloacae
caacctcaacttaatacggcgttttcaaataagatgactgtcatatatcaagttgcgtgccaactttttaaattattgaaaataatggatttatattttgatgctcccaaatgggtagtcattttgactatcttaaaaattgtcaatatgacactatgcattgtcaaaatgacagtgaggcagagatga

SEQ ID NO: 5560 - DNA, 282 bp, Enterobacter cloacae
cgtcagcccggcaatgtatccgttacttacccaggcaagcgcggaaggtgtggtattgaaagcgcgagccatcgccggaaaggcgacgctggcaataaacatgtttatcaaatcaaggaaaaagccgagcagaaagacgacggcgattttgctgcgatacgtcatggaagttcctccggtgaggtggcgtatcgtatcggcccgcacgttacggataaacgcgacaaagcacgatatactgtcaacattattttgacagttaaccaggcaagcgatgcttaa

SEQ ID NO: 5561 - DNA, 516 bp, Enterobacter cloacae
gcaggtcggcgaacagatcagaaaactgggactggactgatgaccaccgccgtacttcagatgcggcagggggtgctcctgaccacgtcatgcctgctcgccttcgtgctgttgtttctggtgatcgcccttggcgtcagcatcggtgagttgtctatcccgctcaataacgtgttctacgccatcagcaataagctggggctgactgacgttccgctcaaccgcatctacgagagcgtcatctgggactttcgcctcagccgcgcgctggtggcggcctgctgcggagccgggttggccatctgcggggccgtattgcagagccttttgaagaatgcactggcggaaccttacgtgctcggcgtgtcggcgggagcgtcaaccggggcggtgtcagtcgtcgtattgggtctcggcaccgggcgcagtgtcgctttctgcgggcgcgtttgccggagccttcgccgcctttgcctttgtcgccttcctgaccaacggcgcgcgcggcggcaatga

SEQ ID NO: 5562 - DNA, 363 bp, Enterobacter cloacae
acgctcgtgaatgatccagtccgcttccgccagttgttccagcgagtcaaccggatggtttgccagccagcctggcgttgccacgggcaggatggtgaaggaggtcatcaacgcggcgtggtagcgcgaatctgcaagcgtgccgagccggatagcgacatcgaagcgctcggcgataagatcggcatgcaaagaggacgagacatgccgcacgcgaaggtccgggtgcaactggctaaattcagccagcaaaggcaccaccacctgcgagccatattcgggcgtggtggtgatccgcagttctcccgtcagcccggcgtggttggcgcgaacgtcatcctgcaatcgctctgcatcccgtaa

SEQ ID NO: 5563 - DNA, 417 bp, Enterobacter cloacae
caacacgcagttacttgcgcaactgcaacaggagcaaccatgacccatttcgaacaagagatcctcgacattcacgtcgcccttgaaaactggttaggtgcaggcgaaggcaatcgggacgccctgctcgcccgtttccgtccggattttctgatggttccaccgagtggcaacccgttagatcatcacgcgcttgcccaatttttatatgcgcagcggggaacccgacccgggctcaggatcggtattgacgcgttaacaacgcttcagacatgggacaacggcgcggtgctccattaccgggagacgcaaacccggccaggccagcccgtcaacgtgcgctggtcaaccgcggtgcttaatcaggaaggggataacatcacctggcgtttgctgcacgaaacggcgcagccgtaa

SEQ ID NO: 5564 - DNA, 240 bp, Enterobacter cloacae
gtaaatgtttgcctggtcgagtatagggaatacgtgaaaggagggaagcgtaaaatgctggattttacgtgttgcgtcatgttttttaactattggttaacgaaagcgccgggtagcgctacgcttacccggcctgcattgcatttccccctctccctgtgggagagggttggggtgagggcatcagcccgcaccgaacgttgcactaaacctgctgcttcttatcgtgctggcggttaa

SEQ ID NO: 5565 - DNA, 252 bp, Enterobacter cloacae
gcccagagggcgttcagtagttgggtcaaaagttccattcagtgttcctggaaatcggttaacgtcacgcctgtaattcgggaaatacagcacggcgacattgttatgatttcattatggtcgctcgcggacacattgatgtgtggccaacactgttccctgttaattggctggttagcaagcactaacttacaaaataacgaagtgaatccaattgtaacaaagcccgacgttctgcgtcacagaatttga

SEQ ID NO: 5566 - DNA, 249 bp, Enterobacter cloacae
atctggtgcgccgcgagggccgctttaaatttattcgggaagatgtcgttactcattacttataccttttttaattccgcagttttagccagtagcttttcttatttattccgactcagcgtcagcgttatatttattttcctgactgaattttggcgttataaaatcgtcattcagtataatcgtcaccacccggcagcacattgtctcaatgctcaattatccaacgggagtaacacgctattttga

SEQ ID NO: 5567 - DNA, 231 bp, Enterobacter cloacae
aactcccgtttacttactatgcttaagtacgcggagcacccctcagatgttctccgcttagttctggaacacggcttacgccgtaacacaatggaaggtttctataatgaaataccgcatcaccctggctctggcccttttttctttaagcacagcttccttcgctatgtctctttgtcaggagaaagaacaggatatccaacgcgaaatcagttatgccgaaaagcataa

SEQ ID NO: 5568 - DNA, 483 bp, Enterobacter cloacae
ctaccgcgtacaggcgaaagcctttggtctggcgaaataaccggaggcgctatgagcgatcgcatttttgccgggatatggctgctgctctgcattggcggcatgttcgtcgcctggcagatccacagcgaatacagctatgaacccgtggggccacgcccctttcccgtcggcattgtcggcctgatgctgctctgctcggtagcgctgctgctgcgccatccggataccgtggagtggccgccacgccgaacgctgcaacgtctgctggtaatggtgattgtcctgctgatgtacgcgtggggctttgaatggctcggcttcccgattgccaccgccctgctgacgatggtgattggcatactatttaacgcctcgctgcctgcggcggggatctccggggtcgtactgggcattttactctggtacgccttcgaccgcctgctggacgtgaccctgccgcttggcgcatggtttaactaa

SEQ ID NO: 5569 - DNA, 207 bp, Enterobacter cloacae
aaacagtgtagcatcagagctgtgctatcgggaatggcggccagtctcatacatatcccgcaatgcctgttattgacacatagcggacgcatctttcacacgtttctatataacctggttagcaaaactatctccgctgcacttcttctcagcaagcaattcctgaatacgctacgcaacttaaacaaatatttcagaccaagatag

SEQ ID NO: 5570 - DNA, 444 bp, Enterobacter cloacae
ggtagtgcgatgaaatatccaatcgtcctggtgctttgtgcgctcactgtcccagccattgcagccagcactgactggccatcagcacttcatggaatcgcctcaggtgacacacactggattgagcaagccccaacgctggctgccacggctgacgccaggcaggcgcaactgctggaggatgctttggccgcagcgctcacaacaaacaccagcgccacactgaaagcgctccagaccattgacgcgggaaagtggccgcacatggttggcagcgatatcgtctgcacgccgcctctagagaaatcccccgccgaagtcgacgcgttctatcagcgcacccgccgggcgctgctggatacggttgagggtgctcagtgcctctggatcctggaagcaacaatggaagagctaaacgctgagaaagcccgtcagggtaagtaa

SEQ ID NO: 5571 - DNA, 195 bp, Enterobacter cloacae
cgtggcagacacaaagtatgtggcgtcgtgcgcaagcgatacggcgtgcttctacgggattggccggacggtgacggcgacggtgaattacagctggtaagcatggtgcggtctgatcccctcaccctaaccctctccccaaaggggagaggggacgattacgccctcgcccctttggggagagggccggggtga

SEQ ID NO: 5572 - DNA, 210 bp, Enterobacter cloacae
cacttcatgctggtggtagcaagcttaacgccgggccagcgcatgcgcccggcggataaacgtcacgacccgatgatcccgccgtccgctttggtaatcaccaccgttgacgatcgcggacgcccgttcgggctggcgtctggccagttggaaacagcgcgcggattggccgggtcggtaatatcatccccgccctcccccggatgctga

SEQ ID NO: 5573 - DNA, 195 bp, Enterobacter cloacae
atggcgactacccctggattttcatacgtacacgctgaagaaagcgctgttcatcaccttcttcacctgcaacttcccgattctgcggatctctttgaactggctggcacctgtgcggcgtacgtgagcgtactggtggaaatggacgatgcggtgacattttctacgctctgtaagcaactgctgggttgttag

SEQ ID NO: 5574 - DNA, 453 bp, Enterobacter cloacae
agctgctctatgaaaaaattacctggcgctacgtggacggtaacatcatgcattcagatagctggaatgaccgtaagacggcataaggagaacgttatgggatggaagtatgagcaatcaactggcaagatgtataaagacggcaaattaattgagacaggatattccggtgcccttaccaataaaaataatccggaccgtcagcatgtgaagggtctgggtccattgccgcgcggaacatataaaattgcgggacattcgaattctaaaggacccattaccattatccttgagcaaacttcgggagagagttttggtcgttcagagttccgcattcatggtgaccataagtacggtccagccggatttgcttcggaggggtgcattattctctcactgtcaacgcgacgtaaaatccttcgtgacggcggtgagcttgaggtagtgcgatga

SEQ ID NO: 5575 - DNA, 204 bp, Enterobacter cloacae
cctttaatgcaaattgccttacatgctaatattatcagggatgaaatacagtgttcagacttatcgttcatgcggcagtcagggaggagatcctctcattgcctgcggatgtttatcaagaagacgcaaaaaacgccctctgctgaactccgtctggcactgaaacgacaacaggagatgttggatgagcaaaaagattattga

SEQ ID NO: 5576 - DNA, 234 bp, Enterobacter cloacae
acatttttattgaacgtccttggttgctatcgccataaaatcaccggtaaatcgccgttgatgatattgcaaattattaccatttgcattagcgttgttaacaaatttcgttggggaacaagcggtaatgaagagggtatggagtgggttgctgttggggatcggcgcgctgcccgccgtggcggcaacgtgcgagcagacgtcccggcagggcgatattcagggaaagtttga

SEQ ID NO: 5577 - DNA, 258 bp, Enterobacter cloacae
aacggaatgcgccgggaactgttatttttcacccatcacctcaagatcgttatacaccgtatagcgggttacgcccagggcctgcgccgcgtgctggacgccaccccgcattttgaaaatgcctttagcgtgcatttcagcgactattttaagccgctgcgctttctgtacctttttgcccggaaccgaatgtttatcgatgatttcctggatagactgctcaatgatgccgcccaggttcatatcctgcgggtctga

SEQ ID NO: 5578 - DNA, 372 bp, Enterobacter cloacae
tatttaaggattaaaatgaaatttttgactttaattgtggctataacgctgctgacagcatgccagctggtacggccttttggcgaggctaccacttataaaccgtttaccgtttcagcccatcccggactggagggacggtatcactgtatgcgaagcgcgcttgatgctgaaggctacgaggtggaacacatcttcccggaacgcgatacgcctaacttttttgatatctccagagggagcaggctgattgcccaggtcgatatgtctcataccaccggggcaaactttctggatattacgcttatctccggttcgaaacagactaatgaagatcttgcccgtgtcatagcccattgtgtcagcagatga

SEQ ID NO: 5579 - DNA, 924 bp, Enterobacter cloacae
acgggtaccagttcttgcttatactggtactggcactaccatgcaggagatgttatggcgctgatgtctgaacctgtcacctctctccaggatgacacccgcaagcagctgggggcgtttttgcgtgcccggcgcgaaagcctcgatccgcagcgtctcggcttaccgcgcagcggccgccgccgcacgccgggcctgcgccgggaggaggtggcgatgctcgcggatgtcggcgtgacctggtacacctggctggaacagggccgggaagtcaacccgtccagcgcggtgatggccgccatcgcaaaagcgctgcaatgcaccccgaccgaagcccggcatctttttgtgctcgccggtttgccgccgggcgaagccccgcaggcggtgtgctgcgaggggatcagcgaaggcacgcgtcgcctgctggataccctgatgccgaaacctgccagtattcagaaaccgaatttcgatatcgtggcgtggaacgacagcttcggccacctgatgggtgtcgatttcaacgccatcccgccggaagatcgcaactgtatttacctgttcctcacccatccggcgtggcgcgcgcggctcggcaaacgtgacgacgtgctgccgattttcgtctcctacttccgcgcggccatggctgagcaccgtggcgacccgctctgggaagcgaagctggcgcgtttttttgcagtgtccgaagagttcaaaaccctgtggcaccagcgtaacgacgtgcgcggcgtggagaaccagctcaagctgttcacccatcccgagctgggggattttcatctccagcagatgtactggtactccgccccgcgaaacggatcgcggctgctggtctatttacccgtggatgaggcaggggagagggcgatggcgtggctggcggagcaggggatataa

SEQ ID NO: 5580 - DNA, 228 bp, Enterobacter cloacae
cggcgtaatcatcctatctataatgagtgcttactcactcataatgccaaagcggtcgtaccgggacataacgggcgttttgtgctggcgaaacatacctggaacgatccactgatccagctggcgaaagccagcaaggataaaaactaccggctgctgacgccggagctgggcgagcccgtgcgggtgagtgataccacgcaacaatttcgcgagtggtgggaataa

SEQ ID NO: 5581 - DNA, 192 bp, Enterobacter cloacae
aaacaggcgcttacgccagtttcaagccagcctgattttcttcatgaaacacccatcgcgaaagtagcgttaacgcacatttttcacagcacaattgactgttataacagtatttttcttacgctgtggcaattttattattcctctaccatgctcatatcacctcactctcactcgtggggctttttgtag

SEQ ID NO: 5582 - DNA, 186 bp, Enterobacter cloacae
agtgtcgctcgcgtgctaccgcgacaaaatagcgcagataacgaagttccatatcaaaaacgtctcaaaccagcatggattctatattggaactctctgctgaatcgggtcaacatttatttaacctttataaataaagttgaagaggacgggcatgatgatgcattcatctgcatgcgactgtga

SEQ ID NO: 5583 - DNA, 228 bp, Enterobacter cloacae
ttgacagccaacgcatttgcggtcacgttcaagaacatgcacattgtgattcatgctgtggagcccagtcgggcacaggtcggcgcagttaccacaatgcagacagcggtcggcatggaaaaaaacatcccgttcggcagtttgtccttccggatttgcgcaccaggcacaacgcatctggcagcctttaaaaaagatgatgctgcggatacccggcccgtcatgtaa

SEQ ID NO: 5584 - DNA, 219 bp, Enterobacter cloacae
acgccgatctctttaccgtcgacgttgccgctaaaagggaaatcttcctgtacttgctctgcgtcacatacgcctatccagctcatcacgatcctccaggcttttgtttcatatatgaaactctgtttcttatttaatacggtcaatataaaagcgatgaatgtttcgtcaagcgacaatgtgacgaatttgttaatcgatcagcaattaattaactaa

SEQ ID NO: 5585 - DNA, 258 bp, Enterobacter cloacae
gcggaaaacgatggttcattatctggtatcacctccacggccgcctctgctgaaacggaccacaagccaaagctaaaagttcactgcttaacccggctggaagtggcgacacgatgtgttcatcgagcgcttattttatatgagccgcgcgccgcgttttataccgagaaggtcgctaaaaagcaaaacaaaaatgcgcaggttgccagcgtcgtcaggaaaaatttccagcagcgttttcaacgcaatgagaggtga

SEQ ID NO: 5586 - DNA, 201 bp, Enterobacter cloacae
aagagttgtctgcttgtgagaatgttcgggaaacgggcattatccaaagttaaggcttctatgcaagcatgggaaagatccggtttacagcagattgacgctgtgctgcaatctgcgtccctgattaagcgaatcgatgaccatgcaagcctctcaattttcagcccaggtgctggactggtacgacaaatacgggcgtaa

SEQ ID NO: 5587 - DNA, 204 bp, Enterobacter cloacae
gctgttcatagcgtcaagaaggtccgcatatgcgggcctttttttatgctttttcaatatcctgcaatacctgattttgtgatctgtttggcaaagccggtgctttttgtttaccctttactgacctgcctgtctccatgggggatggattttgtgttttggtttaacaaaaggaagaataaatggaacaacttgatgttgtag

SEQ ID NO: 5588 - DNA, 321 bp, Enterobacter cloacae
ggagaccgtggcatgagcgacacgctgaactacaacccggcgctgccggaaagccgccagtttaccccaccggcagagggcggtaatggcgccattcataagccgggtgattacaccaacctgatctggcaaacccgcagccgcgagccggaaagctgggaagtgaagctgattgcgacgctggaagatctcttcgagcagggcgttgaaaccttgccggagctggtaagcgggctgaacgcggtgcgcatgcacgaccagcagggcgagccgtggagcgacgccagcttccgggcattcttacaggttaacggctactga

SEQ ID NO: 5589 - DNA, 942 bp, Enterobacter cloacae
atacaggaatgcgaaatgaccaacaccggttttattattggtgcgtacccctgcgcaccctcgtttcaccagaaaggggagcaggaagaatacaccttctggcgggaactttccgacacgccaaatattcgcgggctggaacaaccttgccttgaaaatctccatccgtttggtgatgaatggctgtttcgtcatacgccgggcaactggcagatcgttgtcacagccgttatggaaaccatgcgccgccgcggcagcaacggcgcgtttggcctggcgtccgcggacgaagaacagcgtaaagcgtgcattgaatattaccgccatctgcatcaaaagattgatgccgttaacacccgctttcccgggaaagtggtcgctctggaaatgcaggccgcaccgcaggcgggtaatgaatctgtcgagcaagcgacagaagcattctcccgctcggtacgggaaatcgcgagctgggactggggctgcgatctggtgctggaacactgtgatgcgatgaatggcccggcgccgcgtaaagggttcttgcccttagagcaggtgctggaggtagtgaaagagaccgatatcagcgtctgtatcaactgggcacgttcggctattgaaggtcgcaacaccgcccttccgctggaacatgttcaggcggcactcgctgccgggaaactgggggcgctgatgttttcgggcacgacccctcacggtgagtatggagaatggcaggatctgcacgcgccgttttcttcgttctgcgccgacagtctcatgtccattgaacatgtaaaagcgctgtttactgcggcgagcgccgcaacattgaaattctccggtattaaattactggaaataaatgctaatgctgacgtcagccatcgcatcgctattttgcgcgacggcattagcgctatgaataaagcatcacaataa

SEQ ID NO: 5590 - DNA, 333 bp, Enterobacter cloacae
cagccactgaccagggcggtaataaaaatgatgatgaagcgtggggtgtcactctttctgctgctcttattaacaggatgcagtgcttctgaggagatacctgtccaaaaagcgcagcaggggaaaatgagcccggagcgttccctgaatatggaacagctgtgcagggatcaggcggctcaccgctataattctgaagcacagaaaattcatataaacggcttcgagcgctttcagggcagctatgaactgaaaggctatacggcgcgtaaagagggctttgtctgttcttttgatgcagacggccagtttttacatctctcaatgcgttaa

SEQ ID NO: 5591 - DNA, 225 bp, Enterobacter cloacae
cgcaaacaacgcatcggcccgatgccagccataccaggccagaccaagcgcaataagaatagccccattcatcataacatcagactgataatgaagcatatcggcccgtacagcctggctttgtgttttgcgtacaacccagcgctggaaagttacaagaacaagtgtgcttataagtgcaactaccgttacgaccacgccaacgcccggatcgttcatcggtga

SEQ ID NO: 5592 - DNA, 477 bp, Enterobacter cloacae
gcgccagtgcggttcgcctctggcattatgaaaaccggggatattgcccgcccagtcgacattcagtttaagtctgtcggggcaatagatgacgttctgcaacaccagatcgttaaccgaggcgtaggagtgtttgtcttcagcgcggatgtagaacaggtctccgcgcgtgatgcggtagggacggtcgttgaggacgtgcaggccattgccccgccacaccagcaccagctcgcaaaactcgtgggtgtgctcggcgaagacgttttgcgggtagcggtcggccaccgcgacggcctgactcgcggaggcaaaaaaatcatctttgcgaagaatgagctgagcagccacaccacaacctctacggcgaataaccggacattattagcctttttgcagcaaaaaaacggtgactgccctcgcgttactgaagcaacgcgtctttcccctgacgaatatcgcgcggcgaccagctaa

SEQ ID NO: 5593 - DNA, 417 bp, Enterobacter cloacae
cggcgcagtgttgtcgctggccgccgtaccgtttgcgccggtgggtctgccggtactgctctctttgctcggccttgccgcgaggaaaaaataatggaaaacatgacggtctttattctcggcatcgccattctttctgccggaacctatctgatgcgtcttggcggagcgaagcttggcaaccggctggcgctttcagaacggtcgcaggcgctgctttcagacgcggctaccgttttgctgttctccgtcgcgttggcgacaacgttttatgaaggggaccattttgccgggatggcacgtgtgctgggcgtggggttcgcggtgtttctggcctggcgcaaaatgccgttaattgtggtgatcgtcgcggcggcggtggtgaccgcactgctgcgtctggcaggcataaactaa

SEQ ID NO: 5594 - DNA, 216 bp, Enterobacter cloacae
agaaatgattcaacccacaatcattacctgatgcaaaaacgcgccttatggcgcgaaaacgctcattttattgacacagaccacacatttcgatttcgatatttctcgtttgtgctcgttaacgataaattaacactatgtctacagggcatcgtgactgtcacgggcggtcacgcaaacaataaacattactcttttgcaggattccgattatga

SEQ ID NO: 5595 - DNA, 204 bp, Enterobacter cloacae
ccttataaaaactacggcattgataatcattttcaatatcatttaattaactataatgaaccaactgcttacgcggcattaacagctgtgccgcccgacaataatggagaggattatgagttatacactgccatccctgccgtatgcctacgacgcactggaaccgcatttcgacaagcagacgatggaaatccatcacactaa

SEQ ID NO: 5596 - DNA, 339 bp, Enterobacter cloacae
cgatcagtatcaccgtctgctgtcagcggcgggattatccaccagctggaccagaacgatgcagaagcggcggataagcggcaagatcgagagcagttcgcggagattatgggggaaatagttcccgcagaaagtaggccgggtaaggcgaagccgccacccggcacatacggttacgaacgcttatacagcggcagccacagcgttaacctgagcccgcccagcgggctgtcatcggctttcacccagccacggtgctgttgcatggcggtttccacaatcgccagccccagtcccgtaccgcccgattcccggtcgcgcgcctcgtcggtgcggtag

SEQ ID NO: 5597 - DNA, 201 bp, Enterobacter cloacae
ccgatgaacccgcataacgttcatctccgctgctctgcgagtgtagccgtgttaagagatgaagaaaatcccattcatcagggttttgcgaaacctgacagtgaaacaaaaaggaaagtcttttttgtgacagttagatacaattcaccgtctcactcccgccattcgattcagggaagggttgtatgctcgaaatgttaa

SEQ ID NO: 5598 - DNA, 207 bp, Enterobacter cloacae
cctgactcactttcttttcctgagtatacccttttgggcgatacggctattaaggcacagccgcaagtctgggtcaattcggcgaaatgtaaaataccgtcaatgcttacattaatttatgttattaaaaacaacgcttttatttatcgcattgataattacaggaaaaatattcaaaaaaaacgtaagaaaggtttattcagataa

SEQ ID NO: 5599 - DNA, 210 bp, Enterobacter cloacae
atccgtctcgtccttattatggcgagcatttccacgatatgtccaacagtgccagaaaagtatgacagttatttttttattggggaatttagagggttgggggaggggatgtcgggtggcgctgcgcttaccacgacctacgggaccgtaggcccgtgcaagcgaagcgccgccgggcaattcaaacagactactccttcggcagcataa

SEQ ID NO: 5600 - DNA, 219 bp, Enterobacter cloacae
ctagtaagaaaaatcggcgcaattctaacagtccaggcaaacgtttgcgagcctattctcggcgtggggatctttttttctgtgcggcctgtacagggcaacaaacttgactctgttcacgaaaatgaaaccggtttcggcgatctgcttgcaacggcaatcccctttgcacatcatcaaactgaaaccggtttctgtaactgtttttgcagaaaataa

SEQ ID NO: 5601 - DNA, 294 bp, Enterobacter cloacae
ggtaaggaccgtaatgcggggatgaaaatggcgctcgctcagcgcgtgctgctccccgttgtgcgccatcacacaggcaacttcgcaggcgcgacaaccgatacactgttgagcgttggccataataaaacgattcataacaacacctgtttttggttcaataaccttattctttctattgttatcgtatttacccacagcagcatggcgacgcaatgttcaaatgcccaggaaggcgaactatttccagtgaacctgtggcagatcaatttaattcaggaagctgatgagtga

SEQ ID NO: 5602 - DNA, 216 bp, Enterobacter cloacae
cgcctcaccggcagcagtggctttgattccacgccccgtacgttcgatcagccgcgtctgaagaaactgctccagctggcgtatttgcaggctgacggcgggctgggaaatacccattacatctgctgccgcagaaaagctgccgcgttgaacgaccagacgaaaagtggcgaggtgtcccagattgagcgtcgtcatgcaaagtttctcttatag

SEQ ID NO: 5603 - DNA, 480 bp, Enterobacter cloacae
ggagagacacagatgattcgtcgatatttcctgcttcctgtatttgcgctgacgtcctttgctggcgcactggccgcaccgttggatggcctgagcgccgctgatgttaatggcccggccgccgtagcgccgcaggaaaaaccccagccgccagcaaaactgatcgtcgacccaccgctggcgggaccgctgagtaaaggtgcggtctttattcagtaccgcgtcgaaaacctgcgcattgaacctgtatttggacccgacgcgctgaaagtcactccgcgtatcggccatattcacgttgtggtggatgacgcgccctggcactgggctgataccagcggcgagccggtgatcctggtcgggctgcccgccgggaaacacaaagtaaccatcatcgttgctgacccgacgcataagcccatcgaccataaaaccgttgagttcaccgtgccgccacacgccgcggttcatcacttttaa

SEQ ID NO: 5604 - DNA, 198 bp, Enterobacter cloacae
gtttattggcaatttaaacagggtggacaactatgcttaaaagatgaaagactattcagcttacagctgttcgttgaattatggagaattgtaaatcccgaaaaattccgaatgtgttatattccacttaaggatatatcttcgaaaatattgaacattaaatccacaaaagaacaaaaggattcactatggttgtga

SEQ ID NO: 5605 - DNA, 849 bp, Enterobacter cloacae
ccatcatcgttgctgacccgacgcataagcccatcgaccataaaaccgttgagttcaccgtgccgccacacgccgcggttcatcacttttaaggagcctgttatgaaagcattgtctgtattaacagcggcgctgctggcggtttccaccagcgcgctggcagagacgaaagccagcgtggtgctggtgcacggggcgtttgccgacggcagcagctggaataaggtgattacccggctgcaaaaacaccataacgaggtcattgcggtacaacttccgctcacgtctctgaaagatgatgtcgccgccacgcagcgtgctatcgcccgggctcatggcgacgttgtgctggtcgggcactcctggggcgggtcggtaatcagcgaagcgggcaataatgcgcgggtgaagtctctggtttacgttgccgcttttgcgccggattccggccagtcgaccgcagatctggcagacagttatcctgctccgccagggagcgccagcctcgctaaaacgtcagaggggtatttatatctgccgacaaaagcggtcagcgagaattttgcccctgacgtgaaggacgttgagcgcagcgtgattgccgcgacgcaaagccctattaaggccgatgcgtttggggagaaagtcgcgcatgccgcctggcatgacaaaccgagctggtatgtgatcagcaaaaatgaccggatgatcaatcctgagcttgagcgcgcaatggcgaagaaaatcaacgccaacaccacggaggtagcggcaagccatgtatcgatggtcagccagccggacgtcgttacccgtacgattgaacaggcgttatcgggtcaacagtga

SEQ ID NO: 5606 - DNA, 1233 bp, Enterobacter cloacae
agccattgccctcgcccgcggcaacgccatccctaccaccggtgcatccggttattaaaaggagaaatgatgaaaactatccatcttacccagggccaggcacgaacacggttaatcgcccccgacgatatggtctcctgcaatcttgcttttattgattgcaagctgcccggctcgcatctcaaacaaaactattccttcatcggcccgggtgtaacccagtccagcgagcaggtcgtcaatattcccgagccgcacggctttaacattggcgcggcggctatgccaaaaggggtgacgaataacctgcatctgcatttcaccgcagaagtgttcctgatccatgaagggacgtggcgttttcgctggggcgccaacggcgagcatgaagctgaatttagcgcgcccaccatcctctcaataccgacctggatcttccgcggtttcaccaacgtcagtaaagaagatacctgcggcatggtatttaccgtgctcggcggggacaacacgggcggcatcatctggcacccgtcagtgctggcgactgccagcgaatacggtatgtatctcagcaaggataatatgctgattgcgcaggagccaggtgaaccaacgcccgatcccgccgcgctgctgacgccgctgtcagagcaatatattgccagtctgcgtgactacagcgttgaggagatgcgccagcgtgcggtaaccggcgatgaccgccgctggtcagcacagggactgctggattcggtgctgccgggacacggcggcgaaattgcgccggttatcggtttcggcatttcacaggatcgggattccgctcccgctatcctgagcccgcacggtttttccgtcgaatggctgcgtcttgctgacgaccacattgtcggtcgccatctctgcccggatattcaggtgatcatggtctttaaaggccagctggaggtgacctggaacgaggcgggcgaagaagtcagcattatcgccccggaacgttcggtgatctccattccggcaaacagctggcgccgctaccgcgcggttgatggcaatgtggagtttattctgacgacccggggcgatcagcgtaagcgcctctactgggacgaggcgatcctgcacgaggcgagagaacacaatcgctgtatcgatcctgatggctacgtggcggatgccgacatcctgccagccacggcctgtcgggccggtgcgatactggagaaatggtag

SEQ ID NO: 5607 - DNA, 603 bp, Enterobacter cloacae
agaagaggtgagcgaatgagaaaacgcgacgcacttttgtcagcccgcagctacctcaccattctgctcggctttctgctgggattcgctattgtcgtctgggttgaaaaacagatgccgacacgcgttgagagcagcgcagggatatcgctgagtaacgatttcccacccttgcccgctccgcgtgaactgacattcgaagaagccatctgggcgcgggtggcctggcaatattatgtgaacaacacgcagccgaatggcctggccaacgcgcacgacggtgaaccctggctcagcctgtggagcaccggcagctatctttttgcggttgcagccgccaggcagctcaacgttcttacttccgaggagtttgatgaacgcatcgcggccgcactggcggccctcgcaagccttccactcaatcctcaggggctgccgccgcctattaccatgccgacacacttgagaccctgggcataccggacgcctcggctatcggcatgggccgcctgcttaacgccctgcaaacgctgctgtggcgctatcctcagcacgctggcgccgtacgcaatctgctcgatcgctggaagatgggcgccctga

SEQ ID NO: 5608 - DNA, 1434 bp, Enterobacter cloacae
tacggacgagcctgtgaaactgccgccggtgaccgcacaatgcttaagaccttagcccgctggctggctgccgccgtcctcattcttattatcgccttcgccctgttcagctgcgaaagcgcagggtggcgctggctgaccaaaggcggctggcacaccaccgctcgcatcagtagcctgaccccacaggagcgggagtgggcgggtatcgcctggcgctattttgagaataacacccaacctcagacagggctggtcaacggtagcgataaacagccacgcgttacgctgtggcaaatgggcgatacgcttatcgccctgctggcagcccgcgagctgggtctgatccaggcggccgagtttgatgcacggctgacgcgcctgctcggaacactcaatcgcctgacgctgaccgaaacccgcacgccaggcagactctattccagccgtacggccacgcccatcgatttcacaggaaaaccggcgcagcgcggatggtcggcgaaagatatggcgcggctgatgctggccctgcgtctcactgccgagcgagcacctgagtaccgggaatatctggaaaaaatcatcctgcgctggaatttttgtccggtgatggataaagacggggagctgtggtctgcgtccgagcagaacgaacagctgttggtacgcgacgaactgcggctgggtgaaagcgaatatgccgccagcgcgtttcggctgtggggattcccggcgggcaaggcattttccccgccttcccagaacgtcatcatgtaccagcgcagcctcgccgttgacgcgcgcgatccaagaacaacctggcagccatcgctgctctccaccctccccgcgatgctgccggggctggagtttggctggcaaccgcccggtgtggcgtccgatattcacaaaacgctgcgcgcacgggccgaagccgtatggcttagccagaaaacgcgctgggagcgtgagcgcgcgctaaccgcacgcgccgatttttacctctcacaggccccctggcacgtcgaggacaccgtctgggggaatggttacgcctggaatacgttgggcgatgacggtaaaagctatccccggctggcacaggtgaccaccaaagcggtcttcatgctctggacgctgtgggaaaacgaatataccgatgcccttatggctataacccgacacctgaataacccgcaacagggctggtttgagggccgcgttgaggccaccggcgatatcaacccgacgctaaccctctcgacgaacgccatggtgctggaagcgctgctgtacaaacacaacgccggaccgctgtttgaaaacggccttgtgaagaatgatggctattttgcccgccgcacgtcggatcctttcaatccgcccggcctctgtctgcccggcgaacgtgccttgagggccgcaccatga

SEQ ID NO: 5609 - DNA, 189 bp, Enterobacter cloacae
ggaggtgctatgttttctgtcggtgattatgtccaaccgcgtcagggcggtccgaaactgaaagtgctcgaagtgaatggtgaaaacattgtggccgtgcaggccagcgatgagcagagcgagaaatatcacctgaaagcggcggacgtagttctgtactccgaagaaggtgactttggcgtctgctaa

SEQ ID NO: 5610 - DNA, 1665 bp, Enterobacter cloacae
tgccgataccaatgcggtcgtcctcgaaagcctggcgtacattgcccacggtcagatgctttgtctggcctgccctggccccgccactccccaaacctcttcagcaggagcgaagccatgaagctgaaatcaatactcttttttcctcttctggccgggcttgtggcgtgctggctctcactctctgcggcacaggcagcggctggacttcccgcttctgattacccaccgcgtagcggcgaactcacgcctcgcgagatgactattgccaaaaacgcctggcaatatttcgttgctaactatcagcccacaaccggcctggtaaatgccgttaataaatacccctcaaccactatgtgggacagcgcctcttatatggccgcgatgacggccgcaagggagctggggattattgataaagctgagttcgatcgcagaatgctgaaattactcgctaccctgaacaaactggatttattccgcaacgaactgcccaataaagcctataacaccatcacaggtcagaaggttaactaccagaacaaacctggcgagattggcttctcggcgctggacatcggcaggatgttgatctggctgaaggtcattaaggagcgctatccggaatacagcaacagcattgataacgtgctgctgggatggaacttcaccaacgtcatcaacccctgtggaatgatgtacggagcctacctggaaaatggccagccaaagtacgtgcaggaggggcggctgggctacgaagagtatggtgcagcgggctttgcgctgtggggctttggcacctgtcaggccagccagcctcagccctacgagctggctgagatctactgcgtaatggtgccttatgactcgcgcgatccgcgccttaccagccagcataattacgtcgtaaccgaatcctatgtgctttacggcctcgaatttggtttcgacaaaccgacggacagggaaaacagcccgcgtgactacacccatccgtggatgaaaaacttcgccgacagggtttaccaggctcaggagaatcgctacgccatcaccggtattttatctgctcgctctgagcatcaactcgatcagtcaccctacttcgtctacgacaccgtctttagcgacggcttcaactggaacaccatcaccgataaaggcgtgtacgttcccaatacggccgccgtctctctgaaagcggcgctcggaatgtgggttctctggaattcgccttataccgaccgcctgctggacgccattgaaaacgccaacgaggcgggcaaaggctactatgaagggctgtacgaaaacggcgacggccccatcaaagaattcacggccaataacaacggcatcatgcttgaagcattgctgttcaaaaaagagggcaagctgatgcagttcaacagcgataatcccaaagatccccactttgccccttccctgtgggaaaaaaagctggtggatctctttgagcctaataatgcctcgcgcaaccgtccattcctgaacagtacgcccgcagtgaagacatggtgtgaacaaaccgggaccactctgcgcaccaaacccgcttgccaggcctgtcaatgtgctacctgtaatacggacgagcctgtgaaactgccgccggtgaccgcacaatgcttaagaccttag

SEQ ID NO: 5611 - DNA, 225 bp, Enterobacter cloacae
gcgacctgttgggatgtgactgctgcaaaagtcttacgtttcattacccctgattccttatcaacgtcctgcccatttgcgcgtgcttcaaacgcctcagcaagtgggtgttttttatacttacaccacctttgcatgcgtatgcaacacaaaaaattaaaattctcacaacaagatcgagatcactttacaaacatgaaaccttttcgtaacttcaaatattga

SEQ ID NO: 5612 - DNA, 969 bp, Enterobacter cloacae
acgcatcgcggccgcactggcggccctcgcaagccttccactcaatcctcaggggctgccgccgcctattaccatgccgacacacttgagaccctgggcataccggacgcctcggctatcggcatgggccgcctgcttaacgccctgcaaacgctgctgtggcgctatcctcagcacgctggcgccgtacgcaatctgctcgatcgctggaagatgggcgccctgattgccaataacaccaccagccaggccgcggtcccgctccaccattgggcgctggcgacggacgagccgagaaacagcttcggctatcgtctttatgcaagccatacgcttcggctgatcgacagcgcggcgggactggcagtgacgaatccaccagaagggcagcagatgatcgacatcgacggaataatggtgcccgacgaggggctgcgtacgccgtggggtcgccaaccttcgcttatcagccttccctatttattaacggggcttgagctgggttttgatgcgcagagcgcagaaatcacatggcgcataatgcagatccaacagcgtcgacatagccttcgggtccgcaagccgccgatcagcaccgattacgccgagcccgcgccggattacgtcaacgatctgcccaatcgccagccgctgcaaaatagcgctctgcttgacgccacgccggagcaaacggcgatgacttcgacccgcaccgcctttgcctggtacgccctgttccgcaacggctggagcgaagcactgcgccagcaggtgcaaaagctacaggtaccgggcaagggctggcagcgcgggcttaacctcaacagcagcgtgaacgagatcgttgatgccgataccaatgcggtcgtcctcgaaagcctggcgtacattgcccacggtcagatgctttgtctggcctgccctggccccgccactccccaaacctcttcagcaggagcgaagccatga

SEQ ID NO: 5613 - DNA, 519 bp, Enterobacter cloacae
tggctattttgcccgccgcacgtcggatcctttcaatccgcccggcctctgtctgcccggcgaacgtgccttgagggccgcaccatgaaattttatcgcgatctctttgacgccagcctgaaccgcgtcctgccggaaaatgataaacggcacttttttgaaacgttctgggaaacgtttgtccatatgtcaccggagacagaacagcactttgcccgggaccagggcggagatggccagcagacgatcttcaagagctttttcgccatgcttgccgttgacggtgcgctgtttgtacccgattttctggaacgcctggcgcgggagcagagtgatgaaggactaggcctgccaccgcgatttttcggcctctggcgggaggcaatgctcaggaccgtgcgcgcctgcgatccactttgcgatgaagagatcctcacagcctgggcgatggcaattgcccccgggctggagtatctgcgccgccaggcggagctgcactataaggccagaggtgagtaa

SEQ ID NO: 5614 - DNA, 249 bp, Enterobacter cloacae
aacaaagccatcgtttctgaagagacgaacgcgctcccggcgaaaatactgtttaataaacaggatttaccgttactttctttagcgcgaccgatgcccgccaggattaaaagtggcaacctcagggcaaagctaattatttacacaggaaatagttgtttatttatatgtttgcgatttataagccttattatttgtgcaggtattgatttatttcgttatgaaaatgatatagctataaatgtctga

SEQ ID NO: 5615 - DNA, 201 bp, Enterobacter cloacae
tgctcatcaaagggacgcagcagattgaggaaaatctgcattcagggttggaaccattcaacgctgtgtgggttgcgtggcggggagctgtcgccactggcggatgtgctcgatcagggctctgagcttgggggccatattgtggcgctggggaaaatagagataaaaaccaggaaaagatggaagaaacgcatccagtaa

SEQ ID NO: 5616 - DNA, 951 bp, Enterobacter cloacae
tggcgaaatataacgtcgccgcgcgctggatacctaactaaggaagggctgatgcgggataaatttttgctgacctgcgcactgctgtgcgttgccactggcgcagagtcggcgccgaaggacgatgcggattcactacgtgacaagaacggcgagccggtgcaggctggcgtgttcaccagccgctggggtcgcctgttctccggtaatgaagacgtcttctctggcgcgctgagctttagttcgggactaaaagagcagtggatgactatccctaacagctcggacaccgcagagcagaaacgtaaatacaaccagacgcttaatctcagcctgcaatactcaccctacagttactggtttgcgaacgtgacatcgcgtttgccggtgacggacaccagccgctacacggccgattttcgttacagttttggctatgatgactggcatgccaacactttcagcctggtgtacagcaattacggggataaccgcttctggacgtcaggaaaccgtcgccacacctattttgagcagggggccgtgacgctggcgtataaattttcactgccgaaaccgatagagaatacgctcctgattaacaaaggcgactctatcatttgccagatgggctacagctgggttccgcgttattacgatctggacagcaacgatatccgcaaaaacaagaacgtggtattgggcgggtgtggttatacctttaagcagcacttcttcgtgcgcgccacggcgttctggtttccggacagcagccagcaacagccctggaacggcgactacagctatagttttggctatgcgggttatacgccaggttcattctctgttcagtatgctaactactccggcacccgttaccccggtcaccagagcggcagcggtaaattccgggaaggcaccgtcagcgtcatctggttcttaccgctttag

SEQ ID NO: 5617 - DNA, 981 bp, Enterobacter cloacae
ggagcgcacatgaccagattgcggggcttcagccctcaattcgactctatccagcagttcattttgacgctgacgcacgtggtgtgggagcagaaagatatcggccagctggcggatttttacgccacgccggtggttttcactacccccgaaaaacagctgcatgagctttcccagtttatgcgcctgacgcttgaggcgatgcacagcttcccgcagcgagcggtgctgacggaggatattctgtgcagccagaacccgggggatgagtactatgcggcgcagcgtaccgtagcccgcattcagcaccagggggagggattttttggcccgccgacggggaaaaatgtctgggtccgcacctgggccgatcgcatctgtgttgatggtgccgtacgccaggagtggctgcttcaggatcgtgccgcgattgtggcgcaactggggctggatgtccgcgattttgcttttaacctggcgaccatgcgccagcagcttgggctggaatctgtgtctgctgagacgctggacgcccgctgggcgggcgggcccgagggcgacgacgtggaaggggcgctggccggggtcgttgagcgctacttaacgatgtgggcgggcggtaacagcggcgtggtgcccggtctctatcacccggcggcgacgctgtacgcgccggggcactgcctctgcaccggcgaacaggaaattggcgcacagctttccggttatcgcgcttcatttgccgacagcgaaacgcaacttcatcacctgattgtgcgtaaagatcctaatgagccgattcgactttcattgcgctggtcgttgttaacctggcatgacggttacggcaaatttggtgcgccgacccgtaaacccatatcaattaccggtatcagtcagcttgaattacgtgatggtttaattttccgtgaatacctggggatcgatgaattagcgatttggtcgcaaatatttaattaa

SEQ ID NO: 5618 - DNA, 183 bp, Enterobacter cloacae
gtcactgtagatccgggtcagcacgccttcggggccaaattgctgttttatccagcgcgtgacctgaccggtcgccgcatgctgcgtggcgagcagcatgcgcgaatcctggcgcggattattgattcgccgcgttaccagcagcccatcctccaccgcctcacgcgtcatgtattccggtaa

SEQ ID NO: 5619 - DNA, 1257 bp, Enterobacter cloacae
aatacaagaaactttttagcatggagaacgcgacgccccatgagccagattgcgcctgtgcttataaataaagacgttgaaaaaccaacgacatggcgttacatcgcgtcggataaacgtgatttacgtattgattttatgcgcggtatcgccttagtgatgatggtggtggcgcacacggaagtgatgtcgatatttaatatatttacctgggaaaggtttggtctggtcaccggcgctgagggttttgtgatcctttcaggatttatgctgggaatgttaaaccgtgtaagattgcaaaaagcagtattgttgactatatcctggggactttatctgcgtgcatggaaaatatatcggataaatatcatcattattctttcatttttactgttaggatatctgccgtttattaacgtctttgaggtgacccattttaccgatcgttactcaggtacaacctggtcactgtatccggtgacgccgcaaattaaagaaacctggtttaacattgtcctctacctgcaaattggccctcatcaaacgcaaatccttgggctctatatttttcttctgctgttaagccccctgtttttggggatgctccagaaaggatacgtctactggctgctgggtttatcgttgctcgtctacggcggctggcagatgtggccggtacgcgctacgccgtctcagtttgaattcgcgtttccgctgctggcctggcagtttattttcgtgctgggtatgtgcagcggttggtacaaagaggatttgatctcttttgcccgtacgcccgccggtaaggtcgtgctcgtggcgctggtgataattgcgctgcttcttggctttatcgcccagaaccataccaacccgtttatgccgcccgcactgctaatgcacagcctctcgccggaggacttcaacgctttttatcatacctgggcggcaaaaaatggccttgggcccgtcagggtacttaacgatatctgtctgatggtgaccgtctatttggtgctgacctggtgctggctgcccctgtatcgcctcgcaggctggtttcttattccgctgggtcaacattcgctttatacctttattttgcatgtctacgtcgtatttctgataagccagttcgtcacgttcgatctgtggcgccaggactggatagtgaacaccttcattcacgctgcggcgctgggcgtgctgtggctgatggcgaaatataacgtcgccgcgcgctggatacctaactaa

SEQ ID NO: 5620 - DNA, 381 bp, Enterobacter cloacae
agggggattcctggtatgttgcattctcaatcctcgcgggtcggcagcatgttgctgctgctgaccgcgataatagccttcgcggtggcgctatacgcctggtggacgccgcttaccggcgtcactggcaccattggcgcactgggcgtggtcattgccagcgtagtgctggcgatcctgaccgttatgctacgcgcggcatcgcgtcgcggggcgcgcgttttcctgattattgtcactctggtggtgttggcgggtattggttttgccgccgcgctgctgcaccagtacatcataacggcagccatggtggtcggcctgataggtctgattatgctgagcagccattccgcccgttacaaccatcgcgtcagaagctga

SEQ ID NO: 5621 - DNA, 189 bp, Enterobacter cloacae
atttataagggaaggtatacgaagttgggctttttggctggagcagtgctggcaacctggttgtctttaacctacccgacgcaaatgagagctgtttttgaacaactggttacgatagtgcagcaaatcacgcagccttcatcagagtctcattctgatatggtcacaccggaacagtcatatccttga

SEQ ID NO: 5622 - DNA, 564 bp, Enterobacter cloacae
actgcgtcagcagttaactggaggagcacaatgaaacgtttcctgtttatggcgcttgccctgacgatgctggtggccggatgtagcaccgaggtgacagagtatcgtcagcagcagccacggcttgatatttttacttacttccaggggaaaaccgaggcgtgggggatggtgcaggatcgcagcggtaagcagatccgccgttttcacgtcgagatcgccggggatgttatcggcgatacgctgaccctgaacgagcattttgtctacgatgacggcgaaaagcagcagcgcgtctggcatatccgccgcgtagggcagaatcgttacgaaggtacggcgggtgacatagaaggtgtcgcgacaggccaggcggcgggcaatgcccttaactggcgctacagcatgaacgtgaaggcggacggcaaaacctggctgctgcactttgatgactggatgtatttgcaggacagcacccgtctgttcaataaaactgagatgaagaaatttggcgtcaccgtcgccacggtgacgctgttctttacccgcaaagagggcggttaa

SEQ ID NO: 5623 - DNA, 183 bp, Enterobacter cloacae
ctcaccccatcattgttaataattattttcacccgtgactacaaccgggctaatgatggggggagtgttacttatttagaggtattaaatattaatcctcgtcaaatcaggggaattgagtgggaaaatcattgcggctcagcgggcgcattctcctgcgtacctgcgccgctcaccgggtag

SEQ ID NO: 5624 - DNA, 186 bp, Enterobacter cloacae
ctcttggatacgataatgcatcatccttcgcaacgatgttccgccgtgtcacaggacagccaccttcgtattatcacccggcattattcaaaaagttccacgggacagggcaccgatcatagcgtcagctatgtaccagctaaagaggctgccacgtcaaattctttaattcatgagaagggttaa

SEQ ID NO: 5625 - DNA, 294 bp, Enterobacter cloacae
acatcccagccgaatgaacgcttaattttgaaccgggttgagaggtcgcggctggtgtaccagtacccgcataccatcaataccatgaatattgccgttcccatttcaggccctcttcagcgcgttgacatggcgcagaaagtcctgccgcacctcgtggcttttgtagttaaccgaggcgtttccatcctgatcgatgatgatgcggtcgccatcctctacggcttcgataatttcctggtgactcatgacctgcaacaaggattccgggctggaaaagagcgtcatcagtaa

SEQ ID NO: 5626 - DNA, 543 bp, Enterobacter cloacae
ccacaattgcaggtgtctggccccataatagcggcgatgaaatccgcgcaacgcggcgtgcagcgatcccgtgtcttgccccagagaatcatggctacccacctgaaaacggcgaaaaacctccggttgttccatcgcgtggcgcgccgcggcttcgcgccgggcgggatcatgctgctggataagccggttttccgcatcaatgaccgccacttcgcgctggatgtcctgccgggaaagcagcggcgcctgcaacatatcccgcagtcgcgcgacgccgtcggacaggttatcggcggcaacgtcgaagaaaaaagcgctgtggcgagccagcgtggtggcattgacgttgccgccctggcgctggacccaggccatgagtcgatcatcgccctgatagcgctggctaccgcggaacagcaggtgctcaagcaaatgcgcgagaccggcgaatcgcggtggctcgtgatggcttccggcactcacgcgcgccagcgccgccgcgcgtgtcgcctgcggctgatgcaccagcgttgcgcgtaa

SEQ ID NO: 5627 - DNA, 186 bp, Enterobacter cloacae
atactgtatttatatacagtattgtatattgatagcaaagatcaagggggaacgaggagtgacgtcgtacgggtgcaggaggaagagggttatattcagaatggcggcgaggcaaatctggcggaaagggtatttaatgaaatgtttaaggaatataagtgcccatacggcaggtatgggcagtga

SEQ ID NO: 5628 - DNA, 438 bp, Enterobacter cloacae
cccatgagcacgttgccgtccgtcatcagtcggttcgttgattactacgccacgctggatacccagccgccttcggcgctggcggggatttatcgcgccgatgccacgcttatcgatccctttggcgaacatagcggggtgttcgcgatccagcgctatttcacccacttgctggctaacgtccagcactgtcgctttaccgttgatgcgccgttgcagcagggcgatcgctttgtggtcacctggatgatgcactggtcgcacccgcgtattgcccggggtgcagtgcgacagctgccgggctgctccgtggtagacatgcgcgacgatcgcattgttcgccagcgggattactacgatgccggagagatgatttacgaacatctcccgatactcggctgggccgtacgcggcgtgaagcggagagtgaaatcatga

SEQ ID NO: 5629 - DNA, 528 bp, Enterobacter cloacae
tgcccgcaccatcagcgtggtgcagctgactgcggaacgcgtatgaagcgttacgggcaggtatttctgttggccatcggttttgatctctactggacgctggtggtgctgtttcgcgagcaggggctggtcatctggatcgcgctggcggtgcttgcctggctgttattaccgccatcacaccgggtatacgcccttgtgctggcggcgtcgggtgcgctgctggacgccctctgggcgctgacggggctgattgcgttcacaggcgcgtccctgatgccgctatggatggtggcgctgtggctaatgtttgccaccgtctggacgcacctgacccgcacgaccaccttgccaggatggttgctgacggtgctggcgactctgggcggaccggtagcctacctgatcggcgagcatcttggggccattacgtttcaggagccgacctttatcgtcgtcagctggatgttccccggctggctggtgctgatgctgtttttccacctgttgatggggagacaacaatga

SEQ ID NO: 5630 - DNA, 468 bp, Enterobacter cloacae
tcttcaccgcctggaaaaaggagaaaaagcgttatgcacattattttaattttactggtgattgccggtggcatggggctgtccgtggaagccgggctgctggggccgctgggcgcagaggtgggcgacctgtgggcggcgttcagcatatttagcgtgggaacggggctaacgtttctgctgatgctgtttttcagcccccgcaacagtccctcattttttgcgcagccttcatggcacctgttgggcggcgtgctcggcccggtttacgtcatcattctcaccattgccacgcctgcgatcggcattgccatgacgatgatcggcattctggcaggccaggtttttaaaagcctgattatcgaccactatggcctgctgggtacgccgcaccgcaggatcgatacaaaacgcattattgcgctgggatttatcatcgccgcgctcattctcgtggcgcaggggtaa

SEQ ID NO: 5631 - DNA, 279 bp, Enterobacter cloacae
aatgcgccagtagacgcccggagcaagtacctgcacctcagcatgaagcgcggcggaggcgtcgccgaactggaacgtctgcgcgccttcacgcagcgtcagcgagccaccgcgcagaccgttcagcaggcggaagagcaaccatcgcgcgacgcggacgttgcgcgggatatcgggttcaagcgcaaagacgggatcggtcatgagcgttcactcctgctgaggggatggttatgcagcggcacgcgcttcagccacagcctgagcgcctgccagtaa

SEQ ID NO: 5632 - DNA, 765 bp, Enterobacter cloacae
agagggcctgaaatgggaacggcaatattcatggtattgatggtatgcgggtactggtacaccagccgcgacctctcaacccggttcaaaattaagcgttcattcggctgggatgtctatttccttgtggcgctgtatggctgcattttcgttttacagggcgtgatcgccaccggcctgctctggctgttgttgttcgccctctccgccgccgataacacgttccatttcacgtctgcaaaatatgccgactggcaaattgattttatgaactggagcttcctggggattcaggccccggtggtggtaatgctgaccttcgcgatcctgttctgtctctaccgctcgaactgggccgggagcgcgcggctggacggcgaaggccgaaaaaagctctacaagcggctggcgcaatcgagcggaattgaacagctgctctatcagtgcatggaggaaggtgaactggcgcacgtcacgctgaaatcgcggcggatctatattgggatgatccataccgccacgctggagtatgaaaaaacggccaatatcgtgcttattccgatgctgagcggctaccgtgacgggaaaaacatgcagctctgtatcgaacataactacagcaaatggtatgccgagcatgatattacgctcgattcagagcccaaaagcgccatggattttcgcaaagtgatcatgctggatcagatcgagagtatttcgctgttcgatccggcaagcgcgagcgcgctggcaatgcgtgaataa

SEQ ID NO: 5633 - DNA, 660 bp, Enterobacter cloacae
gcatttatctgtccggttgcgcctgaagcaaccgaaacttacctgtaccatgaccatcaggagaacaatatgcacacgagtaaaaccctgaaaaggctgctagccgtatcagcagttgcagcaatgttcagcaccgttggcgtacaagcccagacgacaagcgccgcacaaactcaaactgcgggcaaggctcaaccggacgccagactcagctccggcgacgagaaagcgttgaaggacatggcgcaggccaatatcaacgaagtcgccgccgccaggctcgccctggacaaggcccaaagcagtgaagtgaaaacattcgctcagaaaatggtcgacgatcacggcgccgcgctgaccaaagtccagaccgttgcccagaaaaagggcgtggagctgccgaccgaaccagacgccgcgcataaagccctgaactcaaggctggaaaaccagcgtggtgacgcttttgacaaaatgtatatggaatatgctggcgtgaaggaccacgagaaggtgctgtcgaagcttaagagcgacgccagtaaaatcgacgatccggatgtgaaggctctggccaacgagcacacgcccgtcgttgagcagcatctgaagtccgccgagcagatgtcaacccactccggcgcatcagccgataaataa

SEQ ID NO: 5634 - DNA, 258 bp, Enterobacter cloacae
cgagatagtcgcgctatggcgcgagatgactcgccgtcgccgtcgctggcgggtgcttttcacgggctgaccggaaccgcagctttcttcctgtgcgtggtttttagtcaaaaaaaagccccgtactacgacggggccaggctgcttatttcgctgttatttatccagcgcgtaggcaatcacgtagtcaccacgatccggcgactggcgtgcaccgccggcagagatcagaatgtactgtttgccggttttcggtga

SEQ ID NO: 5635 - DNA, 573 bp, Enterobacter cloacae
ttatcgaccactatggcctgctgggtacgccgcaccgcaggatcgatacaaaacgcattattgcgctgggatttatcatcgccgcgctcattctcgtggcgcaggggtaacgttatgacagtgattatgattattctggcggtgattggcggcgcaacgctgagcattcaggctgccattaacgggcaattaggcagcagcgtgggggtattcaaaagcgcgtttctgacgttttccgtcggcgcgctggtgaccgccctgctgatcttcttttttgagccgaaacaggcggtcagcctgatggatgtacccaaatggcagcttctgggcgccctctgcggcgtgccctatatcgtgattatggtgctcgcggtgcagcgcatcgggaccgctgttgccacggtagcggttatcctgggccagctggccatgagcatgctgattgataactttggctggctgaacaatgaagccattccgttttcagtgagccgtttcggggccgtcgtctgcctgagtattgcgctcttcttcatttactcaagcagtaaacttcagcccgaagaggattaa

SEQ ID NO: 5636 - DNA, 198 bp, Enterobacter cloacae
cagcaaaaaaatccgggccgtcaaagccgcctgatcgtcagaacgactcatcacctgtcctgccgccgcgggccggaaacggctcgcggcttaatcatgcattatgtcgatcttctcgaaaacaatgcgattgaacattttaatctgttctggcgtaaaatttggttacagcatttcctctcgtcagacgtatgttaa

SEQ ID NO: 5637 - DNA, 1131 bp, Enterobacter cloacae
atcgcgcagttcatgaagaaccctcatgttgcagtgaaattaagtcacttcccctgcgccaggggctcaggcataaattatgcattgataacgttccggcaacatgaacttaggatgcataaccaaatgagtcaggctttcacatttacccttaagcgcagttgctttgatgaaaattataacccgtcagaaaacacgcgtaccaccaccaacttcgccaacctggcgcgtggcgagaagcgtcaggagaacctgcgcaacacgctggtgatgatcaacaaccgctttaacgcgctggcgagctgggataacccgaaagctgaccgctatgccgtcgagctggagattatttcagtcgatatgaatatcggcggcgattttaccttcccggccatcgaaattctgcaaacgacgattgtggataaaaaaacccacgagcgcatcgaaggcatcgtcggaaataacttctcatcgtatgttcgtgactatgatttcagcgtcctgctgctggagcataataaagatcaaccccgttttaccctccccgagaattttggcgagctgcacggcaatatctttaaaagcttcgttcattctgcggaatatcaggcgaacttcaaaaaagcgccggtgatctgcctgagcgtctccagcaaagacacctatcgtcgtaccggtaaccaccacccggtgctggggtatgagtaccagccggacggcgagtcgctaacggaacagtacttcgcgaagatgggcctgaaggttcgctatttcatgccggaaaacagcgtcgcgcctttcgccttcttcttcaccggcgatttactgcgtgattacaccaatctggagctgatcggcaccatcagcaccatggagacgttccagaagatctatcgaccggaaatttacaatgccaattccgctgcgggacagtgctatcagcccgacctgaatcagcaggatcactcattaacaaaaatcgtctatgaccgtgaagagcgcagccggctggccattgaacaggggaaatataccgaagagcggtttatcaaaccctacaaaacccttcttgagcagtggtctcatcacttcacgctttcatttaatacggataaaaggttcttctcatga

SEQ ID NO: 5638 - DNA, 210 bp, Enterobacter cloacae
ggatgtcacgcgatgaaacatttactgatgacgctcttttccagcccggaatccttgttgcaggtcatgagtcaccaggaaattatcgaagccgtagaggatggcgaccgcatcatcatcgatcaggatggaaacgcctcggttaactacaaaagccacgaggtgcggcaggactttctgcgccatgtcaacgcgctgaagagggcctga

SEQ ID NO: 5639 - DNA, 210 bp, Enterobacter cloacae
gatgagcagcatgatggagccgtcacatttaaacatgcatttatgttgcattatttgaacaagctgttattgtcccaaagccttagagcacataaacataagaaaagttttgacttaaactcgccccgcatcaggggcatttttttggctgtctgtaaacaaaaaacccgccagaagcgggtttttgtggtattcgagaaaattatttaa

SEQ ID NO: 5640 - DNA, 330 bp, Enterobacter cloacae
aaaaccaaattcgagggtatgaaaatgaaaaaagtattagctctggttgttgccgctgctatgggtctgtcttccgctgcattcgcggctgaaactaccgccaccgcagcgcctgcggcttccactgctgctccggccaaaacggttcaccataaaaaacatcacaaagcggctaaaccagcggcagaacaaaaagcgcaggccgctaaaaaacaccacaaaaaagcggcaaaaccagcggtagagcagaaagcccaggcggctaaaaagcatcacaaaaaagcagcaaaacacgaagcggctaaacctgctgcacagccagcagcgtaa

SEQ ID NO: 5641 - DNA, 219 bp, Enterobacter cloacae
catggtgattgtctggcccctgaagcacttcaaggatttttaaccgaggaagcgttactttcaggccagctttctttaatgcggtattgttgtcagtcatgcggaatctgtcctgttgctaaacgattcacttcaaaagaagaagtgacagaaaatgcacttgggataatgcgtctcattatagaactgccgtgcctaaatgaaaagttgcaagcgacc

SEQ ID NO: 5642 - DNA, 231 bp, Enterobacter cloacae
attaaacctccgctttattcttatatatatgatttccttatgtttaatttagctaaaggcctttcgtataaacagaagttaaacggctcattttttcttataatcgacaaaagccatccagatggctgtgagggtggttgttttttgtgctattgcgtaaggattgtattaagcgccataaaaatggggttatttttttatctcaggatatttcgtggaaacaaaacgtaa

SEQ ID NO: 5643 - DNA, 462 bp, Enterobacter cloacae
tccttaagtcagtatcagggaggtgtaggtatagaaaagaataaggaacttgtcgccagtcaggcagcgtatagcgggtatattgtggagtttaataatggctcccgtctttggataaatagggaaacattgctcgtcggatggttcgacaatccgcaggtgcctcaaaagggaaggatgcgctttcagaagacaaagatgaatctttttgcttatcttcttgaacatgctgtgcgaaaagaggtcagccgtgatgaattattacatcaggtatgggaaaagtatggccttaagtcatccagcagacaactttggcatgcaataggccagcttaaactgagtctgtttacgctaggtattccttacgaatttattcagtcgaataaaggtaagacctattcactggaaaaagtaaaggttttctttattacgcaatccgatattaatgatgatgcatattaa

SEQ ID NO: 5644 - DNA, 258 bp, Enterobacter cloacae
tatatgaatttggcctattttttatttttgtctataactgttatgcttacgagctttattattaaatcacttgtcgtattggtaaagttcaaattacttcgtgatgaacgtctcgaatataccagcaataaaaatattgatgagatgtacgatttaatgaatgcgaaggaagaaatcctcataaggcatcataagcagatgttggcattgcatctttcactattaatattcgttctatttattgcttacatttactaa

SEQ ID NO: 5645 - DNA, 297 bp, Enterobacter cloacae
  unsure (139)
  unsure (208)
  unsure (226)
ttagctgcccttcaaccagccgggcaagatgcccgctggcggtcgacggcgcaacgtctgccgccgcactcagttcagtggccgtccacgcacgcccgtccattagcgcacaaagcatcttcacgcgcgacggatcggncattgcagccgccaccgcggcaatcgccttttccagcatcgcgctgttatcagagggttagctcgtctntaacattcgtccgcccanggtgtggtgatctcagcgggccacttatcatcatccctcagcagattaaggtgattcccatgggcactgta

SEQ ID NO: 5646 - DNA, 339 bp, Enterobacter cloacae
tacttaagtattctcatttcatcggcaaacaacggagccaatgagatgaacataacctcccaaccaaacccagcgagtaaggaatttgatatccacgccaagctcaaggcagcaaattcgcactggagttatttacgagctgcgcaacctcatcagaatgattttgattacgaatttaacaccacatttattgacggtttggaattcgctatctacgaacgtgtaggtaattattttgttctggttgatttcttcaagtcatatgaagaagcatgtgatgatgctaaaaaaatcattgatgaccatcctgacattaagaaaatgttctctgctatttaa

SEQ ID NO: 5647 - DNA, 342 bp, Enterobacter cloacae
atcgctggagtatttcacagcaaaaaagtcgagttagatgggatttgttatgaaacctctgatatttgtatctcagagttatcccatcttgaatttagtgcgtttttaagtacggatggtgctgctaccattgctatagcaaaaaacggaactaattttactggacttatgcaactgaataacgactattctttattgttttatcatgatggtaaaataaatatggaaggtctaattaaagaaatggaattaaaaggttatatgtatcagggagcaatgggcaatgatgatgttgccgctgagtttcccggtattcttttaattgcaccagagaagctttaa

SEQ ID NO: 5648 - DNA, 363 bp, Enterobacter cloacae
ttgcaccagagaagctttaatatcaaccctatcgggaaatctttccccgttggggagggtttccccttttttttggagaaacccatgactttaaatacttcaatgcttaacaaagtatctgcaaaacaaatctctgagaattttgcaaaatcatatccagatttactggaaggtgcagttataacaaaaattgaaataagtggctgtcaaggatcgcgtcgaaacgataaaatcgatttgtcttatgatggagatgatattacggatcaaaaaagcgtatctaaaaaccaattacgttggattgacataaaagcccttagcttccaaagtacgattaccagcagaatatccacccctttgctc

SEQ ID NO: 5649 - DNA, 663 bp, Enterobacter cloacae
ttgaaattaactaaagatgatttcataaatccctttagatttaatattgctcactttattccttttacgcctattagcgttgaaggtgatgaaacccaggactactatcaggaacaattgataacagatctggcagaagaagcaatgagggtttatgaaaaaattagtaaaaataataatttgcgctcaagtactattgaccgactgaagcaaatgcaaaataagatcattagcttcatgtttatacataaagaggcggcagtacttgcagaagctataaaacacataatgaataatttacctaaaggtgccatttctgaacctcgcgacgttgcggtgttacagcagtggttttatttcatgagtgatgcttcaatgttaaagcgtattatttcaggagagcaaaaggttactgactggttggaatctattaccagatcatttaatcaaagctcacaaacagaaccgaacgcgctacagaacacaggtattgaagctattttagattcaacaaatgtgtttcaggttgaacctgtcgtagagaacgatataaaaaacagcacgttttcaaacactgattctgtagctgaacctgagaaatcagtttcgcaacaggaagacaatgctgaaaatggttttgatatcgagctcaaaggctggtaa

SEQ ID NO: 5650 - DNA, 633 bp, Enterobacter cloacae
gtacccctttttataaagaggtattctatgaaattagatcttaaatcatcgccgcgccatattaagcgtttacagaatatagcaaaagtcattagcggcttaggcgatgtaagagttgtaatagacgacaataccaaaggaccgtattttgatcctgtcaataaagtttgtgttttaccaaacggcgattatagcgatgatgactttgtcagtctgattgaaggttttacctgtcatgaagctggtcatggtcgctataccgtcagtgaggtttacagtgacgcctttaatagtgttctcatgtcatctgaagggtttacacgcttcgatgacggaatgaatgcagagtttgagagcctcgctgagaaacgtaaagcttatagcagggcaaaacgtcttaccgggcttataaatctgttcgatgatgtacagatggaagagaaggttggtaacgattatccggatgcaaagcggcggcttgcagccacttacgcactgatggttaaagccggaaggatgactcctgatatatcttctcgtccggaaaatcctgtcctatttattgagtggtatctgcttaactcatcgcgagtacaatgtcttaactgcggagtgcaggaacgcacttttttt

SEQ ID NO: 5651 - DNA, 237 bp, Enterobacter cloacae
acattaactaaactaggatttatctatatgaaaaacatcaaatctatcgccgctgcctctttgttatccgctgtgtccttctctggcctggcacagaacattagtgttactgacacaactcttgatggcgctgaagcgcagattgcggctaaggcaaaagaggcaaaaacctcctacaaaatcatttctgcatatactggtaatcgtgtgcacatgaccgctgttctgggtgaatag

SEQ ID NO: 5652 - DNA, 363 bp, Enterobacter cloacae
agacaagaggcatcgacaatgcgtctggcatcatatgctattgcgttacttttcatcacttcattgacgggctgtaaaccggaaaatggaaaggcttttgttggaaattgggtcgaggaaacaaattcaaagatcccggctaaaatttctattgccgacgagaaatcggggcaacgtcatttctatgcggtaaaaataaccgatctcatatgggataaagaaacgggcgtccattacaacacgaaaaaaatcaatgccatgctggataaagaaaatttcctgtgggcgaataatggggataacttcatcatctttgacgatcatcttatgtataacggagatcgctacaaacgtgttgagtag

SEQ ID NO: 5653 - DNA, 195 bp, Enterobacter cloacae
gtcccgcaacgagcgcaacccttatcctttgttgccagcggtcaggccgggaactcagaggagactgccagtgataaactggaggaacgtggggatgacgtcaagtcatcatggcccttacgagtagggctacacacgtgctacaatggcgcatacaaagagaagcgacctcgcgagagcaagcggacctcataa

SEQ ID NO: 5654 - DNA, 609 bp, Enterobacter cloacae
ccccaaatgtctaaaaataaagctcgcagtaaagcccttcatcaaacctttagtgaaattattccagagatggataaggcgctaaacaaacagctcttagaagttctgatgaaatatacagaacgtgataatgaactgattgttattttgaatgaggacggcccaaatatcattgaacttaagtctcttaagcctgtgtctttgttggccgaaaagctttctgcttattcaagctattatcatgtggatgttgtggagctcgtggtcaagaaaattgatttcgaaggagcttataagcttcttaaagcttccccagatgtaccactttttaaaagcttaactgaactggataaatatcttgttgaggagtttgaaaaatacggattaaattcatttcttgacgtggataatctggattactcacttgaaaaagccagtgaactcaaaaatgagcagttaataaattgggtttcggacatcatttgcaaacgtgaaaaattaactttacgtaagcgttttgatgtcgcagtaaaggcccactacgaaaatgtagaaaacatgtatgattcttcaccacagaggggtcgaaggacccgcgctaagcggtga

SEQ ID NO: 5655 - DNA, 220 bp, Enterobacter cloacae
actttgggcctgagagaagctacactgaaagaacagtttttggtttctgcggtctcgttatacccaattacctggtttaagcagttccccaaatggacttatacctccgatcaaaccaacctccccaagttggttttttttccgtttccagaagccagaagaattaccaatggttacgaacacggattccctataaagatttttttactccggaacagac

SEQ ID NO: 5656 - DNA, 855 bp, Enterobacter cloacae
tttcagatcaccgccatcaacagtgcgacgtcactgacggttacgcctgccgcgtctcaggcgttgagcggccagaagtacggcattcttgttactgatagtctctcagtcgacggcctggcgcagagcatgtctcaactcatcaacgagtacgacgagaacatcggcgcctgggagacgttcgccaccacctcagcaaaccagaacatcaccgtcaccatcaacggcgctcgtgtaactattccggcgatcggcaaactggtccagaaagggagcaatggggcggttggagtttctgacggcgggaccggagcaacgaatgccgctgacgctcgcacaaacctcggtttaggaagtagcgcgactaaggacgtcggaacggactccggtaatgtcatgcaagtgggggcttttggggttggtacataccaggctccaaggccaaatgatgcaaactcatcgtttatcagtgatgctgacggtaacaccagttgggctcctgccaatggctgtggctaccaaagctcttataacactcagcgcatagcgcaaatgtgggttaccactggcggagctggctattgccgttttctgttaaacacgaatcctcaaactgcaaaaacagatgctccgtggacggtatttcagtcagcaggaacatcggacattaactttaagaaagtgaccggggatctggatctaaacgaatcgctgtcaaacatcgcggcaatggattttaagaccttctactaccttgctgatgaagataaagtcattcgccgcggcgttattgctcaggaactggaaaagatcgatccccaggtcttcacaacgcggtcgaagaaagtactatgt

SEQ ID NO: 5657 - DNA, 192 bp, Enterobacter cloacae
gaaggtgcgctggatcacaacaatcacactattagtttaatttacaacaaaatgttgatattattcattcaggtgaatgacaggtatgagattcatccttatcagcgcgctggtgataaacttacttttatcaaaaataacctattgaatatatttatatttttacatgaagcaattagacctgaaccatga

SEQ ID NO: 5658 - DNA, 216 bp, Enterobacter cloacae
caaacaggaagcggatcggactgctatctcactgcttcaccagctacacataactgtgactcaatggaacaggttgctgataagttctttgacaggctggtgagtggtcagattaagattaagcgtggtctctctgtgaatggtcactcttcaaaagagaaatataatttgatagctggtggcatggtgaatgtgaaaagccttgtcagggggtag

SEQ ID NO: 5659 - DNA, 297 bp, Enterobacter cloacae
ccaatctaccggctggtcgacaactacaatcaaagggcggtcggcttcccgcagcagacgatggggatcgctgcaccagggcagcgtatgggcgagcagacaggcatcaatggatttttccgcaaacggcaaatgcatcggatccgctttcacctgaaccggggagccattaagcgatacgctaacctgatgcgagatagcgcagctttcggtattgatttctgcgctcagattgccaatcttaagcaggtgaaaaccattcattttcgcgagccagggtttaagctgaagttctaa

SEQ ID NO: 5660 - DNA, 237 bp, Enterobacter cloacae
cacgttctcttatcaggtgatcgttatactccggtgatcgaaaccgtggcagagccggattctttcccgatccggttagtcttcccaacattacgcctgtttattctctgtgacctttcacaaggtgtagcatcattgagcgccgcacgaagcgcggaacgtatcgctaatggttcaagtgatgtgtttagagattccggcaactctttcagcttcaagggatggcaaaatttctaa

SEQ ID NO: 5661 - DNA, 210 bp, Enterobacter cloacae
aaaaaggctgttaacttaggattgctaagtatacaacaatgtcagatacttagacaatctaagcatccgaggccgatgaagatgattcagtgtcagaaaaaaacccgataccagaacgacttaaagaagcgagatgcagggcgggactatcacagcgctctctggggctacttattggctttgatcccgcatcggctagtagtcgtatga

SEQ ID NO: 5662 - DNA, 579 bp, Enterobacter cloacae
cagcctttttttagtgatatgaatagtagagtaaccaaccctgagtcgtacatattttctgcaatcatctatattggcaaagataacttcaccagtaacgaagtagcgaaaattcttatcgggcgattttcacttccgaaaaattatttaaaggcaaaagcttttgcttataaccaaattcaaggtctggttagaaagggattgttaaataaagtaagaaaattaggtgcgtatcaatatttatactcagccacatctgaattcaatgtcgcaaaggaaaacgtagagttaattgaggtatcccaaaaaagcccctgtcaacttatttcaagtgctaccagttatgaacatagcaatgtaaacattcaaataagaactcttattgaaaaatacagcagcgagttggaaaaagtatcaggagtaaaggagatttatgaagaattgataattgccgtgccgagcagggaaaatgaattcaggaaactttctctcgaacaagagaaaaagcaaattaagataaatgaacaaatattcttcaccacgaagctgcaaggatgcccgataaattctatggttcag

SEQ ID NO: 5663 - protein, 144 aa, Enterobacter cloacae
CCRRLSGSASPRWSLCLCWCSGCCRACSPSFCLGSPPGASCSPAPSGCAFSCRFCFSAPAASCFILVVALLFCLRFVVFPVLLFGSVCLAWFLVFAFLVALWMDQGVVSWLRHVLLAPGSHKNPVTLVITGLILRAIVWSVMLL

SEQ ID NO: 5664 - protein, 76 aa, Enterobacter cloacae
SRTRQERKSKTDRKKRNRKEQGSKTPQEENPNKTKANRRDSSQNTSRDTKTTEATPIQKDGDNISTKKTNRDKNRT

SEQ ID NO: 5665 - protein, 163 aa, Enterobacter cloacae
NPNQSEALGGTIARGMVNTQTGQEEKKVGTRRIERKKPPVVTGAEEKAKGQNLAPKAEKSESGSPKESRKAEKTEQSIGEEAVKTRGKIQRQQIQDGQKAASQVNAQQANEIGLGKPEDFTQIHQAARIGKPHITSPTFNVQAMMLIAPGLHLATGRIRAYVS

SEQ ID NO: 5666 - protein, 88 aa, Enterobacter cloacae
SSGCRQENRLSVGNSIGQDRRFLFKYMPELESYFHYRYLDVSTLKELARRWKPEIFDGFTKQGTHQAMDDIRESVAELAYYRENFIKL

SEQ ID NO: 5667 - protein, 130 aa, Enterobacter cloacae
PATAGYARRVENNMSADENNLIWIDLEMTGLDPERDRIIEIATLVTDANLNILAEGPTIAVHQSDDQLALMDEWNVRTHTGSGLVERVKASTLGDREAELATLEFLKQWVPAGKSPICGQQHWSGSSFPV

SEQ ID NO: 5668 - protein, 224 aa, Enterobacter cloacae
PLPLSWQSVVKTSATFFTNITLGKLSLLFLALGVAYAAIRRTLLIVYPPILSDGLFNFVVMQTLFYIPFFLIGALAFIHPRLKALFTTPSPWCAVGAALAFAAYLLNQRYGSGDAWMYETESVITMLMGLWMVNVVFALGHRLLNFKSSRVTYFVNASLFIYLVHHPLTLFFGAYITPHIASNALGFFTGLVFVVGIAIVLYEIHLRIPLLRFLFSGKPQVKAG

SEQ ID NO: 5669 - protein, 215 aa, Enterobacter cloacae
RRFVPVGLPVTDVLFAAVILILPVGYIGEKGGLQRVFMRPQIDVIHGDITTVRVDVIVNAANSSLMGGGGVDGAIHRAAGPQLLEACKTVRQQQGECPPGHAVITLAGDLPAKAVIHTVGPVWHGGDRHEAEILEQAYRNCMRLAADNGYKTMAFPAISTGVFGYPKEAAATIAVNTVYQYLSLKPMPEKVIFVCFDEHTADLYQRILTARSQAF

SEQ ID NO: 5670 - protein, 307 aa, Enterobacter cloacae
SPCIIATLFAPEPSDVIPFPRSLEQAVAAPFRDFFGRNNAWLILLLIVLYKLGDAFAMSLTTTFLIRGVGFDAGEVGVVNKTLGLFATIVGALYGGVLMQRLSLFRALLIFGILQGASNAGYWLLSITDKHMISMATAVFFENLCGGMGTAAFVALLMTLCNKSFSATQFALLSALSAVGRVYVGPVAGWFVEAHGWPTFYLFSVVAAVPGILLLLVCRQTLEYTQRTEHFMPRTEYQAAYRFALRLLMAGCLALVVWLAVLIINATTTLSLPFETQLLDAGVFLAIVGILTGGMLDFMSLRKTQMT

SEQ ID NO: 5671 - protein, 334 aa, Enterobacter cloacae
  UNSURE (333)
MANYTVDEFIIQLGFNETVSKNLQKLESRTLKVAERIEKNLNRAFTPKGDFGRVISSANNASKQINRAFSKSMNFDEAGKSSVKSVENAAKASAKRIKDMYQDAYGAKGKGRSNPPAAGKPQGRGSDLTAANSIRSLANTQFYSNLTRRLEGMGSTGQARAMKLRQQVHGLRDDALANPSASLNQFRLALRAATDSASKWASQNRKQVSNAEGLSSSFGRLVSVSAALYGTFEAVRKVVETGVAREGVNLSAEAVFKGQSKNAKTFAAQFSDQIGQGVTETLKQYTGFAAGAQNSLGYQGTQDFYKNAAVFGRIRGLDAEQRTGIMIFTSRAXS

SEQ ID NO: 5672 - protein, 390 aa, Enterobacter cloacae
NKLNSGIRRVLTGVFKVIIIRYLVRETLKSQLAILFILLLIFFCQKLVRILGAAVDGEIPTNLVLSLLGLGVPEMAQLILPLSLFLGLLMTLGKLYTESEITVMHACGLSKAVLVKAAMVLALFTGIVAAVNVMWAGPTSSRHQDEVLAEAKANPGLAALAQGQFQQATDGNSVLFIESVDGNRFNDVFLAQLRPKGNARPSVVVADSGQLSQRKDGSQVVTLNKGTRFEGTAMLRDFRITDFQNYQAIIVHQAVALDPTDTEQMDMRTLMNTDTDRARAELHWRITLVFTVFMMALMVVPLSVVNPRQGRVLSMLPAMLLYLVFFLLQTSIKSNGGKGKIDPMIWTWVVNGLYLLLAVGLNLWDTVPVRRLRARFTRKGSSPRGGRTAS

SEQ ID NO: 5673 - protein, 252 aa, Enterobacter cloacae
  UNSURE (224)
RERTNGDTMTLPSFINASPALPATGQSAGLDYGRALSLREMARHYTELPKYLLAPEVAGLLHFVQDWGQHAFFNTLWNTGARLNEGLALRRRDFHLNESIPHVVLRTAKQRRAGGGRPRKGKSANRVVPLSDPAYVDEMRRLFASTKEQFEDDPITGERRAQPVWNVSDRTVRNWLVRATDAADRDGVRLSIDVSPHTFRHSFAMHLLYGHVHPKVLQGLLGHXKFESTEVYTKIFALDVAASQQLRFTLDT

SEQ ID NO: 5674 - protein, 317 aa, Enterobacter cloacae
  UNSURE (313)
NATGKHLPEGGVCILPELKMSNAAMKLNETSSDAYEKLEALLSPDVIKLKHYVDKGEYLLVLAKDLFGIPEMDPKMAVPVFKTKTSYRAPLNKDYIPNPRILEQVVKLLISPDIDLSVCLKGESGSGKTEMVMYISHMMNWPLTIKQINSNIRVDELEGERSLNGGNTGFVHSDLVTGFRNGHLILLDEVDKIDPDTAAKLHMPIERKPWSLSANGGEVITANGYTRFIGTANTNMSGGARRFVSSQRQDAAFIKRFLIVEMEKPDKVALTNVLTKRYSSLPFQVIEKFVRVAIAVNDSGTEDSVMDIRQLVXWVGT

SEQ ID NO: 5675 - protein, 172 aa, Enterobacter cloacae
VLEVKTAQMGHESTRFTRLVENLNYAVENLVPTFGSHRITQQQSAALGRTATQPANQKAIANLVYGGEWGKEHLGNQVAGDGWKYRGRGLKQITGLSNYRSCGQALKLDLVTHPELLEKDEYAARSAAWFYASRGCLLHSGDVERVTLLINGGRNGLDKRRALFNLAKSVLV

SEQ ID NO: 5676 - protein, 115 aa, Enterobacter cloacae
WRNCVRIETSLFTTPECMKAITLYDVARVAGVKKKKKKKKKKKKKKKKKKKKKKVRQAMAALHYVPNRGAQQLAGKRTRTLGLMTSDLALHAPSQIASAVKSRLHHGAGRFRAKR

SEQ ID NO: 5677 - protein, 113 aa, Enterobacter cloacae
FPELTSLPVRITLMVSGIVVNALATGMYIGAGFGAGPRDGLMTGIHARLGWSIRSVRTAIEVTVLIVGYLLGGAFGVGTVLYALTIGPLIQLCLPWFRQRPRIQKAAQPERIV

SEQ ID NO: 5678 - protein, 369 aa, Enterobacter cloacae
  UNSURE (341)
SLHICVKVGFQCKKVITMNLLEKIALVGQRMKSEQISLKESLMASSRVSVSDDSVDGVDRLIYNHCLNKKNLSDFFGKSRVTFNKILSDLEEKELVGAPIYQNKNHLYTRWDVQKIMDALGYPKYRDHYFSRAIVTQNHKGGTGKSTTSVALAVAAALDLQLNARVLMIEWDPQGSIGSSMIQSVSEDDVFLTAIDAILGIYEENSEYKKYLDSGFSEEEIITNMPFSTHLPNLDVITAFPTDARFKDKYWQCSREERTSLLLRFKEVILPVLKQNYDLIIIDTPPEDSPLIWAADEAADGILVAVSPREYDYASTTDFMLTISERCKQSPSKGDNLKWFXVLAVNVNDKSPYERIVLDKLIKTVQGPF

SEQ ID NO: 5679 - protein, 352 aa, Enterobacter cloacae
  UNSURE (344)
RLLDPGNFATNIQAGASFGYKLLWVVVWANLMAMLIQMLSAKLGIATGKNLAEQIRDHYPRPAVWFYWVQAEIIAMATDLAEFIGAAIGFKLILGVSLLQGAVLTGIATFLILMLQRRGQKPLEKVIGGLLLFVAAAYIVELIFSQPNLAQLTKGMVIPSLPTSEAVFLAAGVLGATIMPHVIYLHSSLTQNLHGGTSKERYSASKWDVAIAMTIAGFVNLAMMATAAAAFHFNGHTGVADLDQAYLTLEPLLSHAAATIFGLSLVAAGLSSTVVGTLAGQVVMQGFVRFHIPLWVRRSVTMLPSFVVILMGLDPTRILVMSQVLLSFGIALALVPLLIFDVIXPGMEGSAL

SEQ ID NO: 5680 - protein, 356 aa, Enterobacter cloacae
  UNSURE (354)
TDERILTMSNVFYMPPVTLMGLNAIRLLGDELVSRELKKALIVTDRVLADTGLVNKLTDELEAHKISYAIFDGVQPNPTEKNIDDGLALLAKSNADFVISFGGGSSHDTAKGIALVATNGGHIRDYSKGVHLSKKPQLPLVTVNTTAGTASEMTVFAIVTNQEDETKYPVVDKHFTPIIAVNDSELMVAMPAFLTATTGMDALTHAIEAYVSTAATPVTDACAIKAIEIIVNNLKDVVDDGQNREARDAMQYGEYLAGMAFSNASLGYVHSMAHQLGGVYNLSHGLCNAILLGEVSRFNAKKVPDRFVEIARAMGIDVSTMTQEQAINSAIEAIEMLSQKVGTNQRLADRASRXSP

SEQ ID NO: 5681 - protein, 178 aa, Enterobacter cloacae
GPKDLFPQKCDRVMIDASSVVIGDVRMADDVSIWPLVAIRGDVNYVAIGARTNIQDGSVLHVTHKSSYNPEGNPLIIGEDVTVGHKVMLHGCTIGNRVLVGMGSILLDGVIVEDDVMIGAGSLVPQNKRLESGYLYLGSPIKQIRPLKEAEIEGLKYSANNYVKWKNDYLDQDNQTQP

SEQ ID NO: 5682 - protein, 66 aa, Enterobacter cloacae
NIYAYDMFYQKGKTPFLTWCEQQGAKHVADGLGMLVGQAAHAVLLWHGVLPAVEPVIEKLKKELMV

SEQ ID NO: 5683 - protein, 118 aa, Enterobacter cloacae
WSGHAGGAGGSCGATLAWRVTCCRTGDRKAEKGTDGMNQAIHFPDREIWDENKQAVCFPVLVHGMQLTCAIKGETLLQRFGGSDPLAVFCENRWDLEEEASDLIRVQQEDDQGWVWLS

SEQ ID NO: 5684 - protein, 65 aa, Enterobacter cloacae
STHYAQRKLGGRWQLRQNFVYLVAIFAHIHNLWSVKILSPQPVIYALMALALLAWRYKKFRQWLR

SEQ ID NO: 5685 - protein, 173 aa, Enterobacter cloacae
KGDNCALRVYVVFYPKIAGDSGIMADKFQILVLNGPNLNMLGTREPEKYGTLTLSEIVNRLSTEAASLNVDLDHFQSNAEYAIIDRIHQAKDTVDYILINPAAFTHTSVAIRDALLAVSIPFIEIHLSNVHAREPFRHHSYLSDIAAGVICGLGADGYSYALQTAVKRLSQSH

SEQ ID NO: 5686 - protein, 196 aa, Enterobacter cloacae
QRHTPAAKNWHPYCKTCLTTQPLPARYFRTGGNMNLRRLKYFVKIVDIGSLTQAAEVLHIAQPALSQQVATLEGEMDQQLLIRTKRGVTPTEAGKILYTHARTILRQCEQAQLAVHNVGQTLSGHVSIGLAPGTAASSVTMPLLQAVRAELPEVLVYLHENSGSVLNDKLLNGQLDMGGAVRSLPGCRDHQPAAAE

SEQ ID NO: 5687 - protein, 79 aa, Enterobacter cloacae
LIDQPVKVTTEPDGSRWVEVHEPLSRNRAEFESTNKVPLPISAAQRTQLISEGAGAELERRSGMPVKLAMTGSASLAGP

SEQ ID NO: 5688 - protein, 113 aa, Enterobacter cloacae
PCRCFRRCEQSYRKCWFICMRTVVPCSMTNCSTVSWIWAVLYDRSPVAGITSQPLLNEDLYLVGTRDCPGQSIDLTAVAQMNLFLARDYSALRLRFDETPSLRPLNANNFLLE

SEQ ID NO: 5689 - protein, 163 aa, Enterobacter cloacae
PVYTPLALRDWFRAAPRNPLKPLPRLRLVQHRADREKISRPSRRYQEAGLADKRSKMLTMWVTEDEHRRLLERCEGKQLAAWMRQTCLDEKPARAGKLPSISPALLRQLAGMGNNLNQIARQVNAGGGSGHDRVQIVAALMAIDAGLERLRHAVLEKGADDDR

SEQ ID NO: 5690 - protein, 232 aa, Enterobacter cloacae
WPSMPDSSGCGMPYWKRVLMMIVKFHPRGRGGGGGPVDYLLGKDRQRDGASVLQGKPDEVRELIDASPYAKKYTSGVLSFAEQDLPPGQREKLMASFERVLMPGLDKDQYSVLWVEHRDKGRLELNFLIPNTELLTGKRIQPYYDRADRPRIDAWQTIVNGRLGLHDPNAPENRRVLVSPSALPEAKQEAAQAITSGLLALASSGELKTRQDVTEALESAGFEVVRTTQGRI

SEQ ID NO: 5691 - protein, 464 aa, Enterobacter cloacae
RMAGNIDIPPIRADKCLFFPTINRENIMSVVPVADVLQGRVAVDQEVTVRGWVRTRRDSKAGISFLAVYDGSCFDPVQAVINNSLPNYNDDVLHLTTGCSVIVTGVVVASPGQGQSYEIQATSVEVTGWVEDPDTYPMAAKRHSIEYLREVAQLRPRTNLIGAVARVRHTLAQALHRFFDEQGYFWVSTPLITASDTEGAGEMFRVSTLDMENLPRTPEGKVDYDKDFFGKEAFLTVSGQLNGETYACALSKIYTFGPTFRAENSNTSRHLAEFWMLEPEVAFADLNDVAGLAEAMLKYVFKAVLEERADDMKFFAERVDNDAIARLERFVSADFAQVDYTDAVAILEKCGEKFENPVYWGVDLSSEHERYLAEKHFKAPVVVKNYPKDIKAFYMRLNEDGKTVAAMDVLAPGIGEIIGGSQREERLDVLDARMQEMGLNPADYSWYRDLSSPTGAGRIRAYLT

SEQ ID NO: 5692 - protein, 188 aa, Enterobacter cloacae
TTVLPAGLGENNTISGLLFLWVPTRKTNFIHGEPLRGVITQSEDFRMAKKVQAYVKLQVAAGMANPSPPVGPALGQQGVNIMEFCKAFNAKTESMEKGLPIPVVITVYADRSFTFVTKTPPAAVLLKKAAGIKSGSGKPNKDKVGKISRAQLQEIAQTKAADMTGSDIEAMTRSIEGTARSMGLVVED

SEQ ID NO: 5693 - protein, 235 aa, Enterobacter cloacae
EMAKLTKRMSVIRDKVDATKQYDINEAIALLKELATAKFVESVDVAVNLGIDARKSDQNVRGATVLPHGTGRSVRVTVFAQGANAESAKAAGAELVGMEDLADQIKKGEMNFDVVIASPDAMRVVGQLGQVLGPRGLMPNPKVGTVTPNVAEAVKNAKAGQVRYRNDKNGIIHTTIGKVDFDADKLKENLEALLVALKKAKPTQAKGVYIKKVSISTTMGAGVAVDQAGLSAAAN

SEQ ID NO: 5694 - protein, 105 aa, Enterobacter cloacae
  UNSURE (98)
SEFRNMSSGKHPGAKLMALNLQDKQAIVAEVSEVAKGALSAVVADSRGVTVDKMTELRKAGREAGVYMRVVRNTLLRRVVEGTQFECLKDTLVGLHHXAAQGPAI

SEQ ID NO: 5695 - protein, 127 aa, Enterobacter cloacae
RSTKMIQEQTMLNVADNSGARRVMCIKVLGGSHRRYAGVGDIIKITIKEAIPRGKVKKGDVLKAVVVRTKKGVRRPDGSVIRFDGNACVILNNNSEQPIGTRIFGPVTRELRTEKFMKIISLAPEVL

SEQ ID NO: 5696 - protein, 199 aa, Enterobacter cloacae
QRNYQVIWSSTMAKLHDYYKDEVVNKLMTEFNYNSVMQVPRVEKITLNMGVGEAIADKKLLDNAAADLTAISGQKPLITKARKSVAGFKIRQGYPIGCKVTLRGERMWEFLERLITIAVPRIRDFRGLSAKSFDGRGNYSMGVREQIIFPEIDYDKVDRVRGLDITITTTGKSDEKGRALLAAFEFPVPQVKVRFTEMA

SEQ ID NO: 5697 - protein, 118 aa, Enterobacter cloacae
KLSLWHQKYSKERIMAAKIRRDDEVIVLTGKDKGKRGKVKNVLSSGKLVVEGINLVKKHQKPVPALNQPGGIVEKEAAIQVSNVAIFNAATGKADRVGFRFEDGKKVRFFKSNSETIK

SEQ ID NO: 5698 - protein, 352 aa, Enterobacter cloacae
  UNSURE (278)
  UNSURE (352)
LRLALGGVTHTDSFLHLKIKGDMIARIFSFLSHRSVRVFAPMKTMKIAVSRELVSKVSTHREKVMLDNTDFTDVAAVVITVVESYSGILALLKRTGFQLPVFMFSTEPGEVPEGVTAIISGKAQELLELESAACRYEENLLPPFFDTLSQYVAMGNSTFACPGHQHGAFFKKHPAGRQFYDFFGENVFRADMCNADVKLGDLLIHEGSAKHAQKFAAKVFNADKTYFVLNGTSAANKVVTNALLTRGDLVLFDRNNHKSNHHGALIQAGATPVYLEAXRNPFGFIGGIDEHCFDEAWLRELIRDVAPQKAAEARPFPSGDHSAPHLPMARIYNARSGESTNIRAPLRLTSLX

SEQ ID NO: 5699 - protein, 177 aa, Enterobacter cloacae
QELNVVIGPFINAGAVLLGGVLGAVLSQRLPERIRVSMPSIFGLASLGIGILLVVKCANLPVMVLATLLGALIGEFCYLEKGINHAVGKAKNLIARPGKAKHGTHESFIQNYVAIIILFCASGTGIFGSMQEGMTGDPSILIAKAFLDFFTATIFATTLGIAVAASLHHGPEGPRMR

SEQ ID NO: 5700 - protein, 171 aa, Enterobacter cloacae
IITSMRSNRFEAFAMLLSLPFLLIYFALSALLVRTDIRTGLLPDKFLCPLLWTGLLYQLCLHPDFLPSAVVGAMAGYAGFAVIYWGYRLICRREGMGYGDIKYLAALGAWHGWCVLPVLALVAALMALLYLVAFSLFTPDKQALKNPLPFGPFLAAAGLCVGWESLINFPL

SEQ ID NO: 5701 - protein, 172 aa, Enterobacter cloacae
PDLRFNEWKRRDYIMKGDVKIISYLNKLLGNELVAINQYFLHARMFKNWGLTRLNDVEYHESIDEMKHADKYIERILFLEGIPNLQDLGKLGIGEDVEEMLRSDLRLELEGAKDLREAIAYADSVHDYVSRDMMIQILADEEGHIDWLETELDLISKIGLQNYLQSQIKVES

SEQ ID NO: 5702 - protein, 391 aa, Enterobacter cloacae
SATKSGTGTGRTTMIKSTDRKLVVGLEIGTAKVAALVGEVLPDGMVNIIGVGSCPSRGMDKGGVNDLESVVKCVQRAIDQAELMADCQISSVYLALSGKHISCQNEIGMVPISEEEVTQEDVENVVHTAKSVRVRDEHRVLHVIPQEYAIDYQEGIKNPVGLSGVRMQAKVHLITCHNDMAKNIVKAVERCGLKVDQLIFAGLAASYSVLTEDERELGVCVVDIGGGTMDMAVYTGGALRHTKVIPYAGNVVTSDIAYAFGTPPSDAEAIKVRHGCALGSIVGKDESVEVPSVGGRPPRSLQRQTLAEVIEPRYTELLNLVNEEILQLQEQLRQQGVKHHLAAGIVLTGGAAQIEGLAACAQRVFHTQVRIGAPLNITGLTDFLTRGGVKR

SEQ ID NO: 5703 - protein, 84 aa, Enterobacter cloacae
ARRSWQLTLTNGIKLNLGRGDTMKRLARFVELYPVLQQQAQTDGKRISYVDLRYDSGAAVGWEPAPVEEPNQQQNQAQVQAEQQ

SEQ ID NO: 5704 - protein, 218 aa, Enterobacter cloacae
IYLEVFMAVAANKRSVMTLFSGPTDIYSHQVRIVLAEKGVSFEIEHVEKDNPPQDLIDLNPSQSVPTLVDRELTLWESRIIMEYLDERFPHPPLMPVYPVARGESRLYMQRIEKDWYSLMNVIVNGSSSEADAARKQLREELLAIAPVFGQKPFFLSDEFSLVDCYLAPLLWRLPTLGVEFSGPGAKELKGYMTRVFERDSFLASLTEPEREMRLGRG

SEQ ID NO: 5705 - protein, 72 aa, Enterobacter cloacae
NASRPRLMTVEMSQLSPRRPYMLRAFYEWLLDNQLTPHLVVDVTLPGVLVPMEYARDGQSSPRRWQDPRLAL

SEQ ID NO: 5706 - protein, 110 aa, Enterobacter cloacae
YTEIAFRKTCIEPQSRCLLTRIKGVIMEKNSEVIQTHPLVGWDISTVDSYDALMLRLHYQTPNQLNRDEAEVGQTLWLTTDVARQFISILEAGIAKIESGDYQENEYKRH

SEQ ID NO: 5707 - protein, 232 aa, Enterobacter cloacae
QSVSKEKPMKYDLIIIGSGSVGSAAGYYATQAGLNVLMIDAHRPPHSEGSHHGDTRLIRHAYGEGERYVPLVLRAQTLWDELAALTEERIFERTGVVNLGPASSTFLATVEESAKAYRLDVERLDANGIMARWPEISVPEDYIGLFEANSGVLHSETAINTWIDLAAKAGCAQLFNCPVTGITHHAEGSTVTTSEGEYTATRLLVSAGTWVTKLLPDLPIHPVRKVFSWVPV

SEQ ID NO: 5708 - protein, 157 aa, Enterobacter cloacae
HLFDVALKFRVLILYEVVLLRVYEAKAKTRSYLMATVNQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 5709 - protein, 137 aa, Enterobacter cloacae
QRSNPMPRRRVIGQRKILPDPKFGSELLAKFVNILMVDGKKSTAEAIVYSALETLAQRSGKNELEAFEVALDNVRPTVEIKSRRVGGSTYQVPVEVRPVRRNALAMRWIVEAARKRGDKSMALRLANELSDAAENKG

SEQ ID NO: 5710 - protein, 112 aa, Enterobacter cloacae
TFVFRSIRKFVRQTQSHGFITAFTSSFNDPTHCQSITTNRTNFNWNLISRTTNAARLNFYSRAHVVESDFEGFQFIFTRTLSQGLQRAVYDCFCGRFFTIYHQDIYKFCQQF

SEQ ID NO: 5711 - protein, 184 aa, Enterobacter cloacae
  UNSURE (165)
KLYAREAFMPRRQILSSEEQERLLVIPDDEIILTRMCFLNEPDIALINKHRRPANRLGFAVLLCYLRGPGFIPDKSSAPHNGVVSRVASRLKLQPDLWPEYASREQTRWEHLTELYRYLELSPFSRSMQKECIRHLQPYAMRTDKRFMLAGRNAHLGYINNNVYXPLLLKVIQTDALPKSFTLR

SEQ ID NO: 5712 - protein, 211 aa, Enterobacter cloacae
FRTHVIIRTSISYGKFPMSRVFAYCRVSTLEQTTENQRREIEAAGFAIRSQRLIEEHISGSVAASERPGFIRLLDRMENGDVLIVTKLDRLGRNAMDIRKTVEQLAALDIRVHCLALGGVDLTSPAGKMTMQVISAVAEFERDLLLERTYSGIARAKAAGKRFGRPPILSEEQKQTVTERLNAGISISAIAREFNTTRQIILRVKAGLLQE

SEQ ID NO: 5713 - protein, 133 aa, Enterobacter cloacae
SPFAGLRLFGEKSDSVICGHSNCGAMKAIADNADLEPMPAVSHWLRYSDAAKAVVEKKTWDKPIDKVNAMVQENVFAQLSNIKTHPSVAVGLRNNAIRLHGWVYDIESGKILALDKNTKSFVSLSENPEVFFE

SEQ ID NO: 5714 - protein, 302 aa, Enterobacter cloacae
GVELFGSAAPLVKTEADFYCPIPYEPLSVLTDCVVASEIDKGPDGLLDRIFALMVKELELADPRWCQAIALGTLNADTLRDAWFEDRKKHGPFTWAEANLKEVERNKREKRTVAWRYTVLRLHEVVQAIVPSLNEHDRERFKSGLERVFIDNYAAIPPQSIRRLLALREAGIISVVALGDDYDLDIGSDQTVITTAKKSYRFDVFIDARGQKPLRNKDIPFPTLRKQLAGTGDDVPDVGEDYTLLAPASLRGRIAFGAIPWLMHDHPFVQGLSECAEIGKAMAKAAGKPASGVRRKLPYMEF

SEQ ID NO: 5715 - protein, 127 aa, Enterobacter cloacae
NCFLIPLIQENDTMLDWNNYRSELMQRLGELGKLTPETMKGVVALGNAGNKTDLLGAKVRELIALACAVTTRCDGCIAFHADAAVKAGATDAEIAEALGVAINLNAGAAVISFSPHLSTARDEVAAP

SEQ ID NO: 5716 - protein, 118 aa, Enterobacter cloacae
LMRGPAAPLVKTTGMSPTEYIMQALAGCYTATLTMMAAEKGIDLDGIELDLNFDINLNGFLGLDSNVRKGAKSIRVDVHLTSNTASREELEALVSEMQKNSPIHDTLANPVEMITRLA

SEQ ID NO: 5717 - protein, 207 aa, Enterobacter cloacae
QQYNLSTSRLYGVIMTTMTRERLLSEAEHLMREKGYSAFSYADLSKIVGITKASIHHHFPTKDILGEQVVIQAFSDTQRVFEQIEATEKSAERRIAAYIDIFAQSHKASLLPLCCALSAETANLPQAITVQTSLYFDMQIEWLTKVVRAGMESGEFSSHAEPSDIALMIINVCEGSSVVAHATARPEVFANSLKYIKLLLNTPHSGE

SEQ ID NO: 5718 - protein, 261 aa, Enterobacter cloacae
SRLHRRIAPFEDHAISATLKESLTKQGVEFLTGADLKQVKVGGDLVICTVIVGEDTHVITAEKILIATGRRPVTEKLNLDAVNVSVGARGQVIVDKHLMTSNPRIWAAGDVTGEAQFVYVAVEQGRLAASNALGGELSSLDYNALPRVTFTSPELASVGLTPLQAEERGIPYEIRELPVAFVLRAIVSRHSDGLIRLVSDSQTGTILGVHMVSESAGDVIAAATYIISANMTVHQLANIWSPEFTMTESLKNVAKTSPITN

SEQ ID NO: 5719 - protein, 83 aa, Enterobacter cloacae
  UNSURE (25)
GHMSQQLTFADSEFSSKRRLTRKEXFLSRMDTLLPWPQLLGNIEPVYPKTGNGRRPYSLETMSRNPCLQLWYNLGDETMEDAL

SEQ ID NO: 5720 - protein, 165 aa, Enterobacter cloacae
REPSMNSLLTLAKDLEQKSKAQQQTTGEMLKAAFSEHEKSVRAELSESEKRISAAILDHDRKLSSAMSQRTKGMLRMVSQTWLTIVLVSALLIASSAGILWWQGQQILENYTTIREQKSTQAMLSERNSGVQLSTCGEQRRRCVRVNPEAGQFGEDSSWMILAGK

SEQ ID NO: 5721 - protein, 72 aa, Enterobacter cloacae
HMTELEKQLLSALEQLQQDYSKRLDEWENAFAEWRTMSGLIQRENAALNERVTVLSRQVQSLSEQLRRLSKG

SEQ ID NO: 5722 - protein, 286 aa, Enterobacter cloacae
PTLPSTDGGRNIRLKGAIYEQSFNAGEGLRAEIESAAADYRRDAESRIQRAREVCQSGTERKREENQRRHPRPRPEAVLSHEPAHERDAAHGQPDVADHRSGLRAADSVERGHSVVAGAADTRELYDHPGAEEHAGHAVREEQRRTALDLRRAETPLREGEPGSGTVRRGLELDDTGGEIAHDGAGKTVAERIRAATAGLLEKAGRVGERLRGMADDVWSYSTGERGAERARHGLEQAGAEFERAAAPVVERLNAIETHRQQERAVQHQKALELERSQWQHHGPSL

SEQ ID NO: 5723 - protein, 208 aa, Enterobacter cloacae
WRQFFSFCLRFVENPKMLKKLFFPLVALFMLAGCATPPTTIDVSPKITLPQQDPSLMGVTVSINGADQRQDQALAKVTRDNQQVTLTASRDLRFLLQEVLEKQMTSRGYMIGPSGAVDLQIIVNNLYADVSQGNVRYNIATKADIAIIATAKNGNKMNKNYRASYSVEGAFQASNKNIADAVNSVLTDTIADMAQDTSIHDFIKQNAR

SEQ ID NO: 5724 - protein, 123 aa, Enterobacter cloacae
LTRCFTGSVHKNMSSHYLRIFQQPKSAILLILGFASGLPLALTSGTLQAWMTVENIDLKTIGFFSLVGQAYVFKFLWSPVMDRYTPPFLGRRRGWLAMTQALLLLAIAAPVSLSCEQSGSPKG

SEQ ID NO: 5725 - protein, 79 aa, Enterobacter cloacae
RCRRSDFMMIREQIEEKLRAAFNPVFLEVVDESYRHNVPAGSESHFKVVLVSDRFTGERFLNRHRSICLHCRVPVRAML

SEQ ID NO: 5726 - protein, 254 aa, Enterobacter cloacae
  UNSURE (253)
TAPVHSGAVLTFLKTLRKRRYFEFYEASNMVPVVALVGRPNVGKSTLFNRLTRTRDALVADFPGLTRDRKYGRAEVEGREFICIDTGGIDGTEDGVETRMAEQSLLAIEEADVVLFMVDARAGLMPADSAIAKHLRSREKPTFLVANKTDGIDADQAIADFWSLGLGDIYPIAASHGRGVTSLLETVLLPWVDEVNPPEEVDEDAEYWAQFEAGEEGEEEPEDDFNPQDLPIKLAIVGRPNVGKSTLTNRIFXR

SEQ ID NO: 5727 - protein, 201 aa, Enterobacter cloacae
LFSRGCSYVVKTFGAAIVGGDNGRVSAVLMQQGQMIWQQRISQATGSTEIDRLSDVDTTPVIVDGVVYALAYNGNLTALDLRSGQIMWKRELGSVNDFIVDGNRIYMVDQNDRLLALSTEGGVTLWTQSDLLHRLLTAPALYNGSLVVGDSEGYMHWIDPENGRFVAQQKVDSSGFLTEPVVADGKLLIQAKDGTLYAITR

SEQ ID NO: 5728 - protein, 153 aa, Enterobacter cloacae
VIVTHHPSLLCLKNSRVQPPKSTAKTYNHTIKPSDFQMCRTDKFQLSVLNTIIFTIDAPIKTGLSINHLSIISGYSKWHLQKIFKHHFGMSLGTYIRRKRIEYAAHEIINKKCKIIDVVIDFNFSNQSSFCRTFKSIYGVSPKEFKSEHINHL

SEQ ID NO: 5729 - protein, 63 aa, Enterobacter cloacae
KGKWVSFREWRARVRFLNSLPLLRTEKTIQEISYLLGYSNTSSFIIMFEKLSGTTPEKYRKNI

SEQ ID NO: 5730 - protein, 119 aa, Enterobacter cloacae
SCLFLCFFCPFMLIIFNTMCVIIIATELEKRCIMKNVLSLSLLLFISSGYAASEVTYLNPTPQGAVRIGEVSFFKAGSATQSEVIGSLSKKADSLGGTHFEISSLNSSDNTYATAIVYK

SEQ ID NO: 5731 - protein, 71 aa, Enterobacter cloacae
TLGTVLFLCFSIGLAITMVAIGAVAAVSVEQASKRWDGLDVLARRAPYFSSALIALGGIYMGYHGWLGITN

SEQ ID NO: 5732 - protein, 103 aa, Enterobacter cloacae
PDFDLPNTTWQPTKLDLENILEPSPRRIWPDAYERLLLETIRGIQALFFHRDEVEEAWKWVDSITEAWAADQDAPKPYQAGTWGPVASVAMITRDGRSWNEFE

SEQ ID NO: 5733 - protein, 295 aa, Enterobacter cloacae
IRGAFMNPTLLRVTQRIVERSKETRAAYLARIEQAKSETVHRSQLACGNLAHGFAACQPGDKDALKSMLRNNIAIITSYNDMLSAHQPYEVYPSIIRNALHSVNAVGQVAGGVPAMCDGVTQGQDGMELSLLSREVIAMSAAVGLSHNMFDGALYLGVCDKIVPGLVMAALSFGHLPAIFVPSGPMASGLPNKEKVRIRQLYAEGKADRQALLEAEAASYHAPGTCTFYGTANTNQMVVEYMGMQLPGSSFIQPDAPLRKALTEAASRQVTRLTGNGNEWMPMGKMVDEKVIVKR

SEQ ID NO: 5734 - protein, 129 aa, Enterobacter cloacae
  UNSURE (15)
  UNSURE (94)
QNGRHMLTCYALNHXRTKTQLATAAGVKLQSIYNWKELVPETRAHRLETTFGRVLTFHKTIFEPHRKAQTTGKKNTSPPPRDSNLWKFQPTPSXAFCLAGAAELREGLSPEGNPAQITPPRGGPPSPGW

SEQ ID NO: 5735 - protein, 140 aa, Enterobacter cloacae
NCLTMKNMNSLGQRILARRKELKLTQREAAKLAGVAHVTISQWERDETQPVGARLFALAKALSCTPTWLMFGDDDQAPVPAEDIQLAPQLSDKHRELIDLYDSLPESEQEAQLEQLRARVKNFNKLFEELLKARQRQSKK

SEQ ID NO: 5736 - protein, 419 aa, Enterobacter cloacae
  UNSURE (15)
NGLGDSCPGLMEKGXWISGELFVPLPGYLFGYHLESGDIMKMKCNNRLLRLSASLTLISLVVTAANANNGQAGISPVAAMTMKESILFALDRDPSVSQQAAQLGIGQAQIDEARSGWMPQIALNGRTGHSQTTDSSGSLRNSAAWGLSLTQLVYDFGKTNNSISQSSAQRDSYRYQLMSTMSAVAEKTALSYVEVKRYSDLLQAAKENVQALKNVEQLAKLRADAGVSSTSDELQTRTRIAGMQATVEQYNASLNSARARLAVLTGIQAERYSPVPGGLAVEPDSLNRIDYSLIPTVMAAQNMERSAQYGVETAKSQHWPTLSLKGGRTRYESDNRAYWDDQIQLNIDAPLYQGGAVSARVRQAEGARAMASSQVDQARFDVLQKILRRTGRLDRGAWTNGSRETSAGKCVARPRCLQK

SEQ ID NO: 5737 - protein, 398 aa, Enterobacter cloacae
  UNSURE (386)
RSGGVTQQSKTSHWSTIMSISLKKSGMLKLGLSLVAMTVAASVQAKTLVYCSEGSPEGFNPQLFTSGTTYDASSVPIYNRLVEFKTGTTEVIPGLAEKWDISEDGKTYTFHLRQGVKWQDSKEFKPTRDFNADDVVFSFDRQKNAQNPYHKVSGGSYEYFEGMGLPDLIAEVKKVDDKTVQFVLTRPEAPFLADLAMDFASILSKEYADNMLKAGTPEKVDLNPIGTGPFQLLQYQKDSRILYKAFPGYWGTKPQIDRLVFSITPDASVRYAKLQKNECQVMPYPNPADIARMKQDKNINLLEQAGLNVGYLSFNTEKKPFDDVKVRQALTYAVNKETIIKAVYQGAGVAAKNLIPPTMWGYNNNLKDYTYDPEKTETVAEKNRPXTRLYRQPVCDAG

SEQ ID NO: 5738 - protein, 112 aa, Enterobacter cloacae
MAIADLDKQPDSVSSVLKVFGILQALGEEREIGITELSQRVMMSKSTVYRFLQTMKSLGYVAQEGESEKYSLTLKLFELGARALQNVDLIRSADIQMRELSRLTKETIHLGA

SEQ ID NO: 5739 - protein, 329 aa, Enterobacter cloacae
NSYSENNFTLSHSFPMQKNVSDGLPLPQRYGAIATIVIGISMAVLDGAIANVALPTIAKDLNASPASSIWIVNAYQIAIVISLLSLSFLGDMFGYRRVYQCGLVVFTLTSLFCALSDSLHTLTLARIAQGFGGAALMSVNTALIRLIYPHRHLGRGMGINSFIVAVSSAAGPTIAAAILSVASWQWLFAINVPLGIVAIFFALRYLPENGPKNTMPRFDLPSAVMNALTFGLLITALSGFAQGQSLSLIAAEIVAMLIIGFFFVRRQLALPVPLLPVDLLRIPLFSLSICTSICSFCAQMLALVALPFFLQSVTGRSVVSSPAVEVYLP

SEQ ID NO: 5740 - protein, 236 aa, Enterobacter cloacae
NDISSQPGSKMKILIVEDEIKTGEYLSKGLTEAGFVVDHADNGLTGYHLAMTAEYDLVILDIMLPDVNGWDIIRMLRTAGKGMPVLLLTALGTIEHRVKGLELGADDYLVKPFAFAELLARVRTLLRRGNTMITESQFKVADLSIDLVSRKVSRAGNRIVLTSKEFSLLEFFIRHQGEVLPRSLIASQVWDMNFDSDTNAIDVAVKRLRAKIDNDYETKLIQTVRGVGYMLEVPDA

SEQ ID NO: 5741 - protein, 113 aa, Enterobacter cloacae
SRQSGAWATCWRSRMHSKPSRRPFSLALRLTFFISLSTILAFIAFTWFMLHSVENHFAEQDVSDLQQISTTLNRILQSPVDPDDKKISKIKESIASYRNVALLLLNPRGGSAL

SEQ ID NO: 5742 - protein, 201 aa, Enterobacter cloacae
IILGCHGEMISGKTIISVIHYEPCLCKPFAEIFTCFNFVFDDQYFHLAPRLAANVILLRPRSLSTDYSKNDNIVIILSPGKQRALGKVPLSILWTSFEPFTRSAWTRSVMFKLKLLSISTIFILAGCVSLAPEYQRPAAPVPQQFSLSHNSLTPAVNGYQDTGWRNFFVDPQVTRLIGEALTNNRDLRMAALNVEEARAQF

SEQ ID NO: 5743 - protein, 432 aa, Enterobacter cloacae
FSFIVRVESAVSLSLWQQCLARLQDELPATEFSMWIRPLQAELSDNTLALYAPNRFVLDWVRDKYLNNINGLLNDFCGSDAPQLRFEVGTKPVTQTVREVVNVAAPAQAAPAPAPRVAPARQGWDNVPAPAEPTYRSNVNVKHTFDNFVEGKSNQLARAAARQVADNPGGAYNPLFLYGGTGLGKTHLLHAVGNGIMARKPNAKVVYMHSERFVQDMVKALQNNAIEEFKRYYRSVDALLIDDIQFFANKERSQEEFFHTFNALLEGNQQIILTSDRYPKEINGVEDRLKSRFGWGLTVAIEPPELETRVAILMKKADENDIRLPGEVAFFIAKRLRSNVRELEGALNRVIANANFTGRAITIDFVREALRDLLALQEKLVTIDNIQKTVAEYYKIKVADLLSKRRSRSVARPRQMAMALAKQLSNHSLPEI

SEQ ID NO: 5744 - protein, 95 aa, Enterobacter cloacae
FNKRGSGSSVVKIQMALTTLLRFEHETVMPPEMKFSKREREILKWTAEGKTSAEIAIILSISENTVNFHQKNMQKKFNAPNKIQIACYAAATGLI

SEQ ID NO: 5745 - protein, 154 aa, Enterobacter cloacae
TQLAVSSVIPILETFPLINVLLVDDHELVRAGIRRILEDIKGIKVAGEACCGEDAVKWCRANSADVVLMDMNMPGIGGLEATRKIARMFVDTLVIMLTVHTENPLPARVMQAGAAGYLIKSAAPQGSGQCDPPPYTPGQGYIPSEYAQQNGSES

SEQ ID NO: 5746 - protein, 74 aa, Enterobacter cloacae
MSTPEFATAENNQELAQEVNCLKSLLTLMLQAMGQADAGRVIIKMEKQIAQMEDQAESAVFANTVKQIKQAYRQ

SEQ ID NO: 5747 - protein, 121 aa, Enterobacter cloacae
HGSHAISLYSQHAFDPRQETLILTETVTTMSKAIMQQTYNFEALHDKGLAEHFLNAGKHLSGEVEVLGSAIRCIMLTGDNLSNKEIILQLIHALEITEEPEACDVIRNTLEIVVGFTRDDI

SEQ ID NO: 5748 - protein, 295 aa, Enterobacter cloacae
VVQIKPFIPHRKVGLDKLYLIRVWFSDARVFRDEVCAVKNNPQGFSDAEIDILQALHKREIFAAYQIITDGDKKGVGFEILLRWHKNGQVLKAAQFLGGVKNGEIWLKLTALVIHAAVSGINRYNGKYYFSVNIPPPLATGNALPGMAKKAVEMLLKPQWAGKLVFELAEAIDVTKDPNIPVTLQRLRAEGCRLFLDDCFSRDYAMLPIRQINVDGLKLDRDIVEHFVANDNDYSIIKAIQIYSDMTGRECVAEGVDSEEKFKKLVALGVKRFQGYYLSRAVKEEELDRMVRLFS

SEQ ID NO: 5749 - protein, 185 aa, Enterobacter cloacae
TNVIHATHAAQFAKIFGVKVDDFSPSLAAEISAMFEAIANGRNHSSVYEYPLLTEVQAGSFCPVNTYTERDAKEWVSTTVKASDSAFWLEVSGHSMTAPPGVKPSFPEGMLILIDPEQDVEPGDFCVAGIFNDSEVTFKKYVREDGKPWLEPLNPSPRYQAIECNENCRIIGKVVKAQWPENIFE

SEQ ID NO: 5750 - protein, 156 aa, Enterobacter cloacae
  UNSURE (133)
  UNSURE (135)
  UNSURE (156)
KSSGRRWLFGCCRAGAVRLFLCRCVAGFVLLGGPFPAAVPRLLLRVLLFRRCPRWSRLRLACAGFRVAVFVRRASFGFAFCSCPSVLSRFRWCVLWALRRLKRGMEQAQPLSTFLFNSLMPQVDLSTPVRRAXLXTLALPLISHVPGETLRIYLRX

SEQ ID NO: 5751 - protein, 109 aa, Enterobacter cloacae
FFLSALGGENLRVVDGFLDVVALALFVFFFAVASLGSSSSAVLFLLLFRVSFFVFCCFDGVRAGLVSAWRALVSALPFLSVGRPLVSLFVPARRCCPGFAGAFCGLCGV

SEQ ID NO: 5752 - protein, 64 aa, Enterobacter cloacae
GHRNSGHWCGTSSRSLLQIPGCLSMFALVDVNSFYASCETVFRPDLRGKPVVVLSNNDLSGEKC

SEQ ID NO: 5753 - protein, 85 aa, Enterobacter cloacae
SGDKMYISEIQIENFRLFDSAEKAFVLSLNPGLTALVGENDAGKTAVIDALRLVLGTRDQEMLRIDMLIMHHWGEAKSRTSPFRS

SEQ ID NO: 5754 - protein, 274 aa, Enterobacter cloacae
GYNMAFKFKTFAAVGALIGSLALVGCGQDEKDPNHIKVGVIVGAEQQVAEAAQKIAKEKYGLDVELVTFNDYVLPNEALSKGDIDANAFQHKPYLDQQIKDRGYKLVAVGNTFVYPIAGYSKKIKSLDELQPGSQVAVPNDPTNLGRSLLLLQKVGLIKLKEGVGLLPTVLDVTENPKNLKIVELEAPQLPRSLDDAQIALAVINTTYASQIGLTPAKDGIFVEDKDSPYVNLIVTREDNKDAENVKKFIQAYQSEEVYQEANKVFNGGAVKGW

SEQ ID NO: 5755 - protein, 310 aa, Enterobacter cloacae
NSRRGSSSPVVKTPVRGVASLKSNPDGASCLGPMAGLEKQREQYSHAVQALSDPDRTRLVLVARLQKSTLQEVARTHDELAAIGLKNQYLVINGVLPETEAVNDTLAAAIWGREQEALASLPAGLDALPTDTLFLQPVNMVGVSALRGLLTSQPETASFAEVSALQKPAISSLSALVDEIALNEHGLIMLMGKGGVGKTTMAAAIAVRLAEMGFDVHLTTSDPAAHLSTTLNGSLNNLQVSRIDPHDETERYRQHVLETKGRDLDEAGKHLLEEDLRSPCTEEIAVFQAFSRVIREAGKRFVVMHTSSPS

SEQ ID NO: 5756 - protein, 60 aa, Enterobacter cloacae
NRNTTSAEKVENVVKPPQKPVVIRTFHIGSMLVMRLNQASPIPIINAPIRFAASVPIGMA

SEQ ID NO: 5757 - protein, 314 aa, Enterobacter cloacae
CRGLNRMLKSHRATLPVPPPIKTAISSCNTVNTCYLLCKCVECNAVFDRETIMYVAVGQFAVTPDWNENAEKCVSLMHAAKQKGASLLVLPEALLARDDGDPDLSVKSAQTLEGAFLKRLLAESVGNTLTTILTVHIPSSPGRAVNTLVAIREGAIVASYAKLHLYDAFSVQESRLVDPGSVIPPLIEVEGFKVGLMTCYDIRFPELALNLALQGAEVLVLPAAWVKGPLKEHHWATLLAARALDTTCYVVAAGECGNKNIGQSRVVDPLGVTVVAAAETPALLLTEIISARIALARQQLPVLRNRRFAPPQLM

SEQ ID NO: 5758 - protein, 131 aa, Enterobacter cloacae
QVLTVLQLLIAVFIGGGTGSVARWLLSMRFNPLHQAIPMGTLAANLIGAFIIGMGLAWFNRMTNIDPMWKVLITTGFCGGLTTFSTFSAEVVFLFQEGRMGWALTNIAVNMLGSFAMTAIAFWLFSSASGH

SEQ ID NO: 5759 - protein, 151 aa, Enterobacter cloacae
LHMNILITTTAFTALFCGAAFAQSSDIAHEAHRFVNNASAVSHVNSSTHENLPDRVNKNNTPSFSEMNEHERAIVAHSFMNNSASYAHQKMIEEHKKMLSGSDANSKTSSSSFNELNAGEKAALVHEQVNNAGAEAHQTQARKLRGLYSTR

SEQ ID NO: 5760 - protein, 279 aa, Enterobacter cloacae
TPPCTLVLPAGWGRPIAGAGGRMGRQLIQAALQMDGVALGAALEREGSSLLGADAGELAGAGKTGVTVQSSLEAVKEDFDVFIDFTRPEGTLAHLAFCRQHGKGMVIGTTGFDDAGKQAIQDAATDIAIVFAANFSVGVNVMLKLLEKAAKVMGNYTDIEIVEAHHRYKVDAPSGTALAMGEAIAHALDRDLKECAVYTREGHTGERVPGTIGFATVRAGDIVGEHTAMFADIGERVEITHKASSRMTFANGAVRAALWLNAKEKGLFDMRDVLDLNNL

SEQ ID NO: 5761 - protein, 130 aa, Enterobacter cloacae
YANKVSEYSLEGVLIKSALLVLEDGTQFIGRAIGATGSAVGEVVFNTSMTGYQEILTDPSYSRQIVTLTYPHIGNVGTNAADEESSQVHAQGLVIRDLPLIASNFRNTEDLSSYLKRHNIVAIADIDTRK

SEQ ID NO: 5762 - protein, 423 aa, Enterobacter cloacae
  UNSURE (417)
CMEFSVKSGSPEKQRSACIVVGVFEPRRLSPIAEQLDKISDGYISALLRRGELEGKPGQTLLLHHVPNVLSERILLIGCGKERELDERQYKQVIQKTINTLNDTGSMEAVCFLTELHVKGRNTYWKVRQAVETAKESLYSFDQLKTTKSEPRRPLRKMVFNVPTRRELTSGERAIQHGLAIAAGIKAAKDLGNMPPNICNAAYLASQARQLADAYSKNVITRVIGEQQMKELGMHSYLAVGNGSQNESLMSVIEYKGNPSEDARPIVLVGKGLTFDSGGISIKPSEGMDEMKYDMCGAAAVYGVMRMVAELQLPINVIGVLAGCENMPGGRAYRPGDVLTTMSGQTVEVLNTDAEGRLVLCDVLTYVERFEPEAVIDVATLTGACVIALGHHITGLMSNHNPVPHGPIGAFVTTAVXGPQYWV

SEQ ID NO: 5763 - protein, 700 aa, Enterobacter cloacae
  UNSURE (86)
PPGAAFAASTTEDTVVVDGGFDNTQDLSASQDQDYSVKTTTTGTKLLLVPRDIPQSVSVISQQRMADQNLQSIGQVLTNTTGITAXVQDSDRTVFYSRGFFVSNYAYDDLPTSISEVWNFGDTAADTAIYDRIEVVRGATGLMSGTGNPAAYVNMVRKHADSPEFKGNVSASYGSWDKQRYVLDLQAPLVESGKVRGRLITGYQDNDSFVDNYHYRKKFLYGVMDADVTDSTTLSVGYEYQESHTADPTWGGLPTWYSDGSKNHYNRSQTVAPDWAYSDKDSTRIFANLTQRFDNGWEAHINGMHAETNFDSKLMYMSGYPDKETGAGLVGYGGWNRGERKQDAVDAFLRGGFDLFGRQHEMMFGGSFSRQRNHYDNSMPDAVYGMVDVGNFKNWNGNIADPQWTPWKLYSKDDIRQSSAYSSARFSLADPLHLILGARYTQYNIRYNPAGSPNTRLESTKDDVTPYAGLVYDINEDWSTYVSYTSIFQPQDNRDASGRYLDPTTGKSYQAGVKADWFNTRLNNSLAIFRIEHDNVASNTYTYLPSGESIYESLDGVVSKGVEFELNGALTDNWQLTFGATRYIAEDKNGNAVSSDQPRTTMKLFTRYQLPMLPELTVGGGVNWQNKVWTDVEGGPAGRSRAEQGSYGLVNLFSRYQVTKDFAVQANVNNLFDKEYYDYVGSYAVYGAPLNVSVSASYDF

SEQ ID NO: 5764 - protein, 163 aa, Enterobacter cloacae
  UNSURE (115)
WTLSMSNTLQPRRARASYSMDFKLALVEKSYQPGACVARLARDNGINDNLLFTWRQRYRHLLPDEIQRSIREQDSVIPVVLPDMALSHHAEPHYETAAPACREAMTCDVTVGGGXLRLSGGFITLHFLKTLIRAPDRGGSRMIPLTVRALRILAGLPGFPKNA

SEQ ID NO: 5765 - protein, 241 aa, Enterobacter cloacae
  UNSURE (183)
  UNSURE (217)
ISPPVNTLALGYAAFRFGRREADSKRTFGYLRFEVIAGFFNALTLFAIVAWIAYEAWERLQAPPAILAGPMLIVAIVGLLVNVLVLWIMTRGETDHVNVKGAILHVMGDLLGSVGAIVAAIVIYYTGWTPIDPILSVLVAALVLRSAWKLLAKSLHILLEGAPENASPDKVKQRLINSVQGLXAVSHIHVWQITSGRIMATLEVRAKEDVDVKDVVXLVKQELYEHFKNRTRNCGHRLELR

SEQ ID NO: 5766 - protein, 129 aa, Enterobacter cloacae
CTTNSGGRTIMSNTSDCGNVRNCSATDYGTEPDLSMLSQNEIGLLSEIFHLLGDQSRLRILLYCMRGSVSVGDIAESLQLSQSLVSHHLRLLRGARLVRGERKGKYIFYSIMDQHVSHVLQDMAFHIAE

SEQ ID NO: 5767 - protein, 94 aa, Enterobacter cloacae
KTVNVDWFIAERSGKVRILKEHPRKNKAAIILEYLKASIRAKVEHPFRVIIRQFGFIKARYKGLMKNDSQLAMLFTLANLFKVDQMIRRQTKSA

SEQ ID NO: 5768 - protein, 144 aa, Enterobacter cloacae
PATIVIVSLPDTYSSVREAIFVPFQRTGVNMQKIVIVANGAAYGSESIRNSLRQAIAQREKEREQEQRHKKKTDAVTAGGCRRGKNPQRATTINKSRRSRPRKTNRTNRAKPEPTGEAKPGSRRKKERKKERRRSRQKGRNPAG

SEQ ID NO: 5769 - protein, 169 aa, Enterobacter cloacae
MLGKQVAQCVPAGSTLFLDAGSTLLAVASFLQGPLTIITPSLDIAQQVSDREGIDLILLGGKWDQKQRLFAGSATLSLLSRYRADIAILGACAIHAELGLSASQEADAEVKRAMLAASQAHWVVADHLKLNQCEPYLVSGLSEIHQLFLDRPWAELGDHSAVQVTVCAH

SEQ ID NO: 5770 - protein, 380 aa, Enterobacter cloacae
IVPGQSSGTIAPCRLPFAHINVEKVMNKVKTMNIALIGYGFVGKTFHAPLIQSVDGLKLAVISSRDEEKVKRDLPDVLVVATPEEAIQHPDIDLVVIASPNATHAPLATLALNAGKHVVVDKPFTLDMQEARDLIALAEEKQLLLSVFHNRRWDSDFLGIKQVIAQGSIGKVKHFESHIDRFRPEVRVRWREQNVPGSGLWFDLGPHMIDQTLQLFGLPQSVQGNIATLRDGAEINDWAHVVLNYPEHKVVLHCSMLVAGGVSRFTIHGNKASVVKARIDQQEAQLLAGVIPGSESWGEDSDAMVLLNAQREASAIPAPKGDQRQYYINVRDALNGKIDNPVPPVEALAVMAVLESAVKSSETGTTHELDLTAHDRAQLQ

SEQ ID NO: 5771 - protein, 253 aa, Enterobacter cloacae
TVKPKSPRLFAISTPAALAKSKRKKERIMSTPANFNGARPVIDVNDAVMLLIDHQSGLFQTVGDMPMPELRARAAALAKIASLAKIPVITTASVPQGPNGPLIPEIHANAPHAQYVARKGEINAWDNPEFVAAVKATGRKTLIIAGTITSVCMAFPSISAVADGYKVFAVIDASGTYSKMAQEITLARVVQAGVVPMDTAAVASEIQRTWNREDAGEWAEVYTHIFPVYQLLIESYSKAQDVVKNSEVLDSQR

SEQ ID NO: 5772 - protein, 193 aa, Enterobacter cloacae
RAVDDGGPSHFARGVPLQRFSQKAGELKMMQLWFNLPAKDKWGTPGYQSITQADIPVVTLPDNSGTLRVIAGRFGEVTGPAHTFSPLNVWDLALHQGSHLTLNQPEGWSTALVVVEGSVTVNGTTPAGEAQLVVLSQSGDKLHLEASSDAKVLLMAGEPLNEPIVGYGPFVMNSKTEIAEAIRDFNSGRFGQI

SEQ ID NO: 5773 - protein, 123 aa, Enterobacter cloacae
SARVWRFVVKRLGPEQRAELVLNALVAIRFLKPQMPKSWHFLAHGMSWTPAIGDAASVNLSDTEEEVNLLVVEPGENAALCLLAQPGVNIAGRVMQLGDAIKVMNDRLKPQLRVDSFSLEQAV

SEQ ID NO: 5774 - protein, 323 aa, Enterobacter cloacae
TARQFPQMVRFTPSPLHDGLHLTAPDGSSVVIRFADFAPLDAPTEVWGNHFTARIAPDNINQWLSGFFSRDVQLRWVGPALTRRVKRHDAVPLSFADGFPFLLTSEASLRDLQKRCKASVQMEQFRPNLVVTGAEAWDEDTWKVIRIGSVIFDVVKPCSRCILTTISPEKGQKHPSGEPLKTLQSFRTAQDKGDVDFGQNLIPRSSGVIRVGDEIEILTRGPARVYGAGQEEEMVDVVTNVASAVDIHWEGKVIRGNNQQVLLEQLEQAGIRVPYSCRAGICGCCRIKLVDGEVSALKKSAIGGDGTILCCSCVPKTSVQLEA

SEQ ID NO: 5775 - protein, 263 aa, Enterobacter cloacae
NRGHRYSPVLAIVLLVRSLLYEPFQIRSGSMIPTLLIGDFILVEKFAYGIKDPIYQKTLIETGHPKRGDIVVFKYPEDPRLDYIKRAVGLPGDKVTYDPVAKEVTIQPGCSSGTACENALPVTYSNVEPSDFVQTFARRNGGEATSGFFQVPKGETKENGIRLVERKETLGDVTHRILTVPIAQDQLAMYYQQPGQQLATWIVPPGHYFMMGDNRDNSADSRYWGFVPEANLVGKATAIWMSFEKQEGEWPTGVRLNRIGGIH

SEQ ID NO: 5776 - protein, 177 aa, Enterobacter cloacae
TGCRRTGVKNAGAGMSIDKTYCGFIAIVGRPNVGKSTLLNNLLGQKISITSRKAQTTRHRIVGIHTEGAYQAIYVDTPGLHMEEKRAINRLMNKAASSSIGDLELVIFVVEGTRWTPDDEMVLNKLRDGKTPVILAVNKVDNVQEKADLLPHLQWLGSHMNFLDIVSLSADTGLNVD

SEQ ID NO: 5777 - protein, 266 aa, Enterobacter cloacae
NIPPKFKVGPARVPRHTKPRWFSQVGFVCCIFDAFIYWYRMNPIVINRLQRKLGYTFHHQELLQQALTHRSASSKHNERLEFLGDSILSFVIANALYHRFPRVDEGDMSRMRATLVRGNTLAEIAREFELGECLRLGPGELKSGGFRRESILADTVEALIGGVFLDSDIQTVEKLILNWYQTRLDEISPGDKQKDPKTRLQEYLQGRHLPLPSYLVVQVRGEAHDQEFTIHCQVSGLSEPVVGTGSSRRKAEQAAAEQALKMLELE

SEQ ID NO: 5778 - protein, 436 aa, Enterobacter cloacae
TGKYHMVDQVKVAAAEEATSEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVIVLLLSLNLATVKMFGEMEFWFAMIKIVAIIALIVVGLVMVLTHFQSPTGVQASFAHLWNDGGWFPKGISGFFAGFQIAVFAFVGIELVGTTAAETKDPEKSLPRAINSIPLRIIMFYVFALIVIMSVTPWSSVVPTKSPFVELFVLVGLPAAASLINFVVLTSAASSANSGVFSTSRMLFGLAQEGVAPSAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLV

SEQ ID NO: 5779 - protein, 211 aa, Enterobacter cloacae
EREDAVLPPAGEELEAQASYGIGLQVGQQLSESGLEGLLPEALVAGIADALEGKQPAVPVDVVHRALREIHERADAVRRARFEEMAAEGVKYLEENREREGVNSTESGLQFRVINQGDGAIPARTDHVRVHYTGKLIDGTVFDSSVARGEPAEFPVNGVIAGWIEALTLMPVGSKWELTIPHNLAYGERGAGASIPPFSTLVFEVELLEIL

SEQ ID NO: 5780 - protein, 399 aa, Enterobacter cloacae
DETRIYYRRSLCNMADDKLSGPDEKLFYQSRRLYRKCCNIYYIQVSMMVKKFKKLLLEFIVAVMLSLSIPGMAMAADAGVPGAMCQSAGVWQGLIKNICWSCIFPMRIMGIGAAPEGAAPSRPGCYCTDQNGVPEIGWQLSFFQPVKIVEVVKSPWCSPFLEGTMLQKSQFDIGKSNTNQPMTATEAGFYDVHLWEFPIMTMLKLLIIGECTAEPYIDASLTYISEVDPMWESDLLTLVLNPEAVVFANPIASMVCAADCVAVTAGKDNLAAYFCAGCDGNLYPLTGHMYANDDAVRTSSLITHRLLTKLHRQGMLMRTMGADAMCEKTWEYFTPRSQYRLSMLFPTPEAKGPDCCHRLGDSVHDWSTLKGGRKKIGNDNYVYMLWRYNDCCVRYIPGA

SEQ ID NO: 5781 - protein, 293 aa, Enterobacter cloacae
QIWSIYMAWNQPGNNGQDRDPWGSSNNQGGNSGGNGNKGGREQGPPDLDDIFRKLSKKLGGLGGGKGSGSGGNSTQSPRPPMGGRVVGIVAAAVVIIWAASGFYTIKEAERGVVTRFGKFSHLVEPGLNWKPTFIDDVTAVNVESVRELAASGVMLTSDENVVRVEMNVQYRVTDPERYLFSVTSADDSLRQATDSALRGVIGKYTMDRILTEGRTVIRSDTQRELEETIRPYNMGITLLDVNFQAARPPEEVKAAFDDAIAARENEQQYIREAEAYTKDVRLHLGRADPRRA

SEQ ID NO: 5782 - protein, 110 aa, Enterobacter cloacae
TKMDMLEDFEPRIDRDEENKPIRVWLYAQAGIGVPLLFQALTERLSGEVAQHTLRLPPQEGRLRSRFYQLQAIEKEWMEDDGSVGMQVRMPIVDWRRLCKQEPALADYIV

SEQ ID NO: 5783 - protein, 198 aa, Enterobacter cloacae
GHHHPVLGIVIKCPLSGETQQERIMMSLAGKKIVLGVSGGIAAYKTPDLVRRLRERGADVRVAITEGGKAFITPLSLQAVSGYPVSDSLLDPAAEAAMGHIELGKWADLVILAPATADLIARLATGMANDLVTTICLATPAPVAVVPAMNQQMYRNAATQHNLDTLASRGLLIWGTDSGSQACGEIGGRGFPQPINDC

SEQ ID NO: 5784 - protein, 68 aa, Enterobacter cloacae
  UNSURE (52)
FGERTAAAKPAGKLGAGVFLNPLTIVDMAAAHFSPVNDLQHLNIMNTAGPPXKPLGFRALHQQPKVRE

SEQ ID NO: 5785 - protein, 284 aa, Enterobacter cloacae
FFPVGFHQRAGILSQSLKRGDDVLNSLCEALRKNEMPASNPEFACGSIMANRRRPGMEETELLLPREKMLRHGVTLLKDDELLALFLRTGTPGKTVFTLAKELIDHFGSLYGLLTAELEAFTHVEGIGVAKYAQLRGIAELARRFYNVRMEEEDPILTPDMTREFLQSQLSDLEREIFMVIFLDNKNRVLKHTRLFSGTLSHVEVHPREIVREAIKVNAAGVILAHNHPSGCAEPSRADKAITERIIKCCQFMDIRVLDHLIIGRGEYICLHHRGSKEPRYACI

SEQ ID NO: 5786 - protein, 111 aa, Enterobacter cloacae
MNMLSFEGKEIETDNDGYLKESSQWSEALAEKIADNEGITLSPEHWEVVRFVREFYLEFNTSPAIRMLVKAMANKFGEEKGNSRYLYRLFPKGPAKQATKIAGLPKPVKCI

SEQ ID NO: 5787 - protein, 220 aa, Enterobacter cloacae
LMDRIITSSRDRTSLLSTHKVLRNTYFMLSLTLAFSAITATASTVLMLPSPGLILTLVGMYGLMFLTYKTADKPVGILSAFAFTGFLGYILGPILNAYLSAGMGDVIGMALGGTALVFFCCSAYVLTTRKDMSFLGGMLMAGIVIVLVGMLANIFLQLPALHLAISAVFILISSGAILYETSNIIHGGETNYIRATVSLYVSLYNIFVSLLSILGFGSRD

SEQ ID NO: 5788 - protein, 93 aa, Enterobacter cloacae
CQMFAPLPGSHGVGQGIGFRYSTQREALQLGLTGYARNMDDGSVEVVACGEADRVEKLVAWLKAGGPRSARVDKVLTEPHQPGREYADFSIRY

SEQ ID NO: 5789 - protein, 383 aa, Enterobacter cloacae
KILRYIPKAAKNYFRIVIKTDNKAKEMKPQTRTHFTLSLLTAGILCASTATWAANVPAGTQLADKQELVRNNGSEPASLDPHKVESDVEFNIISDLFDGLVSVSPAGEIQPRLAEKWENKDNTVWTFHLRPGITWSDGTPITAEDIVWSWQRLVDPKTASPYASYPGSMRIVNGTDIAEGKKAPESLGVKAINDTTLEVTLTQPNAAFLAMLAHPSLVPIDKVLVGRFGDKWTKPEHFVSSGAYKLSQWVVNERIVAVLNPKYWDNEHTVINKVTYLPISSEAADVNRYKAGEIDIVYTVPINQFAQLKKTLGSELDVSPQLATYYYEFNTTRPPFNDARVRKALNLALDKDIIADKVIRQGQRPAWLINQPDIGGVKLQNPG

SEQ ID NO: 5790 - protein, 315 aa, Enterobacter cloacae
KVLPGVSAHMKKMADEAGGLDRVSQMAVTGIGRVKAAMENDLNKAFTSSEKGFGQFNASVANMLNDASPIAEALGHILGKVASMTSGAVDHVDEWSRKLSALILRTSAWYDDLSDGQKKLVDSAEQFAIGAAGVLVLVKSIAGVANKLKWLSALLGGGAEAGAAAGAGGLLKGASRLAGPVGVALVAHDAVDASGVEQNYPNAVGTGNPIAQVLNWLTNPSKILGATEQDSLTNSPFTRMMGSLGDWLQGNNALSGQANTFAVPSMYNPAQTTIRNDQRINISVNMDSQKIGTFQTQVLTGGFEDLNINAEHLGD

SEQ ID NO: 5791 - protein, 184 aa, Enterobacter cloacae
TGQDRIYRLELFCREPTIFKHACCIINLSGLACADEHGCHRIVAQDPGQCHLRQLLPPFFRQRIQLTYLFQLFVGDLFRIKELTAACCARIRRDAVQIAIGQLSARQGREGDTSHPFLLQHVQQPLFRRTFKHGVLRLVDQTWRAQILHYFNRLPCHFCRVVGQTDVQRFALTHHMVKRFHGFT

SEQ ID NO: 5792 - protein, 348 aa, Enterobacter cloacae
CKRIHGCFFPAPEVSQMGYQPDKNRYQTMQYRRCGQSGLKLPAISLGLWHNFGDATLLENSRQLLQRAFNLGITHFDLANNYGPPPGSAERNFGRILQEDFLPWRDELIISTKAGYTMWDGPYGDWGSRKYLIASLDQSLKRMGLEYVDIFYHHRPDPHTPLRETMKALDHVVRQGKALYIGLSNYPAEMARQAIEIMEDLGTPCLIHQPKYSMFERAPEEGLLDVLQQKGVGCIPFSPLAGGQLTDRYLNGIPADSRAASGSKFLNPEQITDKKLEKVRKLNALAEKRRQKLSQMALAWILRHDAVTSVLIGASKTGQIDDAAGVLENCRFTAEELKTIDTILSSSD

SEQ ID NO: 5793 - protein, 463 aa, Enterobacter cloacae
GNKMQVSVETTQGLGRRVTITIAADSIETAVKSELVNVAKKVRIDGFRKGKVPMNVVAQRYGASVRQDVLGELMSRNFIDAIIKEKINPAGAPNYVPGEYKQGEDFTYSVEFEVYPEVELKGLESIEVEKPIVSVTDEDVDGMLDTLRKQQANWKEKEGAVDAEDRVTIDFTGSVDGEEFEGGKASDFVLAMGQGRMIPGFEDGIKGHKAGEEFTIDVTFPEEYHAENLKGKAAKFVINLKKVEERELPELTEEFIKRFGVEDGSVAGLRTEVRKNMERELNGAVRNRVKSQAIEGLVKANDIDVPAALIDSEIDVLRRQAAQRFGGNQQQAMELPRELFEEQAKRRVVVGLLLGEVIRTHELKADEERVKGLIEEMASAYEDPSEVIEFYGKNKELMDNMRNVALEEQAVEAVLAKAKVTEKETSFTELMNHQGVISPQRFKVLNKKPVGPPGDGVFFNHKL

SEQ ID NO: 5794 - protein, 363 aa, Enterobacter cloacae
GLHHAGDPGYRRAYCLIADLCHCYRNAGERHRRSGVCRAGHSPCDAHAMRAGPSSLDPADVSYRRPLYDPRRYRLTHADCAPGSAHRGGDCAGGRPRLCGVALSKPKGASMNITVAGLTVTRQAQTVLKNIDLDLPSGQIIGLLGPNGSGKSTLLRCLAGLFPRLSERVALNGTTFGMMPLKKRAQHMAFVPQHAEVDGELTVEDIVRLGRTPYRKTFQRTSRDDEAAVEQAIGLMQLCRLRQRRWHSLSGGERQRSQIARALAQQPQVLLLDEPTNHLDIQHQLELMRLVSQLPLTVVVALHDLNLAANYCQRLILLKAGQIAATGAPEAVLTPANIEDTWCVKAQVCKADAGITISYNMVA

SEQ ID NO: 5795 - protein, 185 aa, Enterobacter cloacae
LAGIAGAQLFNAMTAYVVGTSANAEQSRSVMFWLLGSLSGVRWPDALLALAVTLAGLLVVLLFSRALDTFTFGDEVSTTLGIPVTAVRIVLLLTCAIVTATLVSATGAVGFVGLVIPHVTRMLCGPGHRRSIPLTFLIGAHFMILADIVSRTLIVHQVLPIGVVTALVGAPVFVALLYQNRKEHP

SEQ ID NO: 5796 - protein, 133 aa, Enterobacter cloacae
KNLGVEAKLQNQEWKTMLDTMHTHNFDAVRYAWIADYDDAATFLNNFRTGDSQNTTQYSNPDYDRALVNAAKSKTAEERGKFYQQAEDLLGRDVPAIPVYHYVRTHLVKPWVGGFTPDKLGYYYTKDMYIKKH

SEQ ID NO: 5797 - protein, 191 aa, Enterobacter cloacae
  UNSURE (41)
  UNSURE (67)
  UNSURE (71)
  UNSURE (72)
LTYDKNNLMIKLSNITKVFQQGNRTIQALNNVSLHVPAGQXYGVIGASGAGKSTLIRCVNLLERPTXGQRXXWRPGAHRSLRKKNSPKRVAQIGMIFLHFNLLASRSVFGNVALPLELDFSPLEEISRRVSELLDLVGLGDKHDSYPANLSGGLYLRVSIARALANNPKVLLCDESSSALYPATTRSILEL

SEQ ID NO: 5798 - protein, 160 aa, Enterobacter cloacae
KDINRRLGLTILLITHEMDVVKRICDCVAVISNGELIEQDTVSEVFSHPKTPLAQQFIQSTLHLDIPEDYLERLKTEAVADSVPMLRMEFTGQSVDAPLLSETARRFNVNNNIISAQMDYAGGVKFGIMLTEMHGTQEETQAAIAWLQEHHVKVEVLGYV

SEQ ID NO: 5799 - protein, 205 aa, Enterobacter cloacae
  UNSURE (205)
RYWVMSEPMMWLLVRGVWETLAMTFVSGFFGFVIGLPVGVLLYVTRPGQIIENAKLYRTLSALVNIFRSIPFIILLVWMIPFTRVIVGTSIGLQAAIVPLTVGAAPFIARMVENALLEIPTGLIEASRAMGATPMQIVRKVLLPEALPGLVNAATITLITLVGYSAMGGAVGAGGLGQIGYQYGYIGYNATVMNTVLVLLVVLVX

SEQ ID NO: 5800 - protein, 209 aa, Enterobacter cloacae
ALYCAAIHEILAEQAFFRSKPVAKSVPAIFLDRDGTINVDHGYVHEIDEFEFIEGVIDAMRQLKEMGYALVVVTNQSGIARGKFTEAQFETLTEWMDWSLADRGVDLDGIYYCPHHPQGSVEAYRQTCDCRKPHPGMFISAQEFLHIDMAASYMVGDKLEDMQAATAAGVGTKVLVRTGKPVTPEAENAADWVITSLAELPKEIKKHQK

SEQ ID NO: 5801 - protein, 174 aa, Enterobacter cloacae
RRWKFSYYPLYCPIPLPRGHYGLNTSMSQTETTAPSKFSLLPGSITRFFLLLIVVLLVTMGVMIQSAVNTWLKDKSYQIVDITHAVHKRIDTWRYATWQIYDNIAAAPATSSGEGLQETRLKQDVYYLEKPQRKTEALIFGSHDSATLEIYQRISSYLDTLWGPENVTVVPCIT

SEQ ID NO: 5802 - protein, 142 aa, Enterobacter cloacae
LLIKDELFIQEIKMKQTRLVLAGILVLAPVFSAMAAPQAATGCEAKRQNIEQQIEHARTHNNDHRVAGLQKALSELNANCTEEGLRAERQADVREKERKVEERRQELAEAQADGRTDKISKKERKLKDAQAELDEARSVLNK

SEQ ID NO: 5803 - protein, 217 aa, Enterobacter cloacae
RTQPMAGFLLFCPRYALNFPFCQVIVIFFPDNENDMTLSALKAGSLLLLMILFYTGLFTSDRVTWLMEVTPVIIIIPLLLATHRRYPLTPLLYTLVFFHAIILMVGGMYTYAKVPVGFEVQEMLGLSRNPYDKLGHFFQGLVPALAAREILLRGGYVRGHKMTGFLVCCVALAISATFNSLSGGLLWRWDRVRMIFWGRRAIHGIPSLICFARCLVR

SEQ ID NO: 5804 - protein, 62 aa, Enterobacter cloacae
LIEWWAALAMGQGADDFLGTQGDPWDTQSDMFCALLGALTTVLILGRFHQRQLRRLNVDSAL

SEQ ID NO: 5805 - protein, 122 aa, Enterobacter cloacae
MCPPRLLKTCGAEIAISIPAHVRLVMVAEAPPALNEPLIEDVLRSLKVTHDQVLQLAPESVAMLPSDSRCNSWRIGAVDELPLEGSQISSPALDELKANPKARSALWQQICEYEHDFFPHDG

SEQ ID NO: 5806 - protein, 163 aa, Enterobacter cloacae
KPTQKRVARYGNKFANMNTISSLTTADLTTAFAIETRAHAFPWSEKTFASNQGERYLNLRLDVDGAMAAFAITQVVLDEATLFNIAVDPAYQRRGLGRELLEHLIHELETRDVFTLWLEVRASNVAAIALYESLGFNEATIRRNYYPTAEGREDAIIMALPIG

SEQ ID NO: 5807 - protein, 116 aa, Enterobacter cloacae
EELIMTLSPYLQEVAKRRTFAIISHPDAGKTTITEKVLLFGQAIQTAGTVKGRGSSQHAKSDWMEMEKQRGISITTSVMQFPYHDCLVNLLDTPGHEDFSEDTYRTLTGPEVFTSD

SEQ ID NO: 5808 - protein, 261 aa, Enterobacter cloacae
ASTRRLSAVTTTPPQRDVKTPLSWLCRLDNENKVVTMKWDWIFFDADETLFTFDSFGGLQRMFLDYSVTFTAEDFQDYQAVNKPLWVDYQNGAITALQLQHQRFDVWAERLNVSPGVLNEAFLNAMADICAPLPGAVSLLDSLKGKVKLGIITNGFTALQQIRLERTGLRDHFDALVISEEVGVPKPDPRIFDYALAQAGNPDRDRVLMVGDTAESDILGGMRSGLSTVWLNAHGRMLPEGIEPTWTVTSLNELEQLLCKQ

SEQ ID NO: 5809 - protein, 232 aa, Enterobacter cloacae
KPNDRLLKRSVFFMSRSLLTNETSELDLLDQRPFDQTDFDILKSYEAVVDGLAMLIGSHCEIVLHSLQDLKCSAIRIANGEHTGRKIGSPITDLALRMLHDMTGADSSVSKCYFTRAKSGVLMKSETIAIRNREHRVIGLLCINMNLDVPFSQIMSTFIPPETPDVGSSVNFASSVEDLVTQTLEFTIEEVNADRNVSNNAKNRQIVLNLYEKGILISKMPSTQWPDRLNIS

SEQ ID NO: 5810 - protein, 227 aa, Enterobacter cloacae
RPEIRYALGSFLGRYMENSLKEQEKLGIKLDKNQLIAGVQDAFADKSKLSDQEIEQTLQAFEARVKGAAQTKMEADAKDNEAKGKAYRDKFAKEKGVKTSSTGLIYKVEKEGTGDAPKDSDTVVVNYKGTLIDGKEFDNSYTRGEPLSFRLDGVIPGWTEGLKNIKKGGKIKLVIPPDLAYGKTGVPGIPANSTLVFDVELLDIKPAPKADAKTDAPADDKAAAAKK

SEQ ID NO: 5811 - protein, 443 aa, Enterobacter cloacae
TSPCNLSRSFGPLVKIATATDRLKAILIHGVNVVTLTDQKQYTSESLNSPMDLIMSILTAQRAHEESQSKSKRMREVWAKKRTEAEESGKIITKSCPRWLTVNSDRTGFEPIPEHVESIRLMFEMRLSGKGFAGIAQALNESGRLTLTGRSKGWNQSSVQQLLSNKALIGYKIPSRKAVVNYIEIPDYFPSVIPLEQFQQVQLIGADKQGQRAANDRPMNVNLFRGVMKCAECGATVIVSGVDDKRAGYYSCSFRRLGRCNTSKPMNRGMVDEALIKGLLYSLDRLTLQGQGENPLIKLEAKRADLTERSQKLLAALEIADDVTAIATRLKAVTDEIKAIETQIKTCKDLEQVHTVQSVQGMDLTVKSQREEVQLLVKKTFREINLDGIRKTVNVYLHNGLTLLNVPVNQIVDAGEWIELLPVIGGDTVDFKDISFKAPRYLD

SEQ ID NO: 5812 - protein, 222 aa, Enterobacter cloacae
GSTMYQHHNWQGALLDYPVSKVVCVGSNYAKHIQEMGSAVPEEPVLFIKPETALCDIRQPLVLPQGLGSVHHEVELAVLIGATLRQATEEHVEKAIAGYGVALDLTLRDVQGKMKKAGQPWEKAKGFDNSCPISGFIPVSEFTDDPQNTPLSLKVNGEIRQQGTTADMIHKIVPLIAYMSRFFTLKPGDVILTGTPEGVGPLLSGDELDVSFNGLSLKTRVL

SEQ ID NO: 5813 - protein, 133 aa, Enterobacter cloacae
HPGLTQFAINRNTSPRYSEEYQACYSQEYIEASNHPLIQSKNMFCVIYRSTSRDQTYLYVEKKDDFSRVPEELMKSFGRPQLAMLLPLDGRKKLVNADLEKVKKALTEQGYYLQLPPPPENLLKQHLEVSGKK

SEQ ID NO: 5814 - protein, 242 aa, Enterobacter cloacae
QGISMARIIVVTSGKGGVGKTTSSAAIATGLAQKGKKTVVIDFDIGLRNLDLIMGCERRVVYDFVNVIQGDATLNQALIKDKRTENLYILPASQTRDKDALTREGVEKVLDDLKKMEFDFVVCDSPAGIETGALMALYFADEAIITTNPEVSSVRDSDRILGILASKSRRAENGQEPIKEHLLLTRYNPGRVNKGDMLSMEDVLEILRIKLVGVIPEDQSVLRASNQGEPLILDTQAEAGKA

SEQ ID NO: 5815 - protein, 268 aa, Enterobacter cloacae
RVVACLNILLTITCLILFGISRRCVAVNSKLSKARMSNTPIELKGSSFTLSVVHLHDAKPEVIRQALEDKIAQAPAFLKHAPVVVNVSDLEGPVNWKRLQQAVTSTGLRIVGISGCKDAELKAEIERAGLPLLNEGKEKAPRATPATVPAPPPPAQNVAPVTKTRLIDLPVRSGQRIYAPNCDLIVTSHVSAGAELIADGNIHVYGMMRGRALAGASGDREAQIFCTHLTAELVSIAGEYWLSDKIPAEFYGKAARLQLADNALTVQP

SEQ ID NO: 5816 - protein, 615 aa, Enterobacter cloacae
FVQLINLLSIRSIRRWLNRSHGLMNRKIYNNVKIFMIVLALSLITIPFSRYISPRAIVNENDVYLAWLPLSAMLAIVLLFGRRAIIPLLIGFSVTNIYYFDLALLQSSVLLICQTFAVFAACGVIRLMLGKRWRHSIPNKYIGIRIFWLGFVVPVGIKLSMYLAGYLFDFPVTISSYFGEGSAIYNVIDIQSLICAALIFTMMFYYPLRMIINPRYARTFWRRSVKPLFCHKKVLFIVVWLMLLVSMIAILCAPFESQFIAGYLMPIVFILFTLGIGRLSYALISLLWAASALMLLTYNYNFLNGVESGHSLSFILSVLISFAICLLYMSRIYQKSEWLKQGWQERALTDPLTGLPNIRALEVFLQHHPEAKICCLRLDNLEFLSRHYGILMRVHCKKMITASLQPLLQKDEKLFQLPGSELVVVLLGPGTAERLQYMVDHLNSRKIVWNKTELDIEFGASWGEVPDGESLHHTLGQLSWLSEQSCGGHNVLALTNSLDDVSGQTTDRVLMLARIKRALDIGGLHLYAQPIHTARGERYFDIPSTLESDGEILHPDRLIPPMAQFNLNPRFDSNFWNKCGCRFATTPLELIESPPRQTDALNLKQHKMGAKFFAF

SEQ ID NO: 5817 - protein, 501 aa, Enterobacter cloacae
RAGFVENVAATAQTVEQLLKLGFTVAIESGAGTLASFDDEAFTQAGADVVDGAEVWQSPIILKVNAPEEGEIELLNAGTTLVSFVWPAQNPELMEKLAARGVTVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSEAFIKAEMALFAAQAKEVDIIVTTALIPGKPAPKLITREMVDSMQPGSVIVDLAAQNGGNCEYTVPNQVTTTANGVKVIGYTDLPGRLPTQSSQLYGTNLVNLLKLLCKEKDGNITVDFDDVVVRGVTVVREGEITWPAPPIQVSAQPQAAPKAAPEPAEPAKPASPWRKYAIMALVIILFGWLADVAPKEFLGHFTVFALSCVVGYYVVWNVSHALHTPLMSVTNAISGIIVVGALLQIGHGGWISFLSFIAVLIASINIFGGFTVTQRMLKMFRKG

SEQ ID NO: 5818 - protein, 192 aa, Enterobacter cloacae
  UNSURE (13)
  UNSURE (58)
  UNSURE (83)
QRGNLIWTWYGAXIFHTPVNEVAHGKWALLTSGSKSFHIPALTGAWGLFADDASRNAXLNALKGRDGLSSLSVLALTAHIAAXRQGEPWLDALRTYLEENLRYVARELNSAFPALSWQPPEATYLAWIDLSPLGIDDNTLQKVLIEQQKVAIMPGYTYGAEGKGYVRLNAGCPRSKLEQGVQRLIAGINTLL

SEQ ID NO: 5819 - protein, 337 aa, Enterobacter cloacae
PAKSATMIDTRLPLTDIHRHLDGNIRAQTILDLGRQFNLTLPAETLETLIPHVQVTSNEPDLVSFLSKLDWGVKMLASVDACRRVAFENIEDAARNGLHYVELRFSPGYMAMTHNLPVAGVVEAVIEGVREGCKTFDVQARLIGIMSRTFGEAACLQELEALLAHRDQITAIDLAGDELGFPGSLFLSHFNRARDAGWHITVHAGEAAGPESIWQAIRELGAERIGHGVKAIEDRALMDFLAEQRIGIESCLTSNIQTSTVASLAQHPLKTFLEHGVLASLNTDDPAVQGVDIIHEYNIAAPQAGLSREQIRQAQINGLEIAFLIFTTRAERSTLCV

SEQ ID NO: 5820 - protein, 132 aa, Enterobacter cloacae
  UNSURE (126)
RDQRAGNIPLSCMAGAHEFRQHGFHARQVGHLLAHVLELVFGQAAGLLAVGAIVEPQQLGNLVQTEPQPLCRFHEFHPNHVRLPIAADAAVRLVRFPQQALALIEADCLHVDPGRLGKNANGQVFXIIFHIA

SEQ ID NO: 5821 - protein, 98 aa, Enterobacter cloacae
GIADLARPASPCSDAINGQETFPFRAWQAHTSSDSTVSMRAKSAIFSRTSLSLCSARLLASSQWVPSSSRNSSAISSRLNPSRCADFTNFTRTTSASP

SEQ ID NO: 5822 - protein, 112 aa, Enterobacter cloacae
  UNSURE (14)
  UNSURE (72)
  UNSURE (73)
  UNSURE (74)
  UNSURE (75)
  UNSURE (76)
  UNSURE (77)
  UNSURE (78)
  UNSURE (79)
  UNSURE (80)
  UNSURE (81)
  UNSURE (82)
  UNSURE (83)
  UNSURE (84)
  UNSURE (85)
PRPPWQKRQWSGFXNYFPYRLTPYMSTEVRLRYPIQIQKGQRMSEPTKRRGALFARGLAGILASTCCLGALXXXXXXXXXXXXXXQRFLPLKPPFIGLKMFFGSQFLPAVKE

SEQ ID NO: 5823 - protein, 220 aa, Enterobacter cloacae
KEASEAENVVKKKKKKKKKKKKIIAPPGSRSMQECRPARGRRAHRAVLLVQTYVGPFEFGLDSVTLLPYSCTESSDMENNLENLTIGVFAKAAGVNVETIRFYQRKGLLREPDKPYGSIRRYGEADVVRVKFVKSAQRLGFSLDEIAELLRLDDGTHCEEASSLAEHKLKDVREKMADLARMETVLSELVCACHARKGNVSCPLIASLQGEAGLARSAMP

SEQ ID NO: 5824 - protein, 319 aa, Enterobacter cloacae
RKLAPALITGNTIVIKPSEFTPNNAIAFAKIVDEIGLPKGVFNLVLGRGETVGQELAGNPKVAMVSMTGSVGAGEKIMAAAAKNITKVGLELGGKAPAIVMGDADLELAVKAIVDSRVINTGQVCNCAERVYVQKGIYDRFVNRLGEAMKAVQFGNPAERTDIAMGPLINAAALERVEQKVARAVQEGAKVVLGGKAAEGKGYFYPPTLLLDVRQDMAIMHEETFGPVLPVVAFDTLEEALNMANDSDYGLTSSVYTQDLNVAMKAIKGLKFGETYINRENFEAMQGFHAGWRKSGIGGADGKHGLNEYLQTQVVYLQS

SEQ ID NO: 5825 - protein, 147 aa, Enterobacter cloacae
SGAPSMRGGSHFQERWLCWRDNGYLSGNNMRTKYTGLQISIHWLVFLLVIMAYCAMEFMGWFPRSDRPLINMIHVSCGISILVLMVARLLIRLKFPAPPIQPKPKAMITGLSHLGHLVIYLLFIALPLICMVMMYNRGNDWFAFWPD

SEQ ID NO: 5826 - protein, 67 aa, Enterobacter cloacae
CITGEMTGLRFGLTNPHAAEGNFDLVDTLKTWHVNLAILGNSLIGLHPLAPLNPPYFLEKTTPLLPH

SEQ ID NO: 5827 - protein, 115 aa, Enterobacter cloacae
IHNGLHGQLKIGIAHHDGRGFTAQLQPHFGDVFRSRSHDLFTCPDAAGHADHRHFRIPGQLLSDGFTPAQHQVKDAFRQANLIDDFGKRNGVVWGKFARFDNDGVAGDQRGSKLT

SEQ ID NO: 5828 - protein, 130 aa, Enterobacter cloacae
TRSAQLHTCPVLMTRESTMAFTASSRSASPITMAGALPPSSSPTLVMFFAAAAMIFSPAPTLPVMLTIATFGFPASSCPTVSPRPSTRLKTPFGRPISSTILANAMALFGVNSLGLITMVLPVISAGASL

SEQ ID NO: 5829 - protein, 244 aa, Enterobacter cloacae
CRTDSPGHSPWFVQCGVVNKSVSEAFDSKAFLKTVTSQPGVYRMYDAGGTVIYVGKAKDLKKRLSSYFRSNLASRKTEALVALIHNIDVTVTHTETEALLLEHNYIKLYQPRYNVLLRDDKSYPFIFLSGDTHPRLAMHRGAKHAKGEYFGPFPNGYAVRETLALLQKIFPVRQCENSVYRNRSRPCLQYQIGRCLGPCVEGLVSEEEYAQQVEYVRLFLAGKDDQVLTQLITRMEKASAALGI

SEQ ID NO: 5830 - protein, 79 aa, Enterobacter cloacae
QQTVTVIMRFNIPTLLTLFRVVLIPFFVLAFYLPVVWAPFACALIFLIAAVTDWFDGYLARRWNQSTRFGAFVLPHRPG

SEQ ID NO: 5831 - protein, 400 aa, Enterobacter cloacae
LLVWKKPARRWEFEEAARIRDQIQAVRRVTEKQFVSNTGDDLDVIGVAFDAGLACVHVLFIRQGKVLGSRSYFPKVPGGTELGEVVETFVGQFYLQGSQMRTLPSEILLDFTLDDKTLLADSLSELAGRRVNVQTKPRGDRARYLKLARTNAATALTTKLSQQSTVSQRLTALATLLKLPEVKRMECFDISHTMGEQTVASCVVFDANGPLRAEYRRYNITGITPGDDYAAMNQVLRRRYGKAIEESKIPDVILIDGGKGQLGQAKAVFESLDVEWDKNHPLLLGVAKGADRKAGLETLFFEPEGEGFSLPPDSPALHVIQHIRDESHDHAISGHRKKRAKVKNTSTLETIEGVGPKRRQMLLKYMGGLQGLLNASMEEIAKVPGISQGLAEKIYYSLKH

SEQ ID NO: 5832 - protein, 173 aa, Enterobacter cloacae
QRLCYQRETVRRRQRRGGRPDSVRLNGDCAPGWLWQQRDRTPVLIHFCTKKQGMRPVFFREDLMSTFILLAALASQITFSTSQQANMTTIIPQVTLADACECQVEVLSVRQGQGGQSTSRQKNTLFIPANQPIDLTRISLNIRSGDAVKIIVTVSDGKSLHLSQQWNAPVSAL

SEQ ID NO: 5833 - protein, 186 aa, Enterobacter cloacae
TCFGRHTLFRNAALTKRIALTEQEILFYSQVQGDSMKNKTLFMMFTLLGAPGFVIAGDSDLASSEYNFAINELSKASYNQAAIIGQQGSGNNSDVRQDGSKLLSVISQEGGNNRANVDQSGTYNLAYIDQTGNGNDASIKQGAFGNTAMIIQKGSGNRANITQYGTQKTAVVVQRQSQMAIRVIQR

SEQ ID NO: 5834 - protein, 158 aa, Enterobacter cloacae
SIRWGFTMKLFKVAVIAAIVVSGSAFAGAVPQFGGGHGGGWGGGNNGPDSTLSIYQYGGGNSALALQTDARDSELTITQHGGGNGADVGQGSDDSSIDLLQKGFGNSATIDQWNSKDSVINVKQFGGGNGAAVDQTASGSTVTVHQVGFGNNATAHQY

SEQ ID NO: 5835 - protein, 296 aa, Enterobacter cloacae
KNIMMRIALFLLTNLAVMVVFGLVLSLTGIQSSSVQGLLIMALLFGFGGSFISLLMSKWMALKSVGGEVIEQPRNDMEQWLMSTVAQQSKQAGIAMPQVAIYHAPDINAFATGARRDASLVAVSTGLLQNMSRDEAEAVIAHEISHIANGDMVTMTLIQGVVNTFVIFISRILAQIAAGFMGGNRDEGEESNGNPLIYFAVSMVLELVFGILASIITMWFSRHREFHADAGSAKLVGREKMIAALQRLKTSYEPQEANSMMAFCINGKSKSLSELFMSHPPLDKRIEALRSGEYLK

SEQ ID NO: 5836 - protein, 535 aa, Enterobacter cloacae
LDRSKAPWPKDEAELNVLWDGKVKYDELSLKLTGKDEKEIRETLNRRYKFDIRRLAQTNSEDVFSLAMTAFAHEIDPHTNYLSPRNTEQFNTEMSLSLEGIGAVLQMDDDYTVINSMVAGGPASKSKAISVGDRIVGVGQTGKSMVDVIGWRLDDVVALIKGPKGSKVRLEILPAGKGTKTRIVTLTRERIRLEDRAVKMSVKTVGKEKVGVLDIPGFYVGLTDDVKVQLQKLEKQNVSSVIIDLRSNGGGALTEAVSLSGLFIPSGPVVQVRDNNGKVREDADTDGVVYYKGPLVVLVDRFSASASEIFAAAMQDYGRALIVGEPTFGKGTVQQYRSLNRIYDQMLRPEWPALGSVQYTIQKFYRVNGGSTQRKGVTPDIMMPTGTEETETGEKFEDNALPWDSIDAATFVKSGDMKQFGPELLKNHNDRIGKDPEFQYIMKDIARFNALKAKRNIVSLNYAQREKENNEDDATRLARINDRFKREGKPLLKKLDDLPKDYQEPDPYLDETVHIALDLPKLEKNKPAVQPAPTK

SEQ ID NO: 5837 - protein, 309 aa, Enterobacter cloacae
  UNSURE (309)
LTFADSEFSTKRRQTRKEIFLSRMEQILPWQNMTAVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSSKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVKTLKQHPRKNKTAINIEYMKASIRAKVEHPFRIIKRQFGFVKARYKGLLQHDNLFTSRGGSASGX

SEQ ID NO: 5838 - protein, 92 aa, Enterobacter cloacae
SASWRGAICLSRCRLPRSATARGAGRGGCGLADRRASRQGKNLEAASAQEQNGHQHRIHESQHPCQGGAPVSHHQAAVRLRESQIQGAAATR

SEQ ID NO: 5839 - protein, 99 aa, Enterobacter cloacae
AVGQATLGIDTNVGLHAKVPLIAFLGLMHLRIALLLFVLARAGCLNDGGIHQSALGHHDACFGQPAIDGLEQLTGQLMLLEQVAEIHDGGAIRQGAIQG

SEQ ID NO: 5840 - protein, 115 aa, Enterobacter cloacae
SGKQAHGGDFVQGIFHGTVAQVVPMLHAVNTQHGLQRIGPSAIARLGIKRLDDSGHILPWQNLLHAGEENLFSGLTALSAEFTIGEGELMAHDVPLGCAPDEYDDLISGTCSHLP

SEQ ID NO: 5841 - protein, 519 aa, Enterobacter cloacae
VLPAACGENDSRRAEMLQQANALDERESFSSLRRLAWQNGHYFTLRTTFNQPGHLATVVAFDLPINDLIPPDMPLDSFRLEPDNSTQNMRSPSDKEGADSVAISFNGSKIEIASSLNSTGMRLVWQVPFGTLMLDTLQNILLPLLLNIGLLALALFGYSTFRFQSGRQSDSTSVSAGTSNELRILRALNEEIISVLPLGVLVHDQEANRTVMSNKIADHLLPHLNLQNITAMADQHQGVIQATINNELYEIRQFRSQVASRTQIFIIRDQDREVLVNKKLKQAQRLYEKNQHGRAAFMQNIGDAFKQPLKSLATQIADLSTPESRQLSSQADSLVRLVDEIQLANMLENDIWKGTPTLFSIQDLIDEVVPEVLPVIKRKGLQLLINNHLPANDERHGDRDALRRILMMLIQYAVTTTQIGKITLEVSTDESTDDRLTFRILDTGEGVTVSEIDNLHFPFLNDTQRDHYGKANALTFWLCDQLARKLGGHLNIKARESLGTRYSLHVKMVSSPRGWSIRP

SEQ ID NO: 5842 - protein, 137 aa, Enterobacter cloacae
SVRSNSMRHYEIVFMVHPDQSEQVPGMIERYSAAITGAEGTIHRLEDWGRRQLAYPINKLHKAHYVLMNVEAPQEVIDELETTFRFNDAVIRSMVMRTKHAVTEASPMVKAKDERRERRDDFANETADDSDAGDSEE

SEQ ID NO: 5843 - protein, 71 aa, Enterobacter cloacae
FLMTNRLVLSGTVCRTPLRKVSPSGIPHCQFVLEHRSVQEEAGFHRQAWCQMPVIISGHENQAITHSFNGR

SEQ ID NO: 5844 - protein, 132 aa, Enterobacter cloacae
TTSSEMVTHPNPGSDYTLIRNPEQRRRAFPRITARSRGAHIMKRIAIAILAALLLSANAMAAIRIDSQQARNMDDVQSLGVIYINHNFATESEADQALNEETDAHGAKYYHVMLTREPGSNGNMHASADIYQ

SEQ ID NO: 5845 - protein, 187 aa, Enterobacter cloacae
NRAFAECKHDGRFADDAGEKMIPVLAISAWSGTGKTSLLKKLIPALCAKGIRPGLIKHTHHNMDVDKPGKDSYELRKAGAAQTMVASNQRWALMTETPDEAPLDLAYLVSRMDHSTLDLVLVEGFKHEAVAKILLFRSDAGHDVSELTLDEHVIAVASDVALTLKVPVLDLNNVEGIAAFISAWCAV

SEQ ID NO: 5846 - protein, 242 aa, Enterobacter cloacae
FIRKGQGVTPTAYATILHEYISQGLESILGALDLTGSYDKQRTITIGTSPSVGVLVMPAIYQAVKQHAPQLLIRNVPVNDPETQLAQFQTDLIIDSNSFAARALGHNVLYTDSLALVCRQNHPVLSAPLTPENLRHYEHATFMSEGQGPDPLRQRIDELFPDRLISFSSYNMFTLAALIGSSDLLCIMPVRLFALLQKCWPLESIPLSQLTTESVEISLHYNKLSLRDPVLENVINVIRQAF

SEQ ID NO: 5847 - protein, 336 aa, Enterobacter cloacae
IETLSFDIRNWNTHAMSKPIVMERGVKYRDADKMALIPVKNVATEREALLRKPEWMKIKLPADSSRIQGIKAAMRKNGLHSVCEEASCPNLAECFNHGTATFMILGAICTRRCPFCDVAHGRPVAPDANEPQKLAQTIADMALRYVVITSVDRDDLRDGGAQHFADCITAIREKSPNIKIETLVPDFRGRMDRALDILTATPPDVFNHNLENVPRIYRQVRPGADYNWSLKLLERFKEAHPHIPTKSGLMVGLGETNAEIIEVMRDLRRHGVTMLTLGQYLQPSRHHLPVQRYVSPDEFDEMKAEAMAMGFTHAACGPFVRSSYHADMQAKGEEVK

SEQ ID NO: 5848 - protein, 186 aa, Enterobacter cloacae
RCICLVKIFFSASEKNMSDYIPKKRGLLILDWYVPLNILLLILVMCVFFTRYTFGYGLLNGCLPADFYMIDHSDKSIKTGELIPFNMPKSVRFIPQNERVIKIVAGVGGDKLKVTMDGVYNGDKFFETNARRISKKYNIPSILIEKELIIPEGEVFLIGQTDHSWDSRFWGTVKLNSVIGKTYAIF

SEQ ID NO: 5849 - protein, 270 aa, Enterobacter cloacae
CAVLSNTNASTEYQHDADLIAQQAKGLGAQAKGAQQPDGALSLDATLKSPDVQKYIAQAEALQKNQDLSKQINRGYVPGMNADSVQAVIDHTQAIRAQSNNSEAVNDIIRRRDEIQENASLNEAALKAVENKPEVMRGQAKNIEKLFGSSGITAADFERKMDSTREEALSTENGITIFASFSLPDYVLEDLLRTASEHKARVVFNGLKKGTTRLPETQAAINQMIVKGKFESPLITIDPDSFSQYQVTQVPTIISREQARFAKMGKLLQR

SEQ ID NO: 5850 - protein, 246 aa, Enterobacter cloacae
MNLRTKGFLLIIKDEGDTKEFTIENPGKYTLMVVFKDNRNNEQRIENTFVVDEQTPMNVEMTPKFSNKYMRAPLDVTLRSNIKISHSADSIDTVTYKVNGEVIPSGKNYWAQLISGLKEKKYEITIDVVSKLGQRGSASVEFDVVKNAVPNCTLSYTETNLSWSFTNKCDDTDGKMVRYEWFINGELRNVFGSTATLSKNLNRGKQDIKVIAYDDSGDFATQHVTVFGPAEEASKSENTVSIPSSE

SEQ ID NO: 5851 - protein, 138 aa, Enterobacter cloacae
VLDAQISVCACSSLIRCINTTPHMRGFFVPDSRVSCGCRVAVAHYPAYRIQYARIEPWSKLFIRPRMGEPWGIVLLDSAKESGSDGGGGRITQRFALRPSGRCMRQRFLDTLESNLGRSFSSFPALKNHGALCFERVL

SEQ ID NO: 5852 - protein, 111 aa, Enterobacter cloacae
FAVLIQPRICGVFLFPIPGYRADAGWRLRITRHTEFNMLESNLGRSFLSVPAWENHGALCFWIVLKNPEVMVVGEGLLSASRFALRVVACGNAFSIRSNRTLVEASHHSPH

SEQ ID NO: 5853 - protein, 173 aa, Enterobacter cloacae
FEEAEDHAGNSTEAKTIRDDRKYTKRERELPANRLNRKRARSQAKKDGNAKEQQQDQIETKIEQQAEEIENINSDQEKQSREIKEGHQGEENDEAKTTQAEQEEIGRKERKRQKETQRAKNIQERKARQPGGQQEQAREIKREIESQQPHNESLFQKVNYLSYINRRGRRTRA

SEQ ID NO: 5854 - protein, 269 aa, Enterobacter cloacae
PFCRDTVMQAEILLTLRLQQKLFADPRRIALLKQIEQTGSISQGAKNAGISYKSAWDAINDMNTLSEHTLVERATGGKGGGGAVLTRYGQRLIQLYDLLAQIQQKAFDVLSDDDNLPLDSLLGAISRFSLQTSARNQWFGTVTGRDHSQVQEHIEILLADGTTRLKAAITAQSGQRLGLNEGQEVLVLLKAPWISITLNPEQAAEADNQLRGRISHIERGAEQCEVLMTLPDGQLLCATVPVNDATELDEGAVVTAYFNADRVIIATLC

SEQ ID NO: 5855 - protein, 388 aa, Enterobacter cloacae
  UNSURE (329)
HMSSLHISQGTFRLSDTRTLSLPELTLRAGESWAFVGSNGSGKSALARALAGEITQLKGERRCTFTRLTRLSFEQLQKLVSDEWQRNNTDLLSPGEEDTGRTTAEIIQDEIKDPARCQQLAEQFGITALLNRRFKYLSTGETRKTLLCQALMSEPELLILDEPFDGLDVQSRAQLAALLASLNQQGYTLVLVLNRFDEIPDFVHYAGVLADCSLTEIGEKAVLLRQALIAQLAHSEKLDGIALPEPDAPSARHGLEPDQPRIVLRDGVVAYDDRPILNHLSWTVNPGEHWQIVGPNGAGKSTLLSLITGDHPQGYSNDLTLFARRRGHXDTIWDIKKHFRYVSSTLHLGLPGEQHRCKTLSSLASFDSIGYLSRRFPTNHHQLAPTLG

SEQ ID NO: 5856 - protein, 263 aa, Enterobacter cloacae
GKTMITLCKTCGTAYDEQPKNCPICDDERQYVPVTGQAWTDFDSLTTTHTNKWQQLEPQLFSIKTVPAFAINQRALLLRTPQGNVLWDCIANLDPATRALVDALGGISAIAISHPHYYTTMQEWAAAFNAPIYLHASDRQWVMRDSPAIRFWEEDALEIMPLVTLLRLGGHFAGGTVLHWQSGDGVLLAGDILQVTPGKDAVSFMWSYPNMLPLPARTVESLIGRLTGKTYQRLYGAFEGQNIPVNADEIVQRSGQKYIACLR

SEQ ID NO: 5857 - protein, 276 aa, Enterobacter cloacae
APPIRGGSRLFQARVKLLIPTPFGADTVLADTQFGSLTRPVQDEAMANWQEEGWKEAPLPVWNLLNYAVLQERRNGMALFTEGLREFEVTGERQKTFALTLLRGVGVLGKEDLLLRPGRPSGIKMPVPDSQMRGQLTCRFSLFSFNGTPVSAGVAQQAKSWLTPVHCYNKIPWDAMKLNRASFTTPCSYSLLTLAPNGCVLSALKKAEDRDEMILRLYNPSETRSCDVALSVNREIQACCETDMNEVYKAQGEEGSAITGSFRPGQSRTFSIKIER

SEQ ID NO: 5858 - protein, 67 aa, Enterobacter cloacae
GLILAGFINSPMVGQGLFLFNIPIGGHVSCGGFLKVPSYRPKPEDVEFDARRDLFFCHHWAFPLQSG

SEQ ID NO: 5859 - protein, 247 aa, Enterobacter cloacae
TRSIPLTFTGSLMRPIVVVLLILAAALTPILWRVERAAPDPVVQVDLLASREVRIATAISAGNGLSQAAIVFIPSYAFLALSLSESMASFSLLPFVTTMALSAPIVGVLLDRVGSRVVMISGSLILMVGCTIMALLSSTTPLFILAEVLMALGLITVIGAPLRYIMLSETPPEHRASGQALINILSSAGQLVGGALIGGIVASMGSGVMGYRFSFLFLVAVAFTLFLLSTGLKGRDVELETMKRDSC

SEQ ID NO: 5860 - protein, 249 aa, Enterobacter cloacae
FMFLSVITVAFRNYEGVVKTWRSLRNLARDPSLTFEWIVVDGGSNDGTAEFLEKLNGEFNLRYISEKDKGIYDAMNKGINMAQGRYAIFLNSGDVFHENVALFARQLARQKEDAMFIGDALLDFGEGKKVLRGAKPGWYIYHSLPASHQAIFFPMSGLKKQPYDLRYKVSSDYALAASLYKSGYPFRRIKGLVSEFSMGGVSTSNNLELCQDAKNVQRKILRVPGFWAELSYFLRLKTTGKAKALYNKA

SEQ ID NO: 5861 - protein, 117 aa, Enterobacter cloacae
GNVMQELNGFSVPKGFRGGSGIKVQLWWAVQATLFAWSPQILYRWRAFLLRLFGAKIGKNVVIRPSVKITYPWKLTLGDYAWVGDDAVLYTLGEITIGANSVVSQKCYLCTGSHDFM

SEQ ID NO: 5862 - protein, 75 aa, Enterobacter cloacae
IIYFSWFAVLLTLWYLFKVFKMMINAFGDNQNFRVQLYLFTPVSLFFTGSIFSPEYAFLIVCPFILRKALNITSV

SEQ ID NO: 5863 - protein, 123 aa, Enterobacter cloacae
TAADLLLQLSTSQRQGRYKTTLNRGVMAPKLLIIDEIGYLPFSQEEAKLFFQVIAKCYEKSAMILTSNLPFGQWDQTFAGDAALTSAMLDRILHHSHVVQIKGESYRLKQKRKAGVIAEANPE

SEQ ID NO: 5864 - protein, 708 aa, Enterobacter cloacae
TRNQMARTTPIARYRNIGISAHIDAGKTTTTERILFYTGVNHKIGEVHDGAATMDWMEQEQERGITITSAATTAFWSGMAKQYEPHRVNIIDTPGHVDFTIEVERSMRVLDGAVMVYCAVGGVQPQSETVWRQANKYKVPRIAFVNKMDRMGANFLKVVGQIKTRLGANPVPLQLAIGAEEGFTGVIDLVKMKAINWNETDAGVTFEYEDIPAEMQDLADEWHQNLIESAAEASEELMEKYLGGEELSEQEIKSALRQRVLNNEIILVTCGSAFKNKGVQAMLDAVVDYLPSPIDVPAINGILDDGKDTPAERHASDEEPFSALAFKIATDPFVGNLTFFRVYSGVVNSGDTILNSVKAARERFGRIVQMHANKREEIKEVRAGDIAAAIGLKDVTTGDTLCDPDHPIILERMEFPEPVISIAVEPKTKADQEKMGLALGRLAKEDPSFRVWTDEESNQTIIAGMGELHLDIIVDRMKREFNVEANVGKPQVAYREAIRAKVTDVEGKHAKQSGGRGQYGHVVIDMYPLEPGSNPKGYEFINDIKGGVIPGEYIPAVDKGIQEQLKAGPLAGYPVVDMGVRLHFGSYHDVDSSELAFKLAASIAFKEGFKKAKPVLLEPIMKVEVETPEENTGDVIGDLSRRRGMLRGQESEVTGVKIHAEVPLSEMFGYATQLRSLTKGRASYTMEFLKYDDAPNNVAQAVIEARGK

SEQ ID NO: 5865 - protein, 125 aa, Enterobacter cloacae
STGLKPKSRALSEGESTIVRNIAVSKEKFERTKPHVNVGTIGHVDHGKTTLTAAITTVLAQTYGGAARAFDQIDNAPEEKARGITINTSHVEYDTPTRHYAHVDCPGHADYVSLHPRALDGSTLR

SEQ ID NO: 5866 - protein, 234 aa, Enterobacter cloacae
CTTFGQRTQLSCISEHFRQRNFSVDLNASYFGFLTTQHTATTAQVTDNVTGVLFRSFYFNLHDRLKQNWFCFLKAFFKGNRRSQFKRQFRGVNVVVRTEVQTNTHVYNRVTSQRTSFQLLLDAFINGRDVFARNYTTFDVVDELVTFRVRARLQWVHVDHNVTVLTATTRLLSVFTFNVGNFRANRFAVSNLRFTHVRFNVEFTLHTVNDDVQVQFTHTSDDGLVRFFISPYTE

SEQ ID NO: 5867 - protein, 370 aa, Enterobacter cloacae
WVFFRQTAQSQTHFFLVSFGFWFNCDGDYRLREFHTLQNDRVIRITQSVTSGHVFQTDSSSDVARTNFFDLFTFVSVHLYDTAKTFTRRFHGVQDGVTGVNHTRVNAEEGQVTHEWVGSNFERQCREWLFITCVTLSRSIFTVVQDAVDRRNVNRGWQVVNYRIQHRLNTFVLERRTTGYQDDFVVQNALTQSRFDLLLRQFFTTQVFFHQLFRSFCCGFDQVLVPFVSQVLHLCRDIFVFEGNARICFVPVDGFHFHQVDNAGEAFFSTNCQLKRNRVRAQTGFDLANNFQEVSTHTVHFVNERDAWNFIFVCLTPYGFRLWLNTTNCAINHYRAVKNTHGTFYFDGEVNVPWGVDDVYAMRFVLLSHT

SEQ ID NO: 5868 - protein, 62 aa, Enterobacter cloacae
SGSHRVSPVVTSFRPIAAAMSPARTSLISSRLLACICTIRPKRSRAAFTEFRMVSPELTTPE

SEQ ID NO: 5869 - protein, 275 aa, Enterobacter cloacae
PHILDLFAPSLEPGHSKTMMAAFIVAIRGTVTQAVLLGLAATISHTSIVWLIALGGMYIRQKFTAESAEPWFQLISAIIILATAAWMFWRTWRGEKLWRMEQEDEHGHVNHPHDETRVIDTGHGSVELSIFEEGQPPHWRLRSLSGRKWEASDITLVTNRGTGTFSQVFNFVEKDGFMESAQPIPEPHNFEVCLSLGHRGHVHDYDVEFREHDHNHDHSALEGLDVSSLEYQDAHEKAHANDIKKRFANSSVTTGQIILSRPDGLHHADGKIKRS

SEQ ID NO: 5870 - protein, 148 aa, Enterobacter cloacae
VIFHQPLVACFDKTKLTFNNPKRVLHLCPDAGFQVFEFDGGFVFAGVLFQYPDFPWTFSDEPVHITVLQLIPFLCATITRIGGDKFFVTVQKIIQLVQVMFISGGGHQRMSKAAFSIDSNMSLHAKVPLISFFGLMHIGVTLFVFILG

SEQ ID NO: 5871 - protein, 328 aa, Enterobacter cloacae
GHMSQQLTFADSEFSSKRRLTRKEIFLSRMDTLLPWPQLLGNIEPVYPKAGNGRRPYSLETMFRIHCLQLWYSLGDEAMEDALYEIASMRQFALLSLDKAIPDRTTIMNFRHLLEKYKLTRKIFQTVNQWLLDCGVMMTQGTLVDATIIEAPSSTKNKNKQRDPDMHQTKKGNQWHFGMKAHIGVDAESGLTHTLVTTAANEHDLNQLNNLLHGDEEFVSADAGYRGAEKRDELKDRDVDWFIAERPGKVRILKKHPRKNKAAIKLEYLKASIRAKVEHPFRVIKRQFGFIKARYKGLMKNDSQLAMLFTLANLFKVDQMIRRQTKSA

SEQ ID NO: 5872 - protein, 343 aa, Enterobacter cloacae
RLPASGGIRMRKSVIAIIIIVLVVLYTSIFVVKEGERGIKFQFSSVVRDGDKRPVIYEPGLHFKIPFIQSVKTLDARIQTMDNQADRFVTKEKKDLIVDSYIKWRISDFSRYFLATGGGDVSQAEVLLKRKFSDRLRSEIGRLDVKDIVTDSRGRLTLEVRDALNSGSAGTEDEVETPAADDAIAKAAERVQAETNGKVPVINPNSMAALGIEVVDVRIKQINLPAEVSEAIYNRMRAEREAVARRHRSQGQEEAEKLRAAADYEVTKTLAESERQGRILRGEGDAEAAKLFADAFSQDPDFYAFIRSLRAYENSFKSNQDVMVLSPDSDFFRYMKTPTNATR

SEQ ID NO: 5873 - protein, 167 aa, Enterobacter cloacae
GGVDDFARCVKYIREGQAYTNEVQPRANGQAQRILEEARAYKTQTILEAQGEVARFAKILPEYKAAPEITRERLYIETMEKVLSHTRKVLVNDNKGGNLMVLPLDQMLKGGSAPAAKDNSGANNLLRLPPASSGSASANTTPSSNDGDIMDQRRANAQRNDYQRQGE

SEQ ID NO: 5874 - protein, 302 aa, Enterobacter cloacae
  UNSURE (252)
  UNSURE (255)
  UNSURE (256)
  UNSURE (257)
  UNSURE (258)
  UNSURE (259)
  UNSURE (260)
  UNSURE (261)
  UNSURE (262)
  UNSURE (263)
  UNSURE (264)
  UNSURE (265)
  UNSURE (266)
  UNSURE (267)
  UNSURE (296)
VRLRGSSLPLVKIMTDPAGASELVFGLFWLLGYQFSPRLADAGASVFWRMDHDADYGVLNDIARGQSDPRKIVLQWDEMIRTAGSLKLGKVQVSVLVRSLLKSERPSGLTQAIIEVGRINKTLYLLNYIDDEDYRRRILTQLNRGESRHAVARAICHGQKGEIRKRYTDGQEDQLGTLGLVTNAVVLWNTIYMQAALDHLRAQGETLNDENIARLSPLCHGHINMLGHYSFTLAELVTKGHLKPLKEASEAXNVXXXXXXXXXXXXXTNRPRHQVHAKMGGHPAGEKAPRAVLVVXTSVGPF

SEQ ID NO: 5875 - protein, 742 aa, Enterobacter cloacae
NPERKFPEGIQYSIAYDPTFFASASLKSVATTLLEATILVVLVVMLFLQTWRASIIPLVAVPISLVGTFALMDVFGFSLNTLSLFGLVLSIGIVVDDAIVVVENVERHIARGLSPKDAARKAMDEVTGPILAITSVLAAVFIPSAFLSGLQGEFYRQFALTIAISTILSAINSLTLSPALASVLLKPHQGTDKKDMLTRVLERLLGSFFGRFNTFFDRLSEKYVDTVRRIVRGSTIVLILYAGFLAMTFLGFKQVPGGFVPAQDKYYLVGIAQLPTGASLDRTEAVVKEMTRLALAQPGVESVVAFPGLSVNGPNMPNSALMFTMLKPFKDRQDPSLSAYAIAGSLMGKFSKIPDGFVGIFPPPPVPGLGSMGGFKLQIEDRAGLGFEELARVQGTIMAKAMQTPELAGMMASFETNSPQIQVDIDRVKAKSQGVALTDIFDTLQVNLGSLYVNDFNRFGRTYRVITQADAPFRMQAEDIGLLKVRNAAGEMIPLSALINIKLTSGPDRVMRYNGYPSADITGGTAPGYSSGQATDAIEKIVKESLPEGMAYEWTDLTYQEKLAGNSALYIFPLAVFFAFLILAAQYNSWSLPFAVLLIAPMALLSAIGGVWISNGDNNIFTQIGFVVLVGLAAKNAILIVEFARTQENEGLSPLEAVLEAAHLRLRPILMTSLAFIAGVIPLVLASGAGAEMRHAMGIAVFAGMLGVTFFGLLLTPVFYVVVRSFSIRRKVNSHQLLSEKR

SEQ ID NO: 5876 - protein, 92 aa, Enterobacter cloacae
  UNSURE (91)
LQQMNGKALDLTTVVSPKLKGTTTKQDTYMQFHLDNMTCGGCARTVTKVIQNLDPDASIVTDPPTRKVEIQTLLSVDLISDALREAGFPPXE

SEQ ID NO: 5877 - protein, 383 aa, Enterobacter cloacae
PPSVQGALAGGPSARFRGTGNRCGHCLRATFLPSPTRRFSAITAEYLVTAAGYHFEENRYAIGEGETIHRTDFSVIPASVSYRPAQSTAWPRTYGPQTAKVVGPQGESIWTDKYGRVKVKFHWDRLAKGDDTSSCWVRVSSAWAGQGYGGVQIPRVGDEVVVDFINGDPDRPIITGRVYNDASMPPWALPAAATQMGFMSRSKDGHKDNANALRFEDKAGQEQIWIHAEKNMDTEIENCETHDVGVDRKKIIGRDEHVTVKRNRDVNVGANSTSNTGNQHKFNVGKNQTVLTMDKEGNALLEATTSIKLKVNDNYILITPSTIEIIVSEGTLKAESITVASFKGTELTKLGGGINAEMKANDTLHLNGTNLTDIKGAVVKINS

SEQ ID NO: 5878 - protein, 363 aa, Enterobacter cloacae
YVEGFLNMGQPAARATIDVSAHSGPIQSGSPDVIIGGFPAARKGDTLSCSTHGSGIIVGGSGTVFVNGMPLARQGDKTKCDVSGSPAPAIPKAAAPQYWGGTLAKNAGEDGMMHGEHFDARVLGAYASLEDKNLNGDFDTASAGFALADITIGNMKSKDLLRAEMRNKLAVANATGSLYGGGNDIYGLNANAAATGEQYGGSVAAGKEGTLYGGVSGDVTIGTAEAKAVLEVYTGNDGKYGLTADAGAEAKGMKGEVSGNLDILGIVSGEAKIDGSFGSAGLAGGGSAFWDTKDYSVNVRVTGGAAGLVWLKGDASLKVAFKPILDFFDYLYGEEDEPAVTSVLTESGDGTIITGCVTVLIGD

SEQ ID NO: 5879 - protein, 129 aa, Enterobacter cloacae
KRDTIYSTQEILMSPFSTLQLFKNLSDETRLGIVLMLKEMGELCVCDLCTALEQSQPKISRHLAMLRESGLLLDRKNGKWVHYRLSPHIPSWAAQVIEQAWLSQQDDVQAIARKLASANCSGSGKAVCI

SEQ ID NO: 5880 - protein, 131 aa, Enterobacter cloacae
HLKAAAVVILLVAEMSGGHMKFLQNIPPYLFFTGKGGVGKTSISCATAISLAEQGKRVLLVSTDPASNVGQVFSQTIGNTILPVASVPGLSALEIDPQAAAQEYRARIVDPIKGILPESSPRGWQDPSLAK

SEQ ID NO: 5881 - protein, 111 aa, Enterobacter cloacae
AFIRRTIMENIALIGIDLGKNSFHIHCQDRRGKAVYRKKFTRPKLIEFLATCPATTIAMEACGGSHFMARKLEELGHFPKLISPQFVRPFVKSNKNEFVDAVFTNGAGSTI

SEQ ID NO: 5882 - protein, 317 aa, Enterobacter cloacae
FMNIKRLVLSALVVGTSSYLTGCSIGSSESECPGIEKGVICKGPREVMELTNNRDDLSALAGEESESGKEKSAVNDSRYPTEISPPGEVKYPQSTTLKNQPVAYSKTEIKPVGQLPVMYDKTLKMGAPTSSIGPRPISGVPVNSNVRMTISYSTASSTGNPFVHPAAEVVKQTSYPVSAGNAPRYVAPNSDISPGKDMYSLYNGQPVNPTLNPGQIQQYRSQGYKQAVVAPEPLAVLQQGKVMRITFAPYTDDNDALNLPGYVYVNVKPQTWIAGKNSTSNPARIVPLEVQDAARENMQQQQKATKAVSSNGIVRQL

SEQ ID NO: 5883 - protein, 590 aa, Enterobacter cloacae
TPRKNSRWAEGFIDVNTMKRLNEQVNVPGRKYTVTENHFSSVTQSDDESEHRYFKQLSVVKFPEYVNFGCMYELVVNWMHGRKTIFSPFMITQTVQFADPLKLSKENVRYKAITNKQASIPSVVTFCPRLRDMDNDYMAVTRELEDGAKLLRGYLTFTVMGSNANSVQTAANDLKSFYLESRVKVADDSFIVFPSFMSCLPMCNDPKTIFDLDRSEVVSNTGAAHMTPIFGPWKGNTDRPVLSLVSREGQLMGLDIFKTSASYNMVIGATSGAGKSFWTAYLINNYLGAGPRSNNLVHYRSTFKHFLENEYPDDDPDGAQVFVVDVGRSYQGIAEQYTNSQFIDFGKTPDFTLNPFAFLTDITVNDDVFNEAPEFTGESTSNDAEKDKVAQTIMVLNQLKIMASEKGLIDDYQQSVMLQLIAEEYQESRKSGRTGSITGFALRCKKHEDKRIKDIGEQLGAWCEGGIYGHRFTDTLPPINFDSRFIVLELEELKGTPHLQTVVLMSIIQAAQHAMFIKKDGRRRLFILDEAWEYIRPDNSSGAGNQSNQFFSSFLEAAWRMFRITNCAGICITHSFEKLFTSSVGPAPEC

SEQ ID NO: 5884 - protein, 515 aa, Enterobacter cloacae
SYTHSGGPSGPVVKTQSSGEYLLEMTGVNKSFPGVKALDNVNLKVRPHSIHALMGENGAGKSTLLKCLFGIYQKDSGSILFQGKEIDFHSAKEALENGISMVHQELNLVLQRSVMDNMWLGRYPTKGVFVDQDKMYRDTKAIFDELDIDIDPRARVGTLSVSQMQMIEIAKAFSYDAKIVIMDEPTSSLTEKEVNHLFTIIRKLKDRGCGIVYISHKMEEIFQLCDEITILRDGQWIATQPLEGLDMDKIIAMMVGRSLNQRFPDKENKPGEVILEVRNLTSLRQPSIRDVSFDLHKGEILGIAGLVGAKRTDIVETLFGIREKAEGTITLHGKKINNHNANEAINNGFALVTEERRSTGIYAYLDINFNSLISNIRNYKNKVGLLDNSRMKSDTQWVIDSMRVKTPGHRTQIGSLSGGNQQKVIIGRWLLTQPEILMLDEPTRGIDVGAKFEIYQLIAELAKKDKGIIIISSEMPELLGITDRILVMSNGLVAGIVETKTTTQNEILRLASLHL

SEQ ID NO: 5885 - protein, 341 aa, Enterobacter cloacae
DQGLLMSALNKKSFLTYLKEGGIYVVLLVLLAIIIFQDPTFLSLLNLSNILTQSSVRIIIALGVAGLIVTQGTDLSAGRQVGLAAVIAATLLQSMENANKVFPEMATMPIFVVILIVCAIGAVIGLINGIIIAYLNVTPFITTLGTMIIVYGINSLYYDFVGASPISGFDSGFSTFTQGFVALGSFRLSYITFYALIAVAFVWILWNKTRFGKNIFAIGGNPEAAKVSGVNVALNLLMIYALSGVFYAFGGMLEAGRIGSATNNLGFMYELDAIAACVVGGVSFSGGVGTVLGVVTGVIIFTVINYGLTYIGVNPYWQYIIKGAIIIFAVALDSLKYARKK

SEQ ID NO: 5886 - protein, 292 aa, Enterobacter cloacae
LLLIKTRSQTMSKVKTITRESWILSTFPEWGSWLNEEIEQEQVAPGTFAMWWLGCTGIWLKSEGGANICVDFWCGTGKQSHGNPLMKKGHQMQRMAGVEKLQPNLRTTPFVLDPFAIRQIDAVLSTHDHNDHIDVNVAAAVMQNCADDVPFIGPQTCVDLWIGWGVPKERCIVMKPGDVVKIKDIEIHALDAFDRTALITLPADQKAAGVLPDGMDERAVNYLFKTPGGSLYHSGDSHYSNYYAKHGNEHQIDVALGSYGENPRGITDKMTSADMLRMAEALKTQMVNPVQQ

SEQ ID NO: 5887 - protein, 268 aa, Enterobacter cloacae
HQPHRDCPLCSHFLERVMEILYNVFTVFFNQVMTNAPLLLGIVTCLGYILLRKSVSVIIKGTIKTIIGFMLLQAGSGILTSTFKPVVAKMSEVYGINGAISDTYASMMATIDRMGDAYSWVGYAVLLALALNIIYVLLRRITGIRTIMLTGHIMFQQAGLIAVSLYIFGYPMWTTVICTAVLVSLYWGITSNMMYKPTQDVTDGCGFSIGHQQQFASWIAYKVAPYLGKKEESVEDLKLPGWLNIFHDNIVSTAIVMTIFFGAMSSHT

SEQ ID NO: 5888 - protein, 130 aa, Enterobacter cloacae
  UNSURE (130)
TRRSSLPRGHDMRGDCRRCQPASVRGFITCTSENADPRADREEPMIPLPSGTRIWLVAGVTDMRKSFNGLGELVQHVLDDNPFSGHLFIFRGRKGDTVRILWADADGLCLFTRPLEEGLSTRRDGREKVX

SEQ ID NO: 5889 - protein, 139 aa, Enterobacter cloacae
WTLSMSNTLQPRRARASYSMDFKLALVEKSYQPGACVARLARDNGINDNLLFTWRQRYRHLLPDEIQRSIREQDSVIPVVLPDMALSHHAEPHYEPAAPACREAMTCEVTVGGASLRLSGDLSPALLKTLIRELTGRSR

SEQ ID NO: 5890 - protein, 211 aa, Enterobacter cloacae
SGAVMMNKLQERYARIIAIMNNKGGPGKTSSATNLAVHYARSGKRTLLIDSDQQANTTEVTANGKKYYSMYGPTICDLYSNSRFDIRDVIIPAMAGDAPIPNLDLIPSDPTFEKIIEQTLTRSHREKILGRHLEKVRTEYDYIIIDCAPGLNIATGNAIFIADHVLVPVDGGSFSLSGLEIMLDYMDEISEEDYARFSVFTTERDGSALEY

SEQ ID NO: 5891 - protein, 403 aa, Enterobacter cloacae
  UNSURE (28)
TCFILGANMDRVSHFVLALVVVTALALXVSTDRKKIRMRYVVQLLVIEVLLAWFFLNSNVGLGFVKGFSEMFEKLLGFANEGTNFVFGSMNDQGLAFFFLKVLCPIVFISALIGILQHIRVLPVVIRAIGFLLSKVNGMGKLESFNAVSSLILGQSENFIAYKDILGKMSRNRMYTMAATAMSTVSMSIVGAYMTMLEPKYVVAALVLNMFSTFIVLSLINPYRVDASEENIQMSNLHEGQSFFEMLGEYILAGFKVAIIVAAMLIGFIALIAALNALFAAVLGISFQGILGYIFYPVAWVMGVPAHEALQVGSIMATKLVSNEFVAMMDLQKIASTLSPRAEGILSVFLVSFANFSSIGIIAGAIKGLNEEQGNVVSRFGLKLVYGSTLVSVLSASIAALVL

SEQ ID NO: 5892 - protein, 216 aa, Enterobacter cloacae
NLEIPIPGWKSDWRDHPPLTVLFPVIGHLNLSNRLNLKLLEKLLMWMRSNRSGRAGTRFSVNLMPLTLMQNEIAAEIIALFERYAIAPQNIIIEITEEQAFSDSGSSIKNIQQLRDYGFRIAIDDFGTGYANFERLKRLEADIIKIDGCFVKDICTDSMDAMIVQSICNMAKTKSLCVVAEYVETAEQREMLLRFGVDYLQGYLIGKPQPLTALEA

SEQ ID NO: 5893 - protein, 290 aa, Enterobacter cloacae
YMDQAGIIRDLLTWLEGHLDQPLSLDNVAAKAGYSKWHLQRMFKDVTGHAIGAYIRARRLSKSAVALRLTARPILDIALQYRFDSQQTFTRAFKKQFSLTPALYRRSPDWSSFGMRPPLRLGEFAMPKYEIITLPETHLVGTTQSYSCSLEQISEFRHQMRVQFWREFLSHAPAIPPILYGLNETHPSQEKDDEQEVFYTTALTPDMANGYIHGSKPVVLEGGEYVMFSYEGLGTGVQEFILTVYGTCMPMLNLNRRKGQDIERYYPAQDAKPEEGPINLRMEFLIPVRR

SEQ ID NO: 5894 - protein, 66 aa, Enterobacter cloacae
LMESEARRFIALVDEFYERHVKLVVSAEVPLYEIYQGERLKSEFQRCLSRLQEMQSEEYLKREHMP

SEQ ID NO: 5895 - protein, 143 aa, Enterobacter cloacae
GPPTRPVKRPKLDEDEIGQRLLSIPCVGTLTASTISTEIGDGKQYASSRDFAAATGLVPRQYSTGGRTTLLGISKRGNKKIRTLLVQCARVFIQKLEHQSGKLADWVRDLLCRKSNFVVTCALANKLARIAWALTARQQTYVA

SEQ ID NO: 5896 - protein, 293 aa, Enterobacter cloacae
KGLLVMQEQEIWTPQKAAIRLTKICDTFSEIHGTERFPVNVEELSLEAAELFKWADPIVKIEPVDIKGFDGALMANESRSRWMLLYNNGLTSPGRIRFTQAHELGHYILHRLIRDEFRCSSDDMLSWEDKNIESEADLFASYLLMPFNDFRKQLTPDVDIDVLSQYAIRYGVSLTAAALKWLECTEENAVFILSRDGYMKWAFSSPAARHNGAFFRTQRNVVSIPEGSIAANQNISMERAGMKIPASIWFPHADKDASVREMKIHSEQYEYVITLLILSRKTTVWPPFHGEDE

SEQ ID NO: 5897 - protein, 97 aa, Enterobacter cloacae
CLHKPHEDIPMKKRFSDEQIISILREAEAGVPARELCRKHAISDATFYIWRKKYGGMEVPEVKRLKSLEEENARLKKLLAEAMLDKEALQVALGRKY

SEQ ID NO: 5898 - protein, 62 aa, Enterobacter cloacae
RGASGGSWAKVLTTDQKRETVMLMCDANGLSQRRACRLTGFILSTCRYEAQRPAADAHLSGR

SEQ ID NO: 5899 - protein, 170 aa, Enterobacter cloacae
NLNFCHISLTVLSAMNITELVFIDDDYNHVVIMSDVVQRLHLYRQLHYASTEAGGTLIGERRGKHIVITHISEPGSGDVRSRTRIERKGEHHQQKVDDLFQQSDGSLVYLGEWHTHPEDFPQPSSTDMRSWRTGLKATEPMVLLIMGRKQAWCGKKHGNVIKKLEEKNNH

SEQ ID NO: 5900 - protein, 373 aa, Enterobacter cloacae
IMVCHMTPPVALFKGCVMQDLHSKDSVINHYADRYQCYMPIDVRNGLRSNSIDASNSSLPWDVTLPLVTTEDVSRDKALGAFVGLAVGDAVGTTLEFKKRDSEHVADMIGGGPFQLKPGEWTDDTSMALCLAETYLSENRMHTDVLRKYLLKWYLDGENSSNGRCFDIGNTTRFALEQYMRVGPSWYGNTEKHTAGNAGVIRQAPVSIFRRKSLRAIYFESQAQSRATHGAVESINACQFLGLVLHYLINGYQKEGAFSPHVFPLCARVMIINAGEYKQKTRDQIRSSGYVIDTLEAAMWSVWNTDNFRDAILLAANLADDADSVAATAGQIAGALYGYSAIPQDWKDKLVQHERIATMAGKLFDRAPEDNFL

SEQ ID NO: 5901 - protein, 82 aa, Enterobacter cloacae
FDTSQVRMRTMKKWAVIISAVGLAFAVSGCSSDYVMSTKDGRMILTDGKPEVDDDTGLVSYRDREGNQMQINRDEVSQIIER

SEQ ID NO: 5902 - protein, 152 aa, Enterobacter cloacae
KRKPAMHYHRIPHSALEISQLGLGTMTFGEQNSEADAHAQLDYAVSQGINLIDVAEMYPVPPRPETQGLTETYVGNWLAKRGNREKLVIASKVSGPSRNNDAGIRPNQILDRKNIRAALDASLKRLQTDYLDLYHVHWPQRPTNCFGKLGYT

SEQ ID NO: 5903 - protein, 107 aa, Enterobacter cloacae
NESAPAVTLLETLETLTECQRAGKIRYIGVSNETAFGVMRYLHLADKHDLPRIVTIQNPYSLLKRSYEVGLAEVTQYEEVELLPQLLSGLRYPDGQIPERRETGWRA

SEQ ID NO: 5904 - protein, 242 aa, Enterobacter cloacae
NISSFFNQKVVSMHSLAPLLSPPVSEAQLLQQAQRLAGYSLGELAVMAGLTIPNDLKRDKGWIGVLLERWLGASAGSKPEQDFAALGVELKTIPIDSQGRPLETTFVCVAPLTGNSGVTWETSHVRHKLKRVLWVPVEGDRQIPLAERRVGAPLLWSPNDEEERLLSQDWEELMDMIVLGQVERITARHGEMLQLRPKAANSKALTEAVCAQGEPILTLPRGFYLKKNFTGALLARHFLLKT

SEQ ID NO: 5905 - protein, 124 aa, Enterobacter cloacae
RSTKRWSCSPNSCLGFGTLTGKYLNGAKPAGARNTLFSRFTRYSGEQTQKAVAAYVDIAKRHGLDPAQMALAFVRRQPFVASTLLGATTMDQLKTNIESFNLNLSEEVLAEIEAVHQVYTYPAP

SEQ ID NO: 5906 - protein, 117 aa, Enterobacter cloacae
TVARCMPAGIVIGVGVLFFSLQHALLPAYALLLLIGMLGGFFVVPLNALLQERGKQTVGAGNAIAVQNLGENMAMLLMLGIYSLAVKAGAPVVAIGVGFGALFALAISGLWVWQRRR

SEQ ID NO: 5907 - protein, 304 aa, Enterobacter cloacae
SPGGGMMRMKRNLKAIPVLVAGLFTSQLSIAAGSVSADPHAGHDMSAMQMPADENFTEMTSMEPIVTESRTPIPPVTDADRKAAFGNLQGHAIHDSAINYLVLLDQLEWQRSDNTNNFSWSVNSWIGGDTDRIWLKSEGERSNGETEAAEAQLLWGHAVGPWWDLVAGVRQDFRPASARTWAAVGFQGLALYNFESEITGFVSNGGKAALRLGGEYDVLLTNRLILQPSYEVNFYSQDDESRGRGRGLTDTELGLRLRYEIRREFAPYIGVSWNQLYGKTSDMAKREGEKDHQVVFLAGARIWF

SEQ ID NO: 5908 - protein, 139 aa, Enterobacter cloacae
RTDIKHSTKQVNKMSILNKAILTGGLVMGVAFSAMAHPELKSSVPQADSAVAAPEKIQLNFSENLTVKFSGAKLTMTGMKGMSSHSPMPVAAKVAPGADPKSMVIIPREPLPAGTYRVDWRAVSSDTHPITGNYTFTVK

SEQ ID NO: 5909 - protein, 490 aa, Enterobacter cloacae
KHFMGVQPDDTYVYTFKVKQNGTYWYHSHSGLQEQEGVYGAIIIDAGEPEPFTYDREHVVMLSDWTDENPHSLLKKLKKQSDYYNFNKPTVGSFFRDVNTRGLSATIADRKMWAEMKMNPTDLADVSGYTYTYLMNGQAPLKNWTGLFRPGEKIRLRFINGSAMTYFDIRIPGLKMTVVAADGQYVNPVTVDEFRIAVAETYDVIVEPQGEAYTIFAQSMDRTGYARGTLATREGLSAAVPPLDPRPLLTMEDMGMGGMGHDMAGMDHSQMGGMDNSGEMMSMDGADLPDSGTSSAPMDHSSMAGMDHSRMAGMPGMQSHPASETDNPLVDMQAMSVSPKLNDPGIGLRNNGRKVLTYADLKSRFEDPDGREPGRTIELHLTGHMEKFAWSFNGIKFSDAAPVLLKYGERLRITLINDTMMTHPIHLHGMWSDLEDENGNFMVRKHTIDVPPGTKRSYRVTADALGRWAYHCHLLYHMEMGMFREVRVEE

SEQ ID NO: 5910 - protein, 91 aa, Enterobacter cloacae
SNIMNDLIMIVIRFLLYLDLMVIFGLPFFQIYGISGVRHETYNLTNFRSFITFAVVTGIILTGINMLLVSNAMSGVTDLRELSIHVIEMVI

SEQ ID NO: 5911 - protein, 453 aa, Enterobacter cloacae
TNSNSSQVNFYYIQGSHAALSGGFMLLAGAIFILTIVLVIWQPKGLGIGWSAIFGAILALISGVVHITDILVVWNIVWNATATFIAVIIISLLLDESGFFEWAALHVSRWGNGRGRLLFTYIVLLGAAVAALFANDGAALILTPIVIAMLLALGFSKSATLAFVMAAGFIADTASLPLIVSNLVNIVSADFFHLGFTEYASVMVPVDIAAIIATLVMLHLFFRKDIPPTYDLNRLKEPALAIKDPATFRTGWIVLILLLVGFFVLEPLGIPVSAIAAVGAAILFFVAKKGHAINTGKVLRGAPWQIVIFSLGMYLVVYGLRNAGLTEYLSGVLNLFADKGLWAATFGTGFLTAFLSSIMNNMPTVLIGALSIDGSTASGVIKEAMIYANVIGCDLGPKITPIGSLATLLWLHVLSQKNMTITWGYYFRTGIIMTLPVLFVTLAALALRLSFTL

SEQ ID NO: 5912 - protein, 92 aa, Enterobacter cloacae
DTDMSNITIYHNPACGTSRNTLEMIRNSGTEPTVIHYLETPPSRDELVKLIADMGITVRALLRKNVEPFEALGLAEDRFTDDQLIDFMVSVK

SEQ ID NO: 5913 - protein, 111 aa, Enterobacter cloacae
KQKGHVSTPMMQLQDPERTKVLLVTLPETTPVLEAANLQADLERAGIHPWGWIINNSLSIAETRSPLLRQRSQQELPQIEAVKNQHATRVALVPVLAAEPTGIDKLKQLAG

SEQ ID NO: 5914 - protein, 212 aa, Enterobacter cloacae
DSIAWMPRPAVVKTLFSAEREGGPLTEAACWAHARRKIHDVYISTRTATAEEALKRISELYAIEEEIRGLPASQRLAARRSRSKPLLISLHDWLVEKRATLSKKSRLGEAFAYALNQWDALCYYCDDGLAEPDNNAAERALRAVCLGKKNYIFFGSDHGGERGALLYGLIGTCRLNGIDPEGYLRHILSVLPEWPINKVAELLPWNVDLTNK

SEQ ID NO: 5915 - protein, 141 aa, Enterobacter cloacae
RQPQPGSQPMQTQLVTPSNDPGQVAPVEPEPVQEDQEQAATPSEPQAQQPTGIEQQWRSYRVEPGKTLAQLFRDHNLPATDVYAMAQVEGAGKPLSNLQNGQMVQIRQNASGVVTGLTIDTGNGQQVLFTRQPDGSFIRAR

SEQ ID NO: 5916 - protein, 153 aa, Enterobacter cloacae
EDKVMQVILLDKVANLGSLGDQVNVKAGYARNFLVPQGKAVPATKKNVEFFEARRAELEAKLADVLAAANARAEAINALGTVTIASKAGDEGKLFGSIGTRDIADAVTAAGVKVAKSEVRLPNGVLRTTGEHEVDFQVHSEVFAKLVVNVVAE

SEQ ID NO: 5917 - protein, 81 aa, Enterobacter cloacae
ILETSHMARYFRRRKFCRFTAEGVQEIDYKDIATLKNYITESGKIVPSRITGTRAKYQRQLARAIKRARYLSLLPYTDRHQ

SEQ ID NO: 5918 - protein, 318 aa, Enterobacter cloacae
NAILFMRFVMDTALPTPVFARRNVAYACATLCCLLWGSSYPAIKSGYELFQIATDDIPSKVVFAGYRFLFAGALLLLFALAQRKPIGRLTPTQFGQLTILGLTQTSLQYTFFYIGLAYTTGVNGSIMNATGTFFSVLLAHFIYHNDKLSYNKTLGCVLGFAGVMLVNFHSGLSEFQFVWKGDGFVVLAAFILSAATLYGKRISQTVDPTVMTGWQLGIGGAALVAGGYATGGTLEVHSMKAVAVLGYLTLLSSVAFALWSALLKVNRVSMIAPFNFVIPVAGTVLSAIFLGDNIMDIKYAIALVLVCSGIWWVNKRRA

SEQ ID NO: 5919 - protein, 95 aa, Enterobacter cloacae
TERLQWLAALLLDALKIQQGDTLLTHPEVWALVTTLANRLSGQSLHAILHDICQSREQLLTVTGGGLNRELLLTDQLLRIEHYLQPGVIPPVSHL

SEQ ID NO: 5920 - protein, 290 aa, Enterobacter cloacae
PTSYCVSNTTCNRVSYRRFPTSERDIMFLVDSHCHLDGLDYQSLHKNVDDVLAKAAARDVKFCLAVATTLPGYRSMRELVGERDNVVFSCGVHPLNQDEAYDVEDLRRLAAEEGVVAMGETGLDYLYTPETKPRQQESFRNHIRIGRELNKPVIVHTRDARADTLAILREEKVTDCGGVLHCFTEDRETAGKLLDLGFYISFSGIVTFRNAEQLRDAARYVPLDRILVETDSPYLAPVPHRGKENQPAMTRDVAEYMAVLKGVSIEELARVTTENFASLFHIDPARLQSV

SEQ ID NO: 5921 - protein, 488 aa, Enterobacter cloacae
KKHKYSGALSIMFKNAFANLQKVGKSLMLPVSVLPIAGILLGVGSANFSWLPAVVSHVMAEAGGSVFANMPLIFAIGVALGFTNNDGVSALASVVAYGIMVKTMAVVAPLVLHLPAEEIAAKHLADTGVLGGIISGAIAAYMFNRFYRIKLPEYLGFFAGKRFVPIISGLAAIFTGVVLSFIWPPIGTAIQTFSQWAAYHNPVVAFGIYGFIERCLVPFGLHHIWNVPFQMQIGEYTNAAGQVFHGDIPRYMAGDPTAGKLSGGFLFKMYGLPAAAIAIWHSAKPENRAKVGGIMISAALTSFLTGITEPIEFSFMFVAPILYIIHAVLAGLAFPICILLGMRDGTSFSHGLIDFIVLSGNSSKLWLFPIVGAGYAVVYYTVFRVLIKALDLKTPGREDATEDSKAGATSEMAPALVAAFGGKENITNLDACITRLRVSVADVAKVDQPGLKKLGAAGVVVAGSGVQAIFGTKSDNLKTEMDEYIRNN

SEQ ID NO: 5922 - protein, 176 aa, Enterobacter cloacae
DSNALIGSIGVRMDHWNLSEIMSTVGVKNEPLTAGEFKDALDPFHPLSDSTREFMQKEILNTMHEKFITDVELGRGKKLLSRHDADAVSLYSGRVWPTPQAVKYGLVDGDLTSVEIRTRLSKMYSTDTFKNYNEPHRNLRSALGMLMSLSSNIESLTGTTTRLVESVNATSYPSVR

SEQ ID NO: 5923 - protein, 245 aa, Enterobacter cloacae
GNMDAFNLLWSITGVAFIILIFVVLLCLLGFMTSAIAERRTAKAIESGLPEEAQGLLSDLTFQLSAHSTTQVDHILVAPHGIYVIEQKNYVGKLYGTLEESHWRKWTQSRTLKLQNPFKQNQGHIRAIQSALKARELECINVVIINGRCKFDGIKPEWLCMGMDDFIHKVKQRRGLRLFTPESVQHICSVLKSTRKSPGLYTDLTHIHNITTKYKAPMKFEQRVTYILLNFIHYLWASLFTKQKP

SEQ ID NO: 5924 - protein, 275 aa, Enterobacter cloacae
RGMPARVSRPGITGRSHLMSQNTLKVHDLNEDAEFDENGAEAFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKDNGPEDTTQDDDMKQ

SEQ ID NO: 5925 - protein, 364 aa, Enterobacter cloacae
RRVAALSLVSLWLAGCTSSNNAPAPVSSVNGTSGSGNTSSGMLITPPPKMGTSTAQQTPQIQPVQRPVTQPTQIQPVEQPVQTENGRIVYNRKYGNIPKGSYTGGSTYTVKRGDTLFYIAWITGNDFRDLAQRNNVQAPYALEVGQTLQVGNATGTPLTPGNTVSAADVTAQNNSVTPAQKTTTVVASQPVITYSEDSGDQSANKMLPNNKGTATVVTAPTTAPVVSSTVPTASSQNASSSITTWRWPTDGKIIENFATSEGGNKGIDIAGSKGQAIIATADGRVVYAGNALRGYGNLIIIKHNDDYLSAYAHNDTMLVREQQEVKAGQKIATMGSTGTSSTRLHFEIRYKGKSVNPLQYLPQR

SEQ ID NO: 5926 - protein, 130 aa, Enterobacter cloacae
SLLNFLIPKNKGAISPQIKFHQVTRTKKFQRDQRIQTSARGNYGREQTEEEPPKGTAPEKPQAAQRREKRKTEKGHQNRGEKLISEQNRSPNEKRNISAEKKRESAQLVLDQNHTVAAVLHRRGRKETRF

SEQ ID NO: 5927 - protein, 604 aa, Enterobacter cloacae
VSPSERTLEGKEWCAGNTNGDSGKSLKVNIGGKKSWADFASGDSGDLLDLWVLVRNCQLHDAMREAKEFLGLKDDDHHFEAKKKLFSRPTKKGVKSASKCYDYLASRGITRETADRFKVTDAVVWYHDESREVPAVAFPYIRNGELLQVKRIGTERPNGKKLIMAEADCEPCLFGWQALDKNTRLVVLCEGEIDCMTFTQLGYDALSVPFGGGKGAKQQWIEYEYHNLDRFQEIWLCLDNDNVGREAAKEIARRLGEHRCRMVELPHKDINDCLMNGMDSDSILEYMERAKFFDPDELCSAGDLLQETIEAFEHRDTGLFTSPWASLNNNFKFRAGELTLVNGVNGHGKTELVGHIAIDAMSQGVRTCIASLELKPGKMLARLTRQTICTSSPKREEIIMTNEWFSDRLWVFKLTGTAKADRLLEIFAYARRRYGIELFVIDNLAKCGLDEEDYTGQKDFIDTLCDFKNEHNCHVLLVTHARKTNDSAPTGKMDVKGTGALTDMPDNVMAVWRNIPRELAQRKADRMGYESLDKDEQAAINLPASMIRLLKQREGEGWIGDIGANFDSRSHQFLEGEKKPFNYLVGKPQSELDLEWEASNVTRV

SEQ ID NO: 5928 - protein, 342 aa, Enterobacter cloacae
ASSRLHNHASSGVCVSSKILGNVWDACAAHDIKGAKLVIMARLADYSNDDGVCYPSVETICRQLGLGESTVRTAIAELESSGWLRREARRKGNRNTSNLYHLNAERLEALARIEEDKVAALKQQRRTNGFHPSDSDPSKTEPSDSGFSNGFHPSDSDKNGVFTRQNLTPDPQVNSKHDPQVNSKHDPQVNSKQESQDIGVCGKASSENRSSKENYSNEFEKAWQAYPKRAGGNSKAAAWKAWKARIKDGVNTEAMLAGVNRYAGYVRATGSAGTQYVKQAATFFGPDKHFDEPWLVETQENKVPTRQDQSRYEWYAKSDDGSAEVFINQSAIDRMNRGGYRP

SEQ ID NO: 5929 - protein, 181 aa, Enterobacter cloacae
SPCPRAAADRLNTSNNTKVRIDPIIVAQDGSLCGPGTACTTVAKQTYALPARPDLSGGMGGVSTPAVPAQPQGEVRAISNDTLQSEDATGAPVKSSGFFGAPTTLAPGVIESNEPAPALAPVVAAPAAQPAPVTAPCCYADCGACDGERQLRGSGWRCQRSDPCRAISAAFKQTVWRARPR

SEQ ID NO: 5930 - protein, 105 aa, Enterobacter cloacae
NSRPVAGVIIFYTHAGADMKTKLNELLEFPTPFTYKVMGLAKPELVDQVVEVVQRHAPGDYSPSVKPSSKGNYHSVSITITATHIEQVETLYEELGNIEIVRMVL

SEQ ID NO: 5931 - protein, 89 aa, Enterobacter cloacae
PRPAATQTAAPATASGSYVVQVGAVSDRTRAEQYQQRLSKQFGVPGRVEQNGAVWRIQMGPFASKSQAASLQQRLQSEAQLQSFIAVAK

SEQ ID NO: 5932 - protein, 434 aa, Enterobacter cloacae
HSHDESRMPARIAFAIVRHFFNSITDVVVLTMKTTFSARFVQRMALTTALCAAAFSAAHADDLNIKTMIPGVPQIDAESYILIDYNSGKVLAEQNADARRDPASLTKMMTSYVIGQAMKAGKFKETDLVTIGNDAWATGNPVFKGSSLMFLKPGMQVPVSQLIRGINLQSGNDACVAMADFAAGSQDAFVGLMNSYVSALGLKNSHFQTVHGLDAEGQYSSARDMALIGQALIRDVPNEYSIYKEKEFTFNGIRQTNRNGLLWDNSLNVDGIKTGHTDKAGYNLVASATEGQMRLISAVMGGRTFKGRETESKKLLTWGFRFFETVNPLKAGKEFASEPVWFGDNDRASLGVDKDLYLTIPRGRMKDLKASYVLNTTELHAPLQKNQVVGTINFQLDGKTIDQRPLVVLEEIPEGNFFGKIIDYIKLMFHHWFG

SEQ ID NO: 5933 - protein, 228 aa, Enterobacter cloacae
YTPRYLFSLVFGDVLLYQDKILVRHLGIQPYEPVSQAMHDFTDMRDDTTPDEIWLVEHMPVFTQGQAGKAEHLLMTGDIPVIQSDRGGQVTYHGPGQQVMYVLLNLKRRKLGVRELVTLLEQTVVNTLAEYGIDAHPRADAPGVYVGEKKICSLGLRIRKGCSFHGLALNINMDLTPFQRINPCGYAGMEMTQMRQWVATATPENIRPVLLKKFLALLNNPDHEYIAA

SEQ ID NO: 5934 - protein, 386 aa, Enterobacter cloacae
PGVDMYALTHGRIYTGHEILDDHAIVIANGLIERVCPLAELPPEIEQRSLNGAVISPGFIDVQLNGCGGVQFNDTAEAVTVETLEIMQKANEKSGCTSYLPTLITSSDDLMKQGIRVMREYLAKHPNQALGLHLEGPWLNMVKKGTHNPNYVRKPDAELVDYMCANADVITKVTLAPEMTGTDVISKLAAAGIVVSAGHSNATLKEAKAGFRAGITFATHLYNAMPYITGREPGLVGAILDEPDVYCGIIADGLHVDYTNIRNAQRLKGDKLCLVTDATAPAGANIDQFICAGKTIYYRNGLCVDENGTLSGSSLTMIEGVRNLVEHCGIALEEVLRMATLYPARAIGVDKQLGGIAPGMVANLTAFTHDYKIIKTIVNGNEVVTE

SEQ ID NO: 5935 - protein, 267 aa, Enterobacter cloacae
IMRLIPLATAEQVGKWAARHIVNRINAFKPTADRPFVLGLPTGGTPLTAYKALVEMHKAGQVSFKHVVTFNMDEYVGLPKEHPESYHSFMHRNFFDHVDIPAENINLLNGNAPDIDAECRQYEEKIRSYGKIHLFMGGVGNDGHIAFNEPASSLASRTRIKTLTHDTRVANSRFFDGDVNQVPKYALTVGVGTLLDAEEVMILVLGAVKAQALQAAVEGNVNHMWTISCLQLHPKAVVVCDEPSTMELKVKTLKYFNELEAENIKGL

SEQ ID NO: 5936 - protein, 398 aa, Enterobacter cloacae
VSKSMTPGGQAQIGNVDLVKQLNSAAVYRLIDQHGPISRIQIAEQSQLAPASVTKITRQLIERGLIKEVDQQASTGGRRAISIVTETRNFQAIGVRLGRHDTTLTLYDLSSKAIAEEHYPLPERTQETLEHALLNTIAQFIESCQRKIRELIAISVILPGLVDPESGVIRYMPHIKVENWGLVEALEKRFKLTCFVGHDIRSLALAEHYFGASQDCEDSILVRVHRGTGAGIISNGRIFIGRNGNVGEIGHIQVEPLGERCHCGNFGCLETVAANAAIEHRVRHLLEQGYQSRVTLDDCKIGAICKAANKGDALACEVIEQVGRHLGKTIAIAINLFNPQKVVIAGEIVEAEKVLLPAIEGCINTQALKAFRQNLPVVRSTLDHRSAIVFIHEGRERR

SEQ ID NO: 5937 - protein, 114 aa, Enterobacter cloacae
MRRDMYEVMDRWGAWAAADSSGVDWQPIAAGFKGLLPHGKKSRLQCDDDEGIMIDGCIARLRKFKSDEYELLIAHFVIGISLRTIAKKKKCSDGTVRKDLQTALGFVEGVMSML

SEQ ID NO: 5938 - protein, 211 aa, Enterobacter cloacae
DVMGIMCDMSYRLYPLKNTVAFRKTTEKWGGLSNMAKGYPLLINGLPIQSSEILYQACRYPDYPEIQKAIITQGNPYEAKQTARSFEAKTRSGWEKNRVSIMKWCVCVKLCQNWETFFALLDSTGEHDIVEHSEKDQFWGASKDSEGNFYGMNVLGRILMDVRDVARKRGPTGFASIPPLPLEKFLLLGDHIRDVTFTPPPVDTGHSLSLF

SEQ ID NO: 5939 - protein, 216 aa, Enterobacter cloacae
SSRIRCNMLFHTNNSIYLSHNDGQQVSHTPSMHCYGCVKKCLFGDAEACARKTCTGLECYIWPDNNSYLVEGIRHYFECVSDKYISQPVVIIDFSHKNITYFLNDSWLEQFKNMRLILVTDKKMTAIAHYWFYNDTLETTISSIIFYDDSAEEVATKLKKTFLAKTIKPSGSRPKLSQNEFSLFSFLFNGWTPKKIAYQNGTSVKNTYAMKNLHHE

SEQ ID NO: 5940 - protein, 811 aa, Enterobacter cloacae
FMRICCLGRIKTLFYHGLSLYLSSLILLAWTAALGVAGLWNIWVLVPLAIILLPFNLTPMRKSMISVPVFRGFRKVMPPMSRTEKEAIDAGTTWWEGDLFQGNPDWKKLHNYPQPRLTAEEQAFIDGPVEEACRMANDFAITHEMADLPPELWAYLKEHRFFAMIIKKEYGGLEFSAYAQARVLQKLAGVSGILAITVGVPNSLGPGELLQHYGTEEQKDHYLPRLARGQEIPCFALTSPEAGSDAGAIPDTGVVCMGEWQGQQVLGMRLTWNKRYITLAPIATVLGLAFKLSDPEKLLGGEEDLGITCALIPTSTPGVEIGRRHFPLNVPFQNGPTRGQDIFVPIDYIIGGPKMAGQGWRMLVECLSVGRGITLPSNSTGGLKSVAMGIGAYAHIRRQFKISIGKMEGIEEPLARIAGNAYVMDAAASLITYGIMLGEKPAVLSAIVKYHCTHRAQQSIIDAMDIASGKGIMLGEGNFLARNYQGAPIAITVEGANILTRSMMIFGQGAIRCHPYVLEEMAAAQNNDVDAFDKLLFKHIGHVGSNEVRSFWLGLTRGLTSATPTGDATKRYYQHLNRLSANLALLSDVSMAVLGGSLKRRERISARLGDVLSQIFLASAVLKRYDDEGRQEADLPLVHWGVQDALYQAEQAIDDLLANFPNRFVAGALRVVIFPTGRHHLAPSDKLDHKVAKILQVPSATRSRIGRGQYLAPTPHNPVGLLEEALLDVMAADPIHQKICKQLGKNLPFTRLDELAKQALAGGIIDNSEAAILVKAEESRLRSINVDDFEPEELATQPVKLPEKHRKPEAA

SEQ ID NO: 5941 - protein, 262 aa, Enterobacter cloacae
GVGIVPGLKISVLQQPLVWMDGPANLRHFDRQLEEISGRDVIVLPEMFTTGFAMEAAKQSMPQDEVVAWMHAKAQETNALIAGSVALQTERGPVNRFLLVEPEGKVHFYDKRHLFRMADEHQHYVAGNERVVFEWRGWRILPLVCYDLRFPVWSRNRNDYDLALYVANWPAPRSLHWQALLTARAIENQAYIVGCNRVGTDGNGHHYRGDSRVISPQGEIIATAEPHQATRIDAELSLTALTEYREKFPAWQDADRFSIENK

SEQ ID NO: 5942 - protein, 165 aa, Enterobacter cloacae
EDIHWIFLVSRPLYPLAVELLMRPESTLLSDMEPIEGVINAIRAGSERAERISQTLLIPETPDIEEESEQMIALTHSERKVLRLLGKGWGINQIATLLNKSNKTISAQKNSAMRRLSLRSNADMYAWISSTQGMRELSLMSAYGEFEEWKRPLQQDISPSSKAAQ

SEQ ID NO: 5943 - protein, 382 aa, Enterobacter cloacae
  UNSURE (327)
ERPKRTYDRRSAMSANHAAFNLIFRFVENYVSPIAGRISSQRHVMAIRDGFISAMPFMIVGSFLLVFAYPPFSPDTTWGFARAWLDMAKQFEGQILTPFDMTMGVMSLYICAAIAYNLGKHYVKTHQLDPFMCAMLSLMAFLLVAAPKTKGALPVDSLGGTGIFTAILVAIYCVEMMRFLKAHNIGIRLPDQVPPMIKNSFDLLIPVLVVVLTLYPLSLLIQSQFGMLIPQAIMSIFKPLVSAADSLPAILLAVLIGHLLWFAGIHGAAIVSGMLQMFWLTNLGANHTALAANQPLPHIFMEAFWTFFIVIGGSGATMGLVFCYLRXRSAHLRSIGRLNVVPSIFNINEPVIFVTPDCDEPGVLYSFPCWRRWLIPCWHGQR

SEQ ID NO: 5944 - protein, 70 aa, Enterobacter cloacae
FPSCRGRHPAPVGAAWALGWDFRAAILVLVLACVSAIIYFPFFKVYEKQLLQQEAEEAQRNGEEENQQVA

SEQ ID NO: 5945 - protein, 229 aa, Enterobacter cloacae
GMEKTTATRHIAVIESCSMSAVGLKHLFAMPSLSHYQVHLFSRFASFKAALSDISFYAVIYSLSDEREERRNCLACLRDLTFTHSDVQRIVLASDEMEARLVSHLSPSRLHGIISKSVPLKQLMEGLKTLLSETHQVNDNMYNHWCVSQNRMLSPTERAILRYMSSGFSIPEIAAQLERNIKTIRAHKFNAMVKLGVNSDVGLLDAADILAHLPAREVRRSALTVPSFS

SEQ ID NO: 5946 - protein, 266 aa, Enterobacter cloacae
RLHTMATRTAHIVEPLLWRAPLSAGETTLADAIREKIAVTRAHLLDFIKLDEAPPHHALTLTEWQRPAELRSLLATYSDHIYRNQPTLTRENKPLLSLWAQWYIGLMVPPVMLALLTQETMLDLSSEHFHVEFHETGRAACFWIDVHEDPSARHLSAQARMERLITRALVPVIDALEATGEINGKLIWSNTGYLIHWYLTEMKPLLGDEKVDALRQSCFFARQLSDGRDNPLYRTVVPREGLLVRRTCCQRYRLPDVQQCGDCTLK

SEQ ID NO: 5947 - protein, 163 aa, Enterobacter cloacae
QITQDICQEESMSLQSVQQFFAEHAPDIEIIELNQSTATVALAAAAHNVEPGQIAKTLSLKIKNDVILVVAKGDARLDNKKLKETFGAKARMLSSDEVVTLTGHPVGGVCPFGLENPLSVYCDITLKQYAEVLPAAGAIHSAVRISPDRMAELTAAKWVDVCI

SEQ ID NO: 5948 - protein, 334 aa, Enterobacter cloacae
IAILPGPCCYTQAPSTCTAGCSITANYLKKFIMSRILAAITLLLSVILTILVTIACSVPIIVAGIIKLLLPVPPVWRAVSAFCNFMMYCWCEGLAILLHLNPWLKWDVQGLEKLNKKNWYLLICNHHSWADIVVLCVLFRKHIPMNKYFLKQQLAWVPFIGLACWALDMPFMKRYSRSYLIRHPERRGKDVETTRRSCEKFRAHPTTIVNFVEGSRFTEEKRQQTRSPYQNLLPPKAAGIAMALNVLGEQFDKLLNVTLCYPENDRTPFYDLLSGRLTRIVVRVDLVPVNTELHGDYVNDKNFKRRFQLWLNTLWKEKDEQIAKIKSSYKNAGQ

SEQ ID NO: 5949 - protein, 185 aa, Enterobacter cloacae
  UNSURE (136)
CSFHLERHVSRVNPTIKEAIFVNQCQEIIGVVLAGGRATRMGGKDKGLQLLNNTPLWQHVADTLADQVSSMAISANRHVDIYQRSGYPVYQDNLADYPGPLAGMLSVMQQSYGEWFLFCPCDTPFIPSCLVERLVXRRGGAPVVWVHDGEREHPTIALINRSLISALGVLLAAGDRRVLVFMPPF

SEQ ID NO: 5950 - protein, 99 aa, Enterobacter cloacae
RVSLNERSTTMKCKRLNEVIELLQPAWQKEPELNLMQFLQKLAKESGFDGELADLSDDILIYHLKMRDSAKDAVIPGIQKDYEEDFKTALLRARGVIKE

SEQ ID NO: 5951 - protein, 333 aa, Enterobacter cloacae
FPDDRMNDQAFTFQTLHPDTIMDALFEQGIRVDSGLTALNSYENRVYQFQDEERQRFVVKFYRPQRWSAEQIQEEHQFAHDLLDDDVPVAAPIKFNNQTLLTHQGFYYAVFPSLGGRQFEADNIDQMEWVARYLGRIHQTGRKKPFVARPTIGVKEYLIEPRQVFETSALIPNALKDNFLTATDKLIDAVKASWRDDITTLRLHGDCHAGNILWRDGPLFVDLDDARMGPAVQDLWMLLNGDKAEQRMQLETIIEAYEEFIPFNSDEIALIEPLRAMRFVYYLAWLIRRWEDPAFPRNFPWLTGEDYWRNQISTFTEQVKVLQEPPLQLTPMY

SEQ ID NO: 5952 - protein, 216 aa, Enterobacter cloacae
LDTPRRELIMKKIWLALAGMILAFSATAAQFTDGKQYITLDKPVAGEPQVLEFFSFYCPHCYEFEQVLHVSDNVKKKLPEGTKMTKYHVEFLGPLGKDLTQAWAVAIALGVEDKITAPMFEAVQKTQTVQTTADIRKVFVDAGVKGEDYDAAWNSFVVKSLVAQQEKAAADFQLQGVPAMYVNGKYQVNMRGMDTTSMDIFVQQYADTVKYLVEKK

SEQ ID NO: 5953 - protein, 87 aa, Enterobacter cloacae
DAQPANLLHRGRKRSAWTIPEGATAPQAADKIHTDFVKGFIRTQTIVFEDFITYKGEQGAKETGKMRAEGKDYIIKDGDVMNFLFNL

SEQ ID NO: 5954 - protein, 82 aa, Enterobacter cloacae
CQRMTFSCVRRLCVTFSAESSSGKGSVEVAVYAAVESDIAEIIDGDHKEFMAERGLNRVIRAGYELLSLQTYFTAGVKEVNA

SEQ ID NO: 5955 - protein, 101 aa, Enterobacter cloacae
RQRMPFSCVRRLCVTFSADSSSDKGSVVVAFWNAVESDIAEMNDADREDFMAEQGLNRVIRAGHEMLSLQTYFTAGVKEVRGPSLRVRLRLRRPIKSTPIS

SEQ ID NO: 5956 - protein, 443 aa, Enterobacter cloacae
VCRLSISWPARITRFRPCSAMKSSRSASFISAISDSTAFQNATTTEPLSLEESAEKVTHNRLTQLNGIRWRYDIHGRTVEKDNGQTRWHYRYDGEHRLTEVISQPRDRNRPQTLVSFRYDPLGRRISKTRRQMLGGQPTGKPVTTRFVWEGFRLLQEVHGDVPLTYVYSDQDSYDPLARIDGVDAQEIFWFHCQPNGTPERMTDSEGQVRWEGVNSAWGKLLRESETQVSGYFQNLRMQGQYLDRETGLHYNLFRYYDPDCGRFTQQDPIGLAGGINLYQYAPNALGWVDPWGLSRECSGKTKPDFYVGPNGPSSTMPSTAYRYMDSKYAPQTIENKSAPLSYFGYTKYKSAHEARDAYQIFYEKGNPDSWSDARLLGEFDTLQLYKNGVPQVQVPLANGGRGPGYELFTSAYPEYGKGGALQLLPIERNYPVIFERVTIIPE

SEQ ID NO: 5957 - protein, 267 aa, Enterobacter cloacae
TQKISLSLKELLKVGGVVVEVKIYYKGSVDFIAGEGTILNEFIGEVATRQINIIDGNYYASSSLLDKKEKVGFLLYDGKKSDLNLSDAEEISNEEFEVFWQTSTGSLQEKKRIKYLSGDAVEPLKKSTVIAHIVNNKGKWGKGFVLSLSNKYPAAKKSYLSCFKENNFPELGVVDFVMVDAQEKIFIANMYAQDGIKKNINDKKQYVCYDSLKVCLEKLSDFALVNRLSIQMPRIGAGLGGGDWNVIESLILKNICYKMIDCNVITL

SEQ ID NO: 5958 - protein, 67 aa, Enterobacter cloacae
SFKEQRMLILTRRVGETLMIGDEVTVTVLGVKGNQVRIGVNAPKEVSVHREEIYQRIQAEKSQQSSY

SEQ ID NO: 5959 - protein, 88 aa, Enterobacter cloacae
IQFGNTKGAHKRFDNLGRWGTPALAVRATEIFLRSWRPHYGAALPGSAEEDGDRYIEIWNIVFMQFNRQADGTMEPLPKTVRRYRYGP

SEQ ID NO: 5960 - protein, 706 aa, Enterobacter cloacae
AGGGPRPLRYVPPRFFYDHGDHIMGRPSREARKKMAIAILRSGTLSSCSSTVRRTAPWSRCPKPSVDTGMGLERIAAVLQHVNSNYEIDLFSTLIKAVAEVTGATDLSNKSLRVIADHIRSCAFLIADGVIPSNENRGYVLRRIIRRAIRHGNMLGAKDTFFYKLVGPLIGVMGSAGDELKRQQAQVEQVLKTEEEQFARTLERGLALLDDELAKLKGDTLDGETAFRLYDTYGFPVDLTADVCRERNIKVDEAGFEAAMEEQRRRARESSGFGADYNAMIRVDSASEFKGYEELALTSNVTALFVDGKAVDSISAGQDAVVILDKTPFYAESGGQVGDKGELKGNGFSFSVSDTQKYGQAIGHQGKLVSGSLKVGEGVQANVDEARRARIRLNHSATHLMHAALREVLGTHVAQKGSLVNDKVLRFDFSHFEAMKPSEIRAVEDLVNAQIRRNLPIETHIMDLEAAKKKGAMALFGEKYDDRVRVLSMGDFSTELCGGTHASRTGDIGLFRIVSESGTAAGVRRIEAVTGEGAIASLHAQSDQLHEIAQLLKGDSQNLGEKVRVALDRTRQLEKELQQLKEQAAAQESANLSSKAVDIKGVKLLVSDLAGVEPKMLRTMVDDLKNQLGSTVIVLATVAEGKVSLIAGVSKDVTDRVKAGELIGMVAQQVGGKGGGRPDMAQAGGTDAAALPAALASVESWVSAKL

SEQ ID NO: 5961 - protein, 298 aa, Enterobacter cloacae
VSPLIQLLDRPIAYQPAFAQLRAGKVKSGPAAAVLLSQLVYWHNRMDGEWLYKTREDIKKETGLSRDEQETARKRLVALGVLQEDLRGVPATVHYRINTERLEALLLAPGQAESQLGATPPTRRRQPRQQDGGNAPNKMVETPPTRRVEPTQQVGWVPANFPTGDYTEITQESTQEITQKAGEKNSVDNFSEIYPEAEIFDAEKKTWGTAEDLEFAQWFFARIVELHEKAAEYDGMLSRPKEPDWTGWADEVRQLREGQRCDHQADAKPGRAYSARPVGGARRFRLPKCCTPNGQNWS

SEQ ID NO: 5962 - protein, 218 aa, Enterobacter cloacae
METVLDVLKAMGKTTYRDVAARLDIEPVVALNMLREQKEQGLCDYADGGWFLGTAAKQKPKRIRPKQESELVGRILAVMQGQGAISAEKIAKLLGKTSRALNASLGALGKEGRVVRHVDGKNITWSLKNDDAPAPATAAPIANARQAESALAEKSTAQIIEEIPAFTARPNDLAIPSSRFISSEIRRTKAKLASLQKLQCAARQLRRHKHLLVGLDNE

SEQ ID NO: 5963 - protein, 138 aa, Enterobacter cloacae
LMEIKHEHIQCVLLAWAAEVGQAHAAEAITAEYTRQGGAELPLVAGNTWNNQQNIFHRWLDGSTPQRRAKIRELLPAILAVLPRSIRHRLSIYDTIERRALLAAQDALGAAIDAHDDAVEALFQKVMQHAAADSPKFH

SEQ ID NO: 5964 - protein, 125 aa, Enterobacter cloacae
VHRGDVVSVKCCGCQELLEEDEVFKLADSCGVDICDRCASRVVHSYNEWHGGFSYAPVKQKNPRKSISAAVKLKIFQRDGFRCKHCGTSEALTIDHIQPVSKGGSNQDENLQTLCASCNSRKGVK

SEQ ID NO: 5965 - protein, 204 aa, Enterobacter cloacae
RKNGLAYINAVYPFNFIIPLGISACLAYILPIINEKITYLQSRPISRTAILLSIRAKKALVADISLEKYRAKRDVTYERHVAGAEKEIQDMREEIVNSKERVGEMNAALLELNQKNDEINALLQDSNIRNKKLSDEIERHKIAETRFFGEIEDLNKELDRLYSLLKMEPTRGVGLGIRKITTINGEENSDTDDTQYRPGSNEDK

SEQ ID NO: 5966 - protein, 241 aa, Enterobacter cloacae
VANMQTPHILIVEDELVTRNTLKSIFEAEGYDVFEATDGAEMHQILSENDINLVIMDINLPGKNGLLLARELREQANVALMFLTGRDNEVDKILGLEIGADDYITKPFNPRELTIRARNLLSRTMNLGTVSEERRSVDSYKFNGWELDINSRSLISPNGEQYKLPRSEFRAMLHFCENPGKIQSRAELLKKMTGRELKPHDRTVDVTIRRIRKHFESTPDTPEIIATIHGEGYRFCGDLQE

SEQ ID NO: 5967 - protein, 228 aa, Enterobacter cloacae
MHLSIVLVAPARAENIGAAARAMKTMGFTDLRIVDSTAHLEPAARWVAHGSGDILDNITTYATLADALHDISFTVATTARSRAKFHYYATPAELVPMLEEKSQWLEKAALVFGREDSGLTNEELALADVLTGAPMVADYPSLNLGQAVMVYCYQLASLIQISQPPVTVSDENQLAALRVRADKLLAQLGVADDQKMVDWLQQRLGRLEQRDTVMLHRLLHDIEKKLAE

SEQ ID NO: 5968 - protein, 159 aa, Enterobacter cloacae
GNNMKYKVLVFAALALMAGRVAQAEQIGSVDTVFKMFGPDHKIVVEAFDDPDVKNVTCYVSRAKTGGIKGGLGLAEDTSDAAISCQQVGPVELSDKIKNGKAQGDVVFQKRTSLVFKKLQVVRFYDAKRNTLAYLAYSDKVVEGSPKNAISAVPIMPWH

SEQ ID NO: 5969 - protein, 287 aa, Enterobacter cloacae
KKCLSALRQILEKSTRLIMSGSSQDDFTGADMFRRLRDIIKRGVVKEVQMQPPRVRVTFGGEHQSGWLQWFTLATSERVDWSAPKVGDPVPPNSTAAERALEAVLSHVGDLPGDIRIIKNPDLCPVDLLPWLAWEYAVTYWNSGWSEQQKRQVIKAAAWQNKHRGTRGAVERALLTVGYESQLQEWFEKVPKGDPYTFGIKIYLLKQMGMDLDLLNTFIAQIFDAKNCRSLLESINFEAEIDGEFYIAGTTAADVVVEIPAEDEGGVKVNGSLFISGVPTAHITVEI

SEQ ID NO: 5970 - protein, 280 aa, Enterobacter cloacae
GGSKSKRLPVYFGCTDSSYHSGNIEMVQKRTALKSATSTPDDKIYAILTDRGAELEAAALATGVPVKLTKFVIGDANGQEEVTPDPARTALIHEVYRGDINGAESKGNQVTFTLDVPPETGGYTIREVGILTEAGELYSVARSPDILKPTESNGAVISITFKYILAVSSTSTVTVVVYNDYLTPDAADARYLKVNANLKEIADNGASSQQLARKNIGIDGDIAYRDKENIFTKKNTFGEILYVNKSIVLSGDWAVSWSLAGAYIEAYLVHSKLPDRLFST

SEQ ID NO: 5971 - protein, 118 aa, Enterobacter cloacae
RCRAALLQAILDGVAQHGPYFVIAPGLAMPHGRPEEGVKKTGFALVTLKTPLVFNHEDNDPVDILITMAAVDANTHQEVGIMQIVNLFDDEANFDRLRACRTAQDVLDLIDNATAAAV

SEQ ID NO: 5972 - protein, 220 aa, Enterobacter cloacae
EELKMSLPMLQVALDNQTLSHAYETTRLIAEEVDIIEVGTILCVGEGVRAVRDLKALYPHKIVLADAKIADAGKILSRMCFEANADWVTVICCADINTAKGALDVAKEFNGDVQIELTGFWTWEQAQEWREAGIQQVVYHRSRDAQAAGVAWGEADISAIKRLADMGFKVTVTGGLALEDLPLFKGIPIHVFIAGRSIRDAESPVEAARQFKRSIAQLWG

SEQ ID NO: 5973 - protein, 289 aa, Enterobacter cloacae
GAGMLSKQVPLGIYEKALPAGECWLERLQLAKQLGFDFVEMSLDETDERLARLDWSRDQRLALVSAIAETGVRVPSMCLSAHRRFPLGSEDDAVRAEGLEIMRKAIRFAQDVGIRVIQLAGYDVYYQEANDETRRRFRDGLKESVEMASRAQVTLAMEIMDYPLMNSISKALGYAHYLNNPWFQLYPDIGNLSAWDNDVQMELQAGIGHIVAVHVKDTRPGVFKNVPFGTGVVDFERCFQTLKQTGYCGPYLIEMWSETADDPAAEVAKARDWVCERMARAGLMEAEHA

SEQ ID NO: 5974 - protein, 217 aa, Enterobacter cloacae
TWCQADGRVKPQLAVLYPCKPGLSLSRWPFVIIHPRGVRMFVAELSEAFNGISQRLIPGAVLAIDCAAIYSFAPNAVVWGFMWGTIGQLIAVGILVGCGSSILIIPGFIPMFFSNATIGVFANHFGGWRAALKICLVMGMVEIFGCVWAVKLTGMSAWMGMADWSILAPPMMQGFASVGLVFMAVIILIALAYMFFAGRSLRAEEDAEKQTAEVSAH

SEQ ID NO: 5975 - protein, 105 aa, Enterobacter cloacae
GVSIMTVRILAVCGNGQGSSMIMKMKVDQFLTQSNIDHTVNSCAVGEYKSELNGADIIIASTHIAGEISVSGNKYVVGVRNMLSPADFGPKLLEVIKEHFPQDVK

SEQ ID NO: 5976 - protein, 61 aa, Enterobacter cloacae
GCHMKLRDSLAENNSILLQAEASTWQEAVKLSVDLLVKADVVEPRYYRRFWMAWRSMALTL

SEQ ID NO: 5977 - protein, 189 aa, Enterobacter cloacae
WRRNMLKLKQQVFEANMDLPRYGLVTFTWGNVSAIDREQGLVVIKPSGVAYDAMKADDMVVVDLEGLVVEGKWRPSSDTATHLALYQRYPSLGGIVHTHSTHATAWAQAGLAIPALGTTHADYFFGDIPCTRALTQTEVEGEYELNTGRVIIETLGETEPLHTPGIVVYQHGPFSGRNLHLGPGGPELR

SEQ ID NO: 5978 - protein, 235 aa, Enterobacter cloacae
KSARYSFNKRVRTAIFSYMDCLLSERRMPMQNKKTIHVAVVDSCEFTMIGLQSLGKREPDEKHDVIFHGFTHIEELAMSEQLFDIIIYDPLNTRHFRVTTNDDILCIKQKQVTAKIYIYSLSAGYLKFKHVDGVISKRVSLGDIKALWQILMSQTPQESGRYNVGMTTRLRTPARLSSEEASVLRGYSCNLKTKQIARQLGCNVRLVYFYKNNAMNKLKAVRGPSFYQSIRWILN

SEQ ID NO: 5979 - protein, 253 aa, Enterobacter cloacae
IKNLTVCRLPFVPVSAGTFFSFSEGCSMYTVLPSPLLQRISGLRFQPLVDLHSGQVFAHEVLVEIRNVNLEVLFASLPSRSALQIFFWQANTLLQIPARDGYWLNLPAEHLLDERAIRLLLALRHQQRLTIEIQDPLTITRLSEAEQRHLHATLVRLKEAGWQIWLDDLTRELAEAFARLALPLDGVKIDRSALRERAPLAPFVQEVRTGIAQSILIEGIENSRDLARARTSGAQSGQGFLWPESRTDARVTL

SEQ ID NO: 5980 - protein, 61 aa, Enterobacter cloacae
GGNDARHIKVGVINGAEQDVAEVAKKVAKEKYGLDVELVGFSGSLLPNDATNQGELDANVF

SEQ ID NO: 5981 - protein, 184 aa, Enterobacter cloacae
HRPFLAEDNKAHNYKLVAVANTFVFPMAGYSRKIKSVSELKDGATIAIPNDPTNLGRALLLLQKEKLITLKPDVGLLPTALDITANPKNLQIMELEGAQLPRVLDDPKVDVAIISTTYLQQTGLSPVHDSVFIEDKNSPYVNIVVTREDNKDAENVKEFIQSYQSPEVAKAAETLFNGGAVPGW

SEQ ID NO: 5982 - protein, 79 aa, Enterobacter cloacae
TPHGVTGCLPKLRPSPPPCGWSTGFIAVPRTVGRTPRQRAAPALPRTRSICSALPTSPRVARQSASTLRISPERRRRVT

SEQ ID NO: 5983 - protein, 78 aa, Enterobacter cloacae
FSSRLVKTKLLAQKLKDMALEDVLIITGELDENLFLAARNLHKVDVRDATGIDPVSLIAFDKVVMTADAVKQVEEMLA

SEQ ID NO: 5984 - protein, 272 aa, Enterobacter cloacae
RPKHEAHYAACERSCRSHPEAHQPHYCGCVRSLRLWRLAMGQKVHPNGIRLGIVKPWNSTWFANTKEFADNLDSDFKVRQYLTKELAKASVSRIVIERPAKSIRVTIHTARPGIVIGKKGEDVEKLRKVVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQPEKPAAQPKKQQRKGRK

SEQ ID NO: 5985 - protein, 140 aa, Enterobacter cloacae
GASLMLQPKRTKFRKVHKGRNRGLAQGTDVSFGTFGLKAVGRGRLTARQIEAARRAMTRAVKRQGKIWIRVFPDKPITEKPLEVRMGKGKGNVEYWVALIQPGKVLYEMDGVPEELAREAFGLAAAKLPIKTTFVTKTVM

SEQ ID NO: 5986 - protein, 280 aa, Enterobacter cloacae
VSRRSNTMAVVKCKPTSPGRRHVVKVVNPELHKGKPFAPLLEKNSKSGGRNNNGRITTRHIGGGHKQAYRIVDFKRNKDGIPAVVERLEYDPNRSANIALVLYKDGERRYILAPKGLKAGDQIQSGVDAAIKAGNTLPMRNIPVGSTVHNVEMKPGKGGQLARSAGTYVQIVARDGAYVTLRLRSGEMRKVEADCRATLGEVGNAEHMLRVLGKAGAARWRGVRPTVRGTAMNPVDHPHGGGEGRNFGKHPVTPWGVQTKGKKTRSNKRTDKFIVRRRSK

SEQ ID NO: 5987 - protein, 113 aa, Enterobacter cloacae
EEEMETLAQHRHARSSAQKVRLVADLIRGKKVSQALDILTYTNKKAAVLVKKVLESAIANAEHNDGADIDDLKVAKIFVDEGPSMKRIMPRAKGRADRILKRTSHITVVVSDR

SEQ ID NO: 5988 - protein, 90 aa, Enterobacter cloacae
DFTDSEGGCVMTDKIRTLQGRVVSDKMEKSIVVAIERFVKHPIYGKFIKRTTKLHVHDENNECGIGDKVEIRDAVQVDDYSWTLFACKKK

SEQ ID NO: 5989 - protein, 104 aa, Enterobacter cloacae
GDAGMIREERLLKVLRAPHVSEKASTAMEKTNTIVLKVAKDATKAEIKAAVQKLFEVEVEVVNTLVVKGKVKRHGQRIGRRSDWKKAYVTLKEGQNLDFVGGAE

SEQ ID NO: 5990 - protein, 93 aa, Enterobacter cloacae
AMPRSLKKGPFIDLHLLKKVEKAVESGDKKPLRTWSRRSTIFPNMIGLTIAVHNGRQHVPVFVTDEMVGHKLGEFAPTRTYRGHAADKKAKKK

SEQ ID NO: 5991 - protein, 67 aa, Enterobacter cloacae
DGDVMKAKELREKSVEELNAELLNLLREQFNLRMQAASGQLQQTHLLKQVRRNVARVKTLLTQKAGA

SEQ ID NO: 5992 - protein, 435 aa, Enterobacter cloacae
TLLLPTRRLKLYGESFSDAHLNVLLTKLEKAATNITEKRKSGWDEKDVVLITYADQFSTKGEQALPVFTRFYNEWLSRTFSHVHLLPFYPWSSDDGFSVIDYHEVAPETGTWRDVAELKHSASLMFDFVCNHMSAKSEWFANYLAQKPGYEDFFISVDPETDLSAVTRPRALPLLTPFTLHDGSVRHLWTTFSDDQIDLNFASPQVLIAMVDVLLHYLMEGARYIRLDAVGFMWKIPGTTCIHLEQTHCLIQLFRAITDAVAPGTVIITETNVPHKDNVSYFGDGENEAHMVYQFSLPPLVLHAVHRQDVKTLCQWAGSLALPSTHTTWFNFLASHDGIGLNPLRGILPESEILSLVEKLQHECALVNWKNNPDGTRSPYEINVTYLDALSLRDSSYDERIARFILSHAVLLSFPGVPAVYIQSILGSRNDYEGV

SEQ ID NO: 5993 - protein, 124 aa, Enterobacter cloacae
  UNSURE (32)
RLGYNRAINRKKYTARHVDLELNNKKSIRYQXYSRLSEFIAIRRGESAFHPDSQAIFDAIGEHILKIVRVAENGERMTALFNFSNKMQTIYGQTLFGRELLSGHDISGTELNLNPWQVMWIKEN

SEQ ID NO: 5994 - protein, 441 aa, Enterobacter cloacae
CGLKKTKKDPKMKMPKIVLLSALVSCALLSGCKDDKASQVTIEFMHSSVEQERQAVITKLIEKFEKENPTITVKQVPVEEDAYNTKVITLARTGALPEVIEVSHDYAKVMDKEQLLDRDAIGNAIKAVGEDTFYDGILRVVRTEDGKAWTGVPVSAWLSGVWYHKDALAAAGIEEPHNWEQLLKASQALNDPAKKHYGIALPTAESVMTEQAFSQFALSGGANVFDANGNVKIDTPEMSKALAFYRALAANTMPGSNDVMEIKDAFMNGCAPMAVYSTYILPAVYKDGNPANLGFVVPTEKSSAVYGMITSLTITTGQTEEETQAAEKFVTWMEQAQNASDWVMMSPGAALPLNKLVVGTESWKNNDVIKAFGQLPYELIAQFPNVQVFGAVGDKNFTRMGDVTGSGIISSMVHNVTVGQKDLNATLSNSQKKLTDLISQR

SEQ ID NO: 5995 - protein, 300 aa, Enterobacter cloacae
ERFAKGIMKTLFSGRSDMPFAMLLLAPSLILLGGLVAWPMISNIEISFLRLPLNPRIDAVFVGLDNYIRILGDAAFWHSLWMTFWYTALVVLGSTGLGLAVAIFFNREFRMRKTARSLVILSYVTPSISLVFAWKYMFNNGYGIVNYLGVDLLHLYDQAPLWFDNPGSSFVLVVLFAIWRYFPYAFISFLAILQTIDKSLYEAAEMDGANAWQRFRIVTLPAIMPVLATVVTLRTIWMFYMFADVYLLTTKVDILGVYLYKTAFAFNDLGKAAAISVVLFVIIFAVILLTRKRVNLNGNK

SEQ ID NO: 5996 - protein, 214 aa, Enterobacter cloacae
  UNSURE (175)
  UNSURE (176)
  UNSURE (182)
  UNSURE (203)
TSMATNKRVLGRIGFYLGLAVFLIITLFPFFVMLMTSFKSAKEAISLHPTILPQEWTLQHYIDIFNPLIFPFVDYFRNSMVVSLTSSVIAVFLGTLGAYALSKLRFKGRTTINASFYTVYMFSGILLVVPLFKIITALGIYDTELALIITMVTQTLPTAVFMLRNYFDTIPDEIXXAPMKDXLKRLQIIFRITLPLGNSGLVXVFVHCFMVGVE

SEQ ID NO: 5997 - protein, 152 aa, Enterobacter cloacae
SFEALKEYYPQAKKEDWRLWQAGQRVQIIKRDPKEGGVLRMSTEVVSDKDGTIAVLLGASPGASTAAPIMLHLMEKVFKDKVSSPEWQAKLKTIIPSYGTKLNGNVEATEQELEYTSRVLQLQYVKPQAADAAPKAELKPQAESKPVADIAL

SEQ ID NO: 5998 - protein, 123 aa, Enterobacter cloacae
CTAFVFFYWCLMLWWSRCGDRVILRVNYCYLSVKGGDMVREKLKTPEGRKFLLALLVVFMIAAACVGRATIVGVIEQYNIPLSAWTTSMFVLQSAMIFVYSLVFTVLLAIPLGIFFLGGREKH

SEQ ID NO: 5999 - protein, 137 aa, Enterobacter cloacae
  UNSURE (137)
IPPGLKGEFIMSLEINQIALHQLIKRDEQTLEVVLRDSLLEPTPTVVEMMAELHRVYSAKNKAYGLFSEESELADSLRLQRQGEEDFLAFSRAATGRLRDELAKYPFADGGIVLFCHYRCPAVVFPQELAIREVNRX

SEQ ID NO: 6000 - protein, 624 aa, Enterobacter cloacae
SIPALLRLSVRRSPNLSPRLCSPPLATTRHTKGNEQQFMVTNRQRYREKVSQMVSWGHWFALFNILLAMVLGCRYLFVADWPTTLTGRVYSWMSLVGHFSFLVFATYLLILFPLTFIVMSQRLMRFLSAILATAGMTLLLIDSEVFTRFHLHLNPVVWELVINPDQNETARDWQLMFISVPIILLIEMLFATWSWQKLRSLTRRRHYAKPVAALFFASFIGSHLMYIWADANFYRPITMQRANLPLSYPMTARRFLEKHGLLDAQEYQRRLVEQGNPEAVSVQYPLSDLKYRDMGRGQNVLLITVDGLNYSRYEKQMPALAEFAENNIVFTQHMSSGNSTDAGIFGLFYGISPSYMDGVLSARIPAALITGLNQQGYQLGLFASDGFNSSLYRQALLSDFSLPAAQSQSDDRTADQWIDWLKRYAQEDNRWFSWVAFNGTTLDDSNQKGFARRYSRAAGDVDAQIGRVLTALRDAGKLDNTVVIITAGHGVPLGDEAKGMEWSRPNLHVPLVIHWPGTPAQRINMLTDHKDVMTTLMQRLLHVSTPAIEYSQGQDLFSATRRHNWVTAAGGNTLVVTTPTLSLVLNSNGNYQTYSLEGEKLKDQKPQLSLLLQVLTDEKRFIAN

SEQ ID NO: 6001 - protein, 172 aa, Enterobacter cloacae
QKGMTVKNAPKFAIALIAAACASSSAFASETQKEQPLEKVAPYPQADKGMKRQVIQLPAQQDEANFKVELLIGQTLEVDCNQHRLGGQLESKTLEGWGYDYYVFDKVTSPVSTMMACPDGKKEKKFITAYLGDNSLLRYNSKLPIVVYTPENVDVKYRVWKADETVGQAVVR

SEQ ID NO: 6002 - protein, 76 aa, Enterobacter cloacae
FMPQHSRYSDEHVEQLLSELVNVLEKHKTPTDLSLMVLGNMVTNLINTSVAPAQRQAIAKSFAQALQSSVSDDQAH

SEQ ID NO: 6003 - protein, 485 aa, Enterobacter cloacae
AKTDPYRSRCRICPGDQRRVRFKISLTTRLSLIFSAVMLTVWWLSSFILISTLNGYFDNQDRDFLTGKLQLTEEFLKTETFRNKTDIKSLSEKINDAMVGHNGLFISIKNMENEKIVELYAKNSVVPAVLLNKSGDILDYMIQTEENNTVYRSISRRVAVTPEQGKSKHVIITVATDTGYHTLFMDKLSTWLFWFNIGLVFISVFLGWLTTRIGLKPLREMTSLASSMTVHSLDQRLNPDLAPPEISETMQEFNNMFDRLEGAFRKLSDFSSDIAHELRTPVSNLMMQTQFALAKERDVSHYREILFANLEELKRLSRMTSDMLFLARSEHGLLRLDKHDVDLAAELNELRELFEPLADETGKTITVEGEGVVAGDSDMLRRAFSNLLSNAIKYSPDNTCTAIHLERDRDCVNVMITNTMSGQVPANLERLFDRFYRADSSRFYNTEGAGLGLSITRSIIHAHGGELSAEQQGREIVFKVRLLMD

SEQ ID NO: 6004 - protein, 243 aa, Enterobacter cloacae
  UNSURE (99)
RKRGSGTPEVKTIHVIEMVIEETDVGISWIVRLCALFTTLGALFLYTNKRVLSCLLMTMSGGVALATLAWGGHAVMHDGLHYYLHLLSDLTHLGAAGAXDRGFALVAFAILLMRRNEHNAQSVIVISDSLAKFATAGTVIVVALILTALVNYLYIAEGNLTPLFNSSWGRILLAKTALFVLMLLLAAANRFHLGPRLEVMVREGNYDRSVALMRNSILTEFVVAIIILGAVAWLGMLAPSQVS

SEQ ID NO: 6005 - protein, 236 aa, Enterobacter cloacae
DFYFHISELTMQRILIVEDEQKTGRYLQQGLVEEGYQADLFNNGRDGLGAASKGQYDLIILDVMLPFLDGWQIISALRESGHEEPVLFLTAKDNVRDKVKGLELGADDYLIKPFDFTELVARVRTLLRRARSQAATVCTIADMTVDMVRRTVIRSGKKIHLTGKEYVLLELLLQRTGEVLPRSLISSLVWNMNFDSDTNVIDVAVRRLRSKIDDDFEPKLIHTVRGAGYVLEIREE

SEQ ID NO: 6006 - protein, 138 aa, Enterobacter cloacae
WTLSMSNTLQPRRARASYSMDFKLALVEKSYQPGACVARLARDNGINDNLLFTWRQRYRHLLPDEIQRSIREQDSVIPVVLPDMALSHHAEPHYEPAAPACREAMTCEVTVGGASLRLSGDLSPALLKTLIRETLEKP

SEQ ID NO: 6007 - protein, 409 aa, Enterobacter cloacae
RRYPQVKLNARQVDAAKPKDKPYKLADGGGLYLLIKPNGGKYWRLKYRVAGKEKLLALGVYPEVTLADARAKREEAKRGIAGGIDPMEAKREEKIAREIQLNNTFKDIALEWHSSKLKKWSAGYASDILEAFNKDVFPYIGKKPIAEIKPLELLNVLRRIEGRGATEKARKVRQRCGEVFRYAIVTGRAEYNPAPDLTSAMQGHESNHFPFLTPKQLPDFFNALSGYSGSELVVLAARLLIITGLRPGELRGAFWDEINISKAVWEIPASRMKMRRPHVVPLSRQALTLIGQIQELTGNYPLVFPGRNDPRKTMSEASINQVFKRIGYNGKVTGHGFRHTMSTILHEQGYNTAWIETQLAHVDKNSIRGTYNHAQYLDGRREMLQWYADYMEALENGENVVHGTFGKSA

SEQ ID NO: 6008 - protein, 408 aa, Enterobacter cloacae
TRFGLKWRSFPCGEKNGLMKKLGDYVEYHSQEILLANEQDLLEARRNGLSEAMLDRLALTPARLKGIADDVRQVCNLADPVGQVIDGGVLDSGLRLERRRVPLGVIGVIYEARPNVTVDVASLCLKTGNAAILRGGKETWRTNAATVNVIQQALEECGLPAGAVQAIESPDRALVNEMLRMDKYIDMLIPRGGAGLHKLCREQSTIPVITGGIGVCHIVVDDTAEVEPALKIIVNAKTQRPSTCNTVETLLVHQGIASTFLPALSKQMAESGVTLHADEKAFALLKDGPAKVVPVNAEQYDDEYLSLDLNVKVVADLDDAIAHIREHGTQHSDAILTRTLRNADRFVNEVDSSAVYVNASTRFTDGGQFGLGAEVAVSTQKLHARGPMGLEALTTYKWIGFGDDTIRA

SEQ ID NO: 6009 - protein, 132 aa, Enterobacter cloacae
RQMSMQDPIADMLTRIRNGQAANKVAVTMPSAKLKVAIANVLKEEGFIEDFKVEGDTKPELELTLKYFQGKAVVESIQRVSRPGLRIYKKKDELPKVMAGLGIAVVSTSKGVMTDRAARQAGLGGEIICYVA

SEQ ID NO: 6010 - protein, 181 aa, Enterobacter cloacae
SEERMSRVAKAPVVIPAGVDVKIDGQVITIKGKNGELTRTLNKAVEVKHADNALTFGPRDGFVDGWAQAGTARALLNSMVVGVTEGFTKKLQLVGVGYRAAIKGNAVGLSLGFSHPVEHPLPAGITAECPTQTEIVLKGADKQLIGQVAADLRAYRRPEPYKGKGVRYADEVVRTKEAKKK

SEQ ID NO: 6011 - protein, 120 aa, Enterobacter cloacae
GNTMDKKSARIRRATRARRKLKELGATRLVVHRTPRHIYAQVIAPNGSEVLVAASTVEKAISEQLKYTGNKDAAAAVGKAVAERALEKGISNVSFDRSGFQYHGRVQALADAAREAGLQF

SEQ ID NO: 6012 - protein, 308 aa, Enterobacter cloacae
QMAKQPGLDFQSAKGGFGELKRRLLFVIGALIVFRIGSFIPIPGIDAAVLAKLLEQQRGTIIEMFNMFSGGALSRASIFALGIMPYISASIIIQLLTVVHPALAELKKEGESGRRKISQYTRYGTLVLAIFQSIGIATGLPNMPGMQGLVLNPGFAFYFTAVVSLVTGTMFLMWLGEQITERGIGNGISIIIFAGIVAGLPPAIAHTIEQARQGDLHFLLLLLVAVLVFAVTFFVVFVERGQRRIVVNYAKRQQGRRVYAAQSTHLPLKVNMAGVIPAIFASSIILFPATIASWFGGGLHHTGRKSDA

SEQ ID NO: 6013 - protein, 169 aa, Enterobacter cloacae
RCKMAHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILG

SEQ ID NO: 6014 - protein, 61 aa, Enterobacter cloacae
LTMAKTIKITQTRSAIGRLPKHKATLLGLGLRRIGHTVEREDTPAVRGMVNAVYFMVKVEE

SEQ ID NO: 6015 - protein, 145 aa, Enterobacter cloacae
EMRLNTLSPAEGSKKAGKRLGRGIGSGLGKTGGRGHKGQNSRSGGGVRRGFEGGQMPLYRRLPKFGFTSRKAAITAEIRLSDLAKVEGGVVDLNTLKAANIIGIQIEFAKVILAGEVSTPVTVRGLRVTKGARAAIEAAGGKIEE

SEQ ID NO: 6016 - protein, 90 aa, Enterobacter cloacae
FQLINKLSAAAVSWRRHGVIMAQIIFNREWVVEAELTALTGLSERQIKALRSGPWLEGIHFKRQSMKGGETKRGLLWYNYPRINQLVQEL

SEQ ID NO: 6017 - protein, 462 aa, Enterobacter cloacae
RMLPARNGGGIHERAARVGAQRRTPKRMLAWIRKTMLVSTQWPEIKKQLTKWLDTPPAKREPVDINTETKTDSGATLGGGNQTDRSPDLVHNLATLRIETALGIIAAAMDFDIYSIPVEIMRRAKELESSGGDPRFSAWWTKLRVTPGILDYSRAAIIALIKSAPEDLYLRPVDLRAYINRELVESDHAKPDPKTVATACGTATTEQNDDQTQPAEKDKADLPAVCPGRAAQLDKELNEAFEKRPSVEPQASDQPQIENLGGGVFSVEALINPPSSNEVEKQEVPPALTDREIEIAHALNDLIAGRTRIMDKEEAEGVVTTTGHSVSHVIPLLLADISTAEFCLSPDFSDEEIHDVATTILDSWSDDLCVRQKIALDAIVEYRRPAPPKAVVLDPPFITAKPKKAAEPVPETHTAAPLNYRQQLILAAMQGMCANPSYRCDFEDLPAMAIELADSLINQDGI

SEQ ID NO: 6018 - protein, 463 aa, Enterobacter cloacae
RYTLQTPVNERRRNQTRSPLVQLPSHKSVSAGAVMSFPTGVEIHNGKIRISFTYRGKRCREVLKGWVNTPANIIKAGNLRALIVSEIQMGEFDYSRRFPESKAVQKFTSTRVAYTWGDLNELWLAAKEEDVSRNTMTRLLAQLRTINRIVGENTLIVDITHSDMLRYRKELLRGESFYAEGNKRKKTGRSVNTVNDYISVVCQMLRFAHRSRFITEKPFEHITKLHKDRKKPDPLQRDEYATMMLAINGQDRNLWQFAMNAGPRHGELAALAWDDVDLESGKVHIQRNRTAQGDFVPPKTKAGDRVITLLAPALDALRAQYALTGHLPETEIVQHFREYGKTEIQKHRFVFLPGLKTKNPGRYFSTQSISDRWDVCVEKAGIRRRAPYQSRHTFACWSLAAGANPSFIASQLGHEDAEMVYRVYSAWIKEFDGEQVELLNQRLGFAPNTPPEGKIIKINELNQ

SEQ ID NO: 6019 - protein, 173 aa, Enterobacter cloacae
HFDWFASHSRGENVCRILLTGWFMSANTEAQGSGRGLEAMKWVVVAVLLIVAIVGNYLYRDMMLPLRALAVVILIAAAGGVALLTTKGKATVAFAREARTEVRKVIWPTRQETLHTTLIVAAVNRCNVTDPVGTGWYSGSPGILYHWPEVLRCLKPLKSAGTSFRRFPVLKAA

SEQ ID NO: 6020 - protein, 406 aa, Enterobacter cloacae
YHRFIRVLEGQSMSKEKFERTKPHVNVGTIGHVDHGKTTLTAAITTVLAKTYGGAARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYNFPGDDTPIVRGSALKALEGEAEWEEKIIELAGYLDSYIPEPERAIDKPFLLPIEDVFSISGRGTVVTGRVERGIIKVGEEVEIVGIKETAKSTCTGVEMFRKLLDEGRAGENVGVLLRGIKREEIERGQVLAKPGSIKPHTKFESEVYILSKDEGGRHTPFFKGYRPQFYFRTTDVTGTIELPEGVEMVMPGDNIKMVVTLIHPIAMDDGLRFAIREGGRTVGAGVVAKVLG

SEQ ID NO: 6021 - protein, 184 aa, Enterobacter cloacae
GSEMSEAPKKRWYVVQAFSGFEGRVATSLREHIKLHNMEELFGEVMVPTEEVVEIRGGQRRKSERKFFPGYVLVQMVMNDASWHLVRSVPRVMGFIGGTSDRPAPISDKEVDAIMNRLQQVGDKPRPKTLFEPGEMVRVNDGPFADFNGVVEEVDYEKSRLKVSVSIFGRATPVELDFAQVEKA

SEQ ID NO: 6022 - protein, 102 aa, Enterobacter cloacae
TPGLRSSNGGPVVLFTQEDVMVTIRLARHGAKKRPFYQVVVTDSRNARNGRFIERVGFFNPLAAGAEEETRLDLDRIAHWVGQGVTVSDRVATLIKAANKAA

SEQ ID NO: 6023 - protein, 184 aa, Enterobacter cloacae
SVTVVMMSNKAPVEPIVLGKMGSCYGIRGWLRVFSSTEDADSIFDYQPWFIQKAGKWEEVELESWRHHNQDIIIKLKGIDDRDAANALTNCEIVVDSSQLPQLEEGDYYWKDLMGCQVVTTEGYSLGKVIDMMETGSNDVLVIKANLKDAFGIKERLVPFLDGQVIKKVDLTTQTIEVDWDPGF

SEQ ID NO: 6024 - protein, 146 aa, Enterobacter cloacae
VEAQNRERDGVLRIKAEMENLRRRTELDVEKAHKFALEKFVNELLPVIDSLDRALEVADKANPDNAAMIEGIELTLKSMLDVVRKFGVEVIADTDVPLDPNVHQAIAMVESEDVAAGNVLGVMQKGYTLNGRTIRAAMVTVAKAKA

SEQ ID NO: 6025 - protein, 462 aa, Enterobacter cloacae
  UNSURE (101)
  UNSURE (105)
RFYPRRETMFDNLTDRLSRTLRNISGRGRLTEENIKETLREVRMALLEADVALPVVRDFINRVKEKAVGHEVNKSLTPGQEFVKIVRNELFSAMGEENQVXNLAXQPPAVVLMAGLQGAGKTTSVGKLGKFLREKHKKKVLVVSADVYRPAAIKQLETLAEQVGVDFFPSDVAQKPVDIVNAALKEAKLKFYDVLLVDTAGRLHVDEAMMDEIKQVHASINPVETLFVVDAMTGQDAANTAKAFNEALPLTGVVLTKVDGDARGGAALSIRHITGKPIKFLGVGEKTEALEPFHPDRIASRILGMGDVLSLIEDIESKVDRAQAEKLASKLKKGDGFDLTDFLEQLRQMKNMGGMASLMGKLPGMGQIPDNVKSQMDDKVLVRMEAIINSMTLKERAKPEIIKGSRKRRIAAGCGMHVQDVNRLLKQFDDMQRMMRKMKKAGMAEDDARHEKHDAAPFSLGE

SEQ ID NO: 6026 - protein, 261 aa, Enterobacter cloacae
TVKDGAMWIGIISLFPEMFRAITDYGVTGRAVKNGLLSIQSWSPRDFTHDRHRTVDDRPYGGGPGMLMMVQPLRDAIHTAKAAAGEGAKVIYLSPQGRKLDQAGVSELATNQKLILVCGRYEGIDERVIQTEIDEEWSIGDYVLSGGELPAMTLIDSVARFIPGVLGHEASATEDSFADGVLDCPHYTRPEVLEGMEVPAVLLSGNHADIRRWRLKQSLGRTWLRRPELLENLALTEEQAKLLAEFKTEHAHQQHEHDGKA

SEQ ID NO: 6027 - protein, 295 aa, Enterobacter cloacae
HEGAFVVMQRLEQASRNVILLLFLIKTTVDAYMPVFALIALVAYSVSLALIIPGLLQKNSGWRRMAILSAVIALISHAFALESRIIPGDGSVQNLSVLNVGSLVSLMICTVMTIVASKNRGWLLLPIVYAFALINLALATFMPNEFITHLEATPGMLVHIGLSLFAYATLIIAALYAMQLAWIDYQLKNKKLAFNHEMPPLMVIERKMFHITQVGVVLLTLTLCTGLFYMKNLFSVENIDKAVLSIIAWFVYIVLLWGHYHEGWRGRRVVWFNVAGAGILTLAYFGSRFIQQFAG

SEQ ID NO: 6028 - protein, 433 aa, Enterobacter cloacae
QKEFPLEHISTTTLIVILVIMVVISAYFSGSETGMMTLNRYRLRHRAKQGNRAARRVEKLLRKPDRLISLVLIGNNLVNILASALGTIVGMRLYGNAGVAIATGVLTFVVLVFAEVLPKTIAALYPEKVAYPSSFLLAPLLILMMPLVWLLNMVTRVLMRMVGIKADVTISSALSKDELRTIVNESRSQISRRNQDMLLSVLDLEKVSVDDIMVPRNEIVGIDINDDWKAIVRQLTHSPHGRIVLYRDSLDDAISMLRVREAYRLMTEKNEFTKEVMLRAADEIYYVPEGTPLSTQLVKFQRNKKKVGLVVDEYGDIQGLVTVEDILEEIVGDFTTSMSPSLAEEVTPQNDGSVLIDGSANIREINKAFNWHLPEDEARTMNGMILEALEEIPATGTRVRIEQYDIDILDVQDNMIKQVKVLPVKPLRESIAE

SEQ ID NO: 6029 - protein, 364 aa, Enterobacter cloacae
RPRWGEKIKRFSDLIIKESRHHMAVAKKITINDVALAAGVSVSTVSLVLSGKGRISPATGQRVNEAVEQLGFVRNRQASALRGGQSGVIGLIVRDLASPFYAELTAGLTEALEAQGRMVFLLHGGREPEQLLSRLDLLLTQGVDGVIVAGASGVGSELCERAAQKGVPLVFASRASYLDEADTLRPDNMQAAQMLTEHLIHRGHQRIAWLGGKSSSLTRAERVGGYCSTLIKYGLPFHSEWVVECESSQKKAAEAIGTLLRNSPTISAVICYNDVIAMGAWFGLIRAGRQSGEGGVETFFGHQVALGAFADVGENALDDLPIVWATTPAREMGYTLAERIMQRIENTDVQAGHQIVAARLLTVK

SEQ ID NO: 6030 - protein, 230 aa, Enterobacter cloacae
ISFYPLRSRFMTTKAAQKISLWEFFQQLGKTFMLPVALLSFCGIMLGIGSSLSSHDVITLIPFLGNPVLQAIFIWMSKVGSFAFSFLPVMFCIAIPLGLARENKGVAAFAGFVGYAVMNLAVNFWLTAKGILPTTDAAVVKANNIQSVIGIQSIDTGILGAVIAGVIIWMLHERFHNIRLPDALAFFGGTRFVPIITLVVMGLFGLIIPLIWPIFAMGDHRDWPHYQRRG

SEQ ID NO: 6031 - protein, 200 aa, Enterobacter cloacae
GGFTLRSTVMFDFSTVVDRHGTWCTQWDYVADRFGAADLLPFTISDMDFATAPCITDALHQRINHGVFGYSRWKNDEFLAAVAHWFRQRFNSQIDTETVVYGPSVIYMVSELIRLWSSPGDGVVVHTPAYDAFYKAIEGNQRTVVSVPMQKTAHGWEGDMASLETALSKPENKVLLLCYPQNPTGKIWTREALNTMGGPV

SEQ ID NO: 6032 - protein, 330 aa, Enterobacter cloacae
FGRFLPWGITGIGRIINGAGDFGPMIFGTGERLLLPFGLQHILVALIRFTEAGGTMDVCGHSVSGALTIFQAQLSCPTTHGFSESATRFLSQGKMPAFLGGLPGAALAMYHCARPENRHKIKGLLISGVIACVVGGTTEPIEFLFLFVAPVLYLIHAVLTGLGFTVMAVLGVTIGNTDGNVIDFVVFGILHGLSTKWYLVPVVAAIWFAVYYGIFRFAITRFNLKTPGRDTDTATSVEQAVAGTVGKSGYNTPAILAALGGADNITSLDNCITRLRLSVADMSKVDTNALKANRAIGVVQLNQHNLQVVIGPQVQSVKDELATLMRTVEA

SEQ ID NO: 6033 - protein, 344 aa, Enterobacter cloacae
LSARGGTMTQPLAGKHILIVEDEPVFRSLLDSWLSSLGATTSLAEDGVEALEKMASMAPDLMICDLEMPRMDGLMLVENLRNEGYQTPILVISATENMADIAKALRLGVQDILLKPVKDLNRLRETVLACLYPNMFNSRVEEEERLFQDWDALVSNPLAAAKLLQELQPPVQQNISHCRVNYRQLVAADQPGLVLDIAPLSDSDLAFYCLDVTRAGDNGVLAALLLRALFNGLLQEQLSHQGQRLPELGSLLKQVNQLFRQANLPGQFPLLVGYYHSGLNNLILVSAGLNATLNTGEHHIQVSNGVPLGTLGNTYLNQISHRCTSWQCQIWGAGGRLRLMLSTE

SEQ ID NO: 6034 - protein, 317 aa, Enterobacter cloacae
AGALTLCRESRGSKTGLMRKVKIGLALGSGAARGWSHIGVINTLNQMGIDVDIVAGCSIGSLVGSAYACGKLPELESWVRSFSYWDVLRLMDLSWQRGGLLRGERVFNQFRKIMPLADFSHCQMPFGAVATNLSTGRELWLTEGDIHLAVRASCSMPGLMAPVPHNGYWLVDGGVVNPVPVSLTRAMGADIVIAVDLQHDAHLMQQDLMPVNLQSDDAEEEKLAWHARLRGRIGRLAARRAVTAPNAIEIMTTSIQILENRLKRNRMAGDPPDILIQPYCPQISTLDFHRAEAAIAAGSLAVEKKIDELLPFVRTAR

SEQ ID NO: 6035 - protein, 279 aa, Enterobacter cloacae
CCPRSKQSDFIFQIALPVFLLAVLLSLQVSCVFVLIDRQRVLFRPVLVAETVYSTRYSMHKSSKLEQFRRISMAALNSKVRKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGDEPVAVILPDVILDEYESDLSQENLAEMIKRFDETGSSQIMVEPVDDVTAYGVVDCKGVDLQPGESVPIVVFTTGADGAG

SEQ ID NO: 6036 - protein, 296 aa, Enterobacter cloacae
CLTTQTSQIHKQDFPAMQSLQRKVLRTICPDQKGLIARITNICYKHELNIVQNNEFVDHRTGRFFMRTELEGIFNDTTLLADLDSALPEGSVRELNPAGRRRIVILVTKEAHCLGDLLMKANYGGLDVEIAAVIGNHETLRTLVERFDIPFELVSHEGHTREEHDNLMAAAIEAHNPDYVVLAKYMRVLTPSFVARFPNKIINIHHSFLPAFIGARPYHQAYERGVKIIGATAHYVNDNLDEGPIIMQDVIHVDHTYTAEDMMRAGRDVEKNVLSRALYQVLAQRVFVYGNRTIIL

SEQ ID NO: 6037 - protein, 164 aa, Enterobacter cloacae
RLIFCSRKRIVSQLCPCGSALEYSLCCQRYLSGKQVAPDPSHLMRSRYTAFVIKNADYLIKTWHPSCHAADFRQEIEAGFANTVWQGLTVFEAAPGRDANEGYVSFVARFSEQNKPGAIIERSRFLKDSGQWYYIDGTRPQFGRNDPCPCGSGKKFKKCCGSNA

SEQ ID NO: 6038 - protein, 73 aa, Enterobacter cloacae
GYTRATMAHTKRSDLARASGPHKVRRSPDWSLQLDSMKSESLVIVDQNATVNTFPGLVHTARHTMGVGCKRSR

SEQ ID NO: 6039 - protein, 62 aa, Enterobacter cloacae
ESGPCLSSSVAGHPLRPARDRRLGEPLPHLLANPIWAHPMARGPKVPLFGLATLCGISYRFQ

SEQ ID NO: 6040 - protein, 214 aa, Enterobacter cloacae
VSQQVSTVLNKLSRLLEQAGISLTDHQKNQLVAYVDMLNKWNKAYNLTSVRDPNEMLIRHILDSIVVAPYLNGERFIDVGTGPGLPGVPLSIVRPESHFTLLDSLGKRVRFLRQVQHELKLENITPVQSRVEEFPAEPPFDGVISRAFASLNDMVSWCKHLPAEKGRFYALKGQLPGDEIEQLPDGFAVESIEKLQIPQLEGERHLVIIKPNTF

SEQ ID NO: 6041 - protein, 136 aa, Enterobacter cloacae
QRVKGIMASENMTPQDYIGHHLNNLQLDLRTFSLVDPHNPPATFWTINIDSMFFSVVLGLLFLAMFRSVAKKATSGVPGKFQTFIEMIIGFVHGSVKELYHGKSKLIAPLALNVFVWVFLMTLMDLLPIHFLPWDR

SEQ ID NO: 6042 - protein, 648 aa, Enterobacter cloacae
NPRPGLQSIFIPLYARQTTMFYQDPFDVIIIGGGHAGTEAAMAAARMGQQTLLLTHNIDTLGQMSCNPAIGGIGKGHLVKEVDALGGLMAKAIDHAGIQFRILNASKGPAVRATRAQADRVLYRQAVRTALENQPNLMIFQQAVEDLIVENDRVVGAVTQMGLKFRAKAVVLTVGTFLDGKIHIGLDNYSGGRAGDPPSIPLSRRLRELPLRVSRLKTGTPPRIDARTIDFSVLAQQHGDNPMPVFSFMGNAAQHPQQVPCYITHTNEKTHDVIRNNLDRSPMYAGVIEGIGPRYCPSIEDKVMRFADRNQHQIFLEPEGLTSNEIYPNGISTSLPFDVQMQIVRSMQGMENAKIVRPGYAIEYDFFDPRDLKPTLESKFIQGLFFAGQINGTTGYEEAAAQGLLAGLNAARFSAEKEGWAPARSQAYLGVLVDDLCTLGTKEPYRMFTSRAEYRLMLREDNADLRLTEVGRELGLVDDERWARFNEKLERIEQERQRLKTTWVNPQAETAAEVNAHLTAPLSREASGEDLLRRPEVTYENLVKLTAFAPGLEDAEAAEQVEIQVKYEGYIARQQDEIEKQQRNENTLLPEMLDYRQVTGLSNEVIAKLNDHKPVSIGQASRISGVTPAAISILLVWLKKQGMLRRSA

SEQ ID NO: 6043 - protein, 151 aa, Enterobacter cloacae
CLTLSLKGRFIRHAAYLEGSRSKNVMSVSLLSRNVARKLLFIQFLAVIASGLLFSLKDPFWGISAACGGLAVVLPNVLFMIFAWRHQAHTPAKGRVAWSFALGEVCKVLLTFALLVMALAVLKVVFMPLIATWVLVLVVQVLAPAVINNKG

SEQ ID NO: 6044 - protein, 255 aa, Enterobacter cloacae
RIPFPTCNNDYSGSVFAEPVFKVAIMLNAILLAGLLLSTGHSWANIVINGTRVLYPENNKEVIVQLMNTGDAPALVQSWIDDGDINSTPETANVPFLLSPPVIKVNEHNGQQLRIKKLPSSLPADRESVFFLNVLDIPPRPENLQNQNTVQLAIKSRIKLFYRPAALKGTLDDAVAKLTLAAEGDRFRITNNSPFHITVANISLGKTKLLQESPMVSPFGQLTVAAKNTVKRGQTFQLMYVDDLGAYKTRTFTSQ

SEQ ID NO: 6045 - protein, 835 aa, Enterobacter cloacae
SERLTMKMKQNRLCLLAVCTLLLSHKSGAVSFDPSLLAGASGESDLSRFSENNAMPAGSQEMDIYVNGSWKGRYTVIYGEQRDDIRIAWKDARSLGINTTSVPAPAIAHGQVQLRDLVQGGEVKTDTSTLSLALTVPQAAVLRTEEGYIARQFWDEGIPALMLSWNTTWYNTRAKGAAKDTNDDFYAGLDSGANLFGWQFRDSSAWRKTASGESSWQNNTRYLRRPLASLKSNLTLGDFYIPGDLFDSLRVRGVSLASDMKMRPNSQQGFSPVVHGVARTNALVKVIQNGNVIYQENVPPGQFTLDSIQPTGSAGDLLVVVREADGSQQSFTVPFSAVPGMLKEGVSQYSVVAGKVHQNTLDAEPAFMQATLRYGFNNLITGYTGTIISDNYQAGLVGTGWNLPFGAVSFDVTHAKTTLQDRTSSGQSYRVSYSKFIDTTATNFTLAAYRYSTKGYYSFSDALYSREGYQRLRAQYDDYEDRFGVAPDMSLSTWDAMRAAQPKNTFTLNLNQRLLNNWGTVFVSGTQRDYWNSQQTTREYQMGYSNAIGRASYTLSASRVRNRDSEEETRLYLSLSLPFSLFDNNAWITSSLTASDSHYEQSNISMSGNALASNRLSYTLSGSNARGGKNAASVNAAYRSNFATLGGSYSESSDYRQTGLSGRGSLVAYPWHVLASNETGTTMTIVDAPKAEGLMVNGDESIMTNRDGVALVHNATRICKNAITLTETENSAGAEVIGNMANVAPYDGAVSYIRFETDKRQSWVLHATRADGKPLPFGTEVLDEHGESVGYVGQASVLYIRAERPPRALNVHLRGGKCEISSPAWGLNSPSSVCH

SEQ ID NO: 6046 - protein, 359 aa, Enterobacter cloacae
LRIIKMLRSFMFLLLTSVSGMSYATCSGSSIVYGTPITIDLSDKLSPATPTWTGSFTTQYSGSFNCTTGNSEFSYTPILSTDSKYATILGFSNNKYMVRAEITNPPANKTLSASGSHTASELNTPFTVRFTLVNQSGTTLTGDTANMSDVLFVSDMSGLSIWEIITWPINQVIKIAQWLFSGFKWPYDNRDMFGQPMIIKYAPKLTTCSFDNAGLTVALPTLGIPQLSASSQPGLTPFSLNMSCQNVGVNGNSDRAIEMFLSSTQLLSTDSSVLIDSSSSAAQGVGLRLIKRDAPQTPVTFSNSTTSRGNATMIFSVAAGAALDEHFTLPMAAYYYVWAPAQVSQGKINTSATLNIIYP

SEQ ID NO: 6047 - protein, 165 aa, Enterobacter cloacae
DLSFNELNNLLNHKGMERGGPHRFTSLCKTLNVRRVLLCPELHYGLLKKVLEMKFELTISQQDELTELKKELPALLMADGQKPSIYSWLRRVMRSGSRARSILSAREWEVLHLIVEGFSTTEIARHRNRSVSTIATQKHNAMKKLNLSNHSELIKYVQTVGKMEE

SEQ ID NO: 6048 - protein, 514 aa, Enterobacter cloacae
NCVAITFPPGWNCAGKCSFRRRASRRSTKKRVVPAGKVFANPRNAAAGSLRQLDPRITAKRPLTFFCYGVGILEGGDLPDTHLGRLMQFKEWGLPVSNRVQLCDSPEAVLAFYHKVEEDRPTLGFDIDGVVIKVNSLALQEQLGFVARAPRWAVAFKFPAQEQMTFVRDVEFQVGRTGAITPVARLEPVQVAGVLVSNATLHNADEIARLGLRIGDKVVIRRAGDVIPQVVNVVESERPADTRAIEFPAHCPVCGSDVERVEGEAVTRCTGGLICGAQRKESLKHFVSRRAMDVDGMGDKIIDQLVEKEYVHTPADLFTLTAGKLTGLDRMGPKSAQNIVNALEAAKNTTFARFLYALGIREVGEATAAGLAAYFGTLDALEKATIDELQKVPDVGIVVATHVFNFFAEESNREVIGKLLEQGIHWPAPVVVNAEEIDSPFAGKTVVLTGSLSQLSRDDAKARLVALGAKVAGSVSKKTDLVIAGEAAGSKLAKAQELGIEIIDEAEMMRLLGE

SEQ ID NO: 6049 - protein, 200 aa, Enterobacter cloacae
WCDMDSIEQQLTELRTTLRHHEYLYHVMDAPEVPDAEYDRLMRELRELEAQHPELITPDSPTQRVGAEPLGAFSQVRHEVPMLSLDNVFDEESFLAFNKRVQDRLKSVDNLSWCCELKLDGLAVSILYENGVMVRAATRGDGTTGEDITTNVRTIRAIPLKLRGDNIPARLELRGEVFLPQAGFEKINEEARRTGGESVC

SEQ ID NO: 6050 - protein, 316 aa, Enterobacter cloacae
IKQMNYSLRQLRVFVTVAQARSFSRAGEIIGLSQSAVSHSVKELETQTGVKLLDRTTREVVLTEAGQQLAMRLERLLDELNSTLRDVGRLGQQLSGTVRVAASQTISAHLIPQCIAESNHRYPDIDFVLHDRPQQWVLESIRQGDVDFGIVIDPGAVSDLECEVVLSEPFLLLCRDDDPLASLPQVAWQALQGANLVLQDYASGSRPLIDAALTAQGVKATIVQEIGHPATLFPMVEAGIGISVLPALALPLPQGSRLTVKRFVPCVERQLMLVRRKNRSLSGAAHACWDVVRMQAERLMEARTRDPLFNETNNQT

SEQ ID NO: 6051 - protein, 339 aa, Enterobacter cloacae
RHLFSGVIMKLFRILDPFTLTLIGVVLLASFFPARGSFVPVIEGLTTAAIALLFFMHGAKLSREAIIAGGSHWRLHLWVMCSTFILFPVLGVLFAWWAPVNVDPALYTGFLYLCILPATVQSAIAFTSLAGGNVAAAVCSASASSLLGIFVSPLLVGLLMNMHGAEGNLEQVGKICLQLLLPFVLGHLSRPWIGEFVAKHKKWIGKTDQSSILLVVYTAFSEAVVNGIWHRVGAGSLLFIVVVSIVLLAIVIAVNVFVARKCGFNKADEITIVFCGSKKSLANGIPMANILFPTSVIGMMVLPLMIFHQIQLMVCAVLARRYKAQTEKLAQEETHAAKV

SEQ ID NO: 6052 - protein, 528 aa, Enterobacter cloacae
LSSGISGITTSMLTRYFSSNRKILFISFLTGLFTALLLGALQFYWSYHKRDVRFDTLITDLSVYMESYFDELKMSIDTLQPLTLNSCEEVSAALTSRAAFSINVRAFLLVRDKQAFCSSATGPMNTPMEKLIPQLHISKPVDIALLPGTPMLPDKPAIAIWYRNPLVKDGGVFTSVNLNLSPYLLYTSRQDEFAGISIVIGDSALSTQSGMLIQARDLPDVPARSATLKNIPLTVNVYAQAWTTDELLYAVFFGLVCGIAAGLLNFYILTIRLNPGKEILTAIKHDQFYVVYQPVVDAQSLRMTGLEVLMRWKHPVMGEIPPDAFINFAEAQKLIVPLTLHLFDLIIRDAPVLQTVLPPGAKFGINIAPGHLHAESFKEDMRAFLAALPPDHFQIVLEITERDMINHREANQLFEWVHNEGFEITIDDFGTGHSALIYLERFTMDYLKIDRGFVNAIGTETVTSPVLDAVLTLAERLNMITVAEGVETPEQAAWLREHGVNYLQGYWIGRPMPLEQFRTWQPDITLGE

SEQ ID NO: 6053 - protein, 626 aa, Enterobacter cloacae
FHNHGAVPYYSVQPSLSVNKGIRRTMIMRVVLTLLALVSLSSQAQTIKESTAFAVIGEPKYAVNFNHYDYVNPAAPKGGNVTLSATGTFDNFNRFALRGVAAARTESLYDTLFVTSDDEPGSYYPLVAENVRYAEDFSWVEIAINPRARFHDGTPVSARDVAFTFHKFMTEGVPQFRLVYKGTTVKAIAPLTVRIELPEANKENMLSLFSLPVMPESFWKNHKLSDPLSTPPLAGGPYRITDWRMGQYVIYSRVKDYWAATLPVNRGRWNFDTIRYDYYLDDNVAFEAFKAGAFDLRVENSAKNWATRYIGKNFAKGYIVKDEHKNESAQDTRWLAFNIQRPVFSDRRVREAITLAFDFEWMNKALFYGAYSRANSYFQNTEYAARDYPHADELVLLAPLKAELPPEVFTRIFEPPKSDGNGFDRDNLLKASSLLDDAGWVLKNRQRVNAQTGKPLSFELLIASGANDQWVLPFKKNLARLGVTMNIRQVDMAQLTNRKRSRDYDMMQTLWAAQPWPSSDLQISWASGYIDSSYNAPGVKSPVIDALIAKIVAAQGDKNKLLPLGRALDRVLTWNYYMLPMWYMGEDRVARWDKFSLPAVRPVYTLGFDTWWYDVNKAVKLPAERR

SEQ ID NO: 6054 - protein, 277 aa, Enterobacter cloacae
GVTMGAYLIRRLLLVIPTLWAIITINFFIVQIAPGGPVDQAIAAIEFGHAGGMPGGGGEGMGASHARTGVGNISESHYRGGRGLDPEVIAEITHRYGFDKPLHERYCRMLWDYVRFDFGDSLFRSASVLTLIKQSLPVSITLGLWGTLIIYLVSIPLGIRKAVYNGSRFDIWSSTFIIIGYAIPAFLFAVLLIVFFAGGSYFDLFPLRGLVSADFSTLPWYQKITDYFWHITLPVLATVIGGFAALTMLTKNAFLDEIRKQYVVTARAKGVGEKQIG

SEQ ID NO: 6055 - protein, 97 aa, Enterobacter cloacae
HICGSAPLSKRRGPSGLNLPRSTYEQQEMGKSISRTKLRTGDLVLFRAGSTGRHVGIYIGNDQFVHASTSSGVTISSMNEPYWKKRYNEARRVLSRS

SEQ ID NO: 6056 - protein, 503 aa, Enterobacter cloacae
PGRTSTIMELNVPQVAACIINSQDWDVMKKGLSVWPALSTVAYGVFSALFYAFGVHADDDIQFDSNFLRISHPENVDLSAYMNNALPAGRYRADIYLNDKLVMIDDIRISGKDARSQRILLSQATVTGLQLKKSRLCATNAGQWCDLQAVLPESRLKFNGGRQRLDVSIPQAMLQHVARGSVNPVLWDAGIPALMLGYNVNGYRSENSSGEYNNLYAALNGGLNIGAWYFRHNGTLSWQQQNGTQQKKYTVLNSYVQHPLAGIEGNLILGESNTSGQLFDSVSFTGASVASDDRMLPASRRGYAPEIRGVAQTNAKVTIRQNGKVIYETTVSPGAFVINDLYPSGYGGDLNVTVREADGSQHFFDVPYASVAQLLRPGASRYSATAGRLRGDYLSERPAFSEVTYQRGLTNSLTGSGGIQATSFYQAMHAGLAVGTAVGTVSLDTTWSQTQVREKTTRGRKHQVELQQIYSRKPDAVFTGHLAIFDGELSFSDGCHPVTSAAA

SEQ ID NO: 6057 - protein, 199 aa, Enterobacter cloacae
LIRRNNVRKLMKVLVCVFTDNEFFFSAMMELLSSHTLLAEKYTLCKIRSDEIGAWMHTADNNMMIMAGPDMESLVRFFCLEKRWDYLTTRFSASEMQDFLAQKINRQHEVKKNLIRTRTHLKLSKQELNVLSWFMHGLSPYSMSRYYGLSVKTISTFKRRLMDKLYIKSDAELFRVGWTYKMYQNSGHLRGRDENFRMD

SEQ ID NO: 6058 - protein, 402 aa, Enterobacter cloacae
EKKQPGGESIRLSYSKYIPASRTQFSLATWRYSTGNYLSLMDATLLHQQRPDETADGHTGRTRNRVTLTLNQGLPDKWGQLYVTGILQDYWGRKGYDQQYQAGYTLTTGRVNWSLGVNRSRSSGGEFQNIWTLSFNMPLGSASTPLLTGQVSRDGQGHFSEQVALSGSAGERQQFSWNAGASHQYHSGDSGQIGGSWTGPVSTLTANYAQGKAWKSGSVGVSGTAVAHSDGVTFSPWTGNTFALVEAKGAEGAEIPGYAGTRVDGSGYALVPNLMPYQKNAISIDTTSVEDDLDLDSTSQQVIPYAGAVVKVKYRATAGVPVLIKVTRSNGEGVPFSARATDANKNIVGYVGQGSRLYARLAQQNGVVELRWAEGEGARCKMKYSLPSTAGKKLLIFNAICN

SEQ ID NO: 6059 - protein, 386 aa, Enterobacter cloacae
EGEMKISGWISVATFFCLLIFSNAAMAETCSLDSASVFKTASNVSMPLNISSIAVSNDIPDGTIIYQQKYIPGYSSISVNCDESRSWYYVMSLTNTPMPLSSWTGTIISHESWVAEYSWDGYIYETGIPGIGITISMMSVRRPAPGIVGTNCFASKSCTDTGMKARAIIALVKTGPISAGVINAGNFPTMKVALGREATNITLYTLSFTGSLNVTLPTCTTPDFNVSLGKWTTEHFTGKGSSTPWVAANIVLSNCGDFIGSNVSGDMSDGNYWSDNGSSFSSTMQWNTWSITLSPVSSVLDSASGIMSVDTSVPSAATGIGIQISSGDTTSADSHIIDFGNALTGTFNSDGSSSVTIPLSARYIQTEDSVTAGMANGKLVYTISYY

SEQ ID NO: 6060 - protein, 405 aa, Enterobacter cloacae
QVMIKKKGLGFNAITALIMLTTSNCVIAEEYQLPATINNPVVMPVGADGFQNGAAKAIIPGQAGSEQSGAQTNLSEAGNAQGQKPTTDLPTVQLSPASNASPAVSAITGALSNNPSLPGFDAQTRSGAIDSYGRPTGTSSQQNATNATATSKADELYVEARNRYKEVQRVNVPPGGNVVLPVSRGLQNRISTSFKNASVSTSTPAEEASIFVNGGDVFISTNTDKPIGIMLSEDQVPESTYNLTLVPLDVPGAMISVTTSLSPSMQAKRETSLDKQNYEEMLARSQSEELAPTDPKQDDHKQRIIDLLTPVALGEVPSGFSLQQDRLSRIPAPEQSPCNFNMYAKLGQRLVGSRELIDVILVKNDKPYGQIVADQQCMAEGVIASALFDKAYLQPGEETELYIVR

SEQ ID NO: 6061 - protein, 300 aa, Enterobacter cloacae
KSYHRRVKLMIKNNELIHPFDVTSNESGKTYQLTPNSSKSVQPVALLRLSVFTPVGTKENRDRNFEVDASDELSCMEIARSEGYDDIKITGVKLSMSTDFKCWLGIIMAFSKYGFTSEKISLTFNEFAKMCGISSTNINKRTRARFKESLMNLASVVLAFSDSRSGRFTVTHLVQKAMIDPKSDTVELVGDPSMWELYRYDHKTLLSLQVLYILAKKEAAQSLYIYFEAMPAGTLFVNMKRLRERLLLTTPIRTQNQIIRKAMRELESIGYLDYQEVKKGRDIQFQIFKRSPKLALAKQG

SEQ ID NO: 6062 - protein, 262 aa, Enterobacter cloacae
MKMLSGINIPFFKKSKKDENGDLEQSYVKKDESAKGRFLDIKKRFSPQAEASGAGITYSALINRDTKLIRINTVSIAVIGLLVAKILFFTDPVTIVTPPNMNEEITVVGNKASESYKTQWALFFSTLLGNINPTNISFVTAYVLDALSPELQAKTSESLQEQINIMQARGVEQTFKPNDIYFDPKNDMVYVWGTKTTRLVNVPDKTESSKWTYEWVLGMKNGRPRIAYVNQYSGTPNIKKITINGKEQLATLDNPPPSTGNK

SEQ ID NO: 6063 - protein, 213 aa, Enterobacter cloacae
QELRMIDLYYAPTPNGHKITLFLEEAEVDYRIIRVDISKGDQFRPVFLAISPNNKIPAIIDNLPSDGGKPLSLFESGEILLYLAEKTGKLLSGELRERHHTLQWLFWQSSGLGPMLGQNHHFTAYAPQTIPYAIERYQVETQRLYGVLNRRLEKSPWLGGEHYSIADIACWPWINTHERHRIDLATYPAVNNWFERIRTRPATERAMQKIHQI

SEQ ID NO: 6064 - protein, 147 aa, Enterobacter cloacae
SCAPLGAGVLLMYDEVKILTRRRPVMSQHDAIIRIKNLRLRTFIGIKEEEIANRQDIVVNVVIHYPADKARASEDINDALNYRTITKSIIQYVENNRFALLEKLTQDVLDIAREHHWVTYAEVEIDKLHALRYADSVSMTLSWQRQA

SEQ ID NO: 6065 - protein, 170 aa, Enterobacter cloacae
YGVTMATITTTRLNLTPFEPSDWAFFRSLREDPAIMRYMAAITPEKETRRVFAARLMAEHVFVIRLHNDVKPLGDIGLQISAANREEADIGYTVVPAAQGKGIASEALRAVCEYAFNQTGVKAINAYVLADNVGSVRVLEKAGFVRTQVLEKAYEINGVRYDDWVYRLEC

SEQ ID NO: 6066 - protein, 308 aa, Enterobacter cloacae
AGSARRKPGGCMKILLTGGTGLIGRHLIPRLQALHHDITVVTRSPEKARQVLGTGVEIWKGLAERQDLNGFDAVINLAGEPIADKRWTEEQKQRLCSSRWNMTERLVELIRNSETPPSVLISGSATGYYGDLGEVVVTEEEPPHNEFTHKLCAQWERIACGAQSDNTRVCLLRTGVVLAPKGGILGKMLPPFKMGLGGPIGNGRQYLAWIHIDDMVNGILWLLDNDLRGPFNMVSPYPVRNEQFAHALGHALHRPAVLRVPATAIRLLMGESSVLVLGGQRALPKRLEAAGFTFRWYDLEEALGDVVQ

SEQ ID NO: 6067 - protein, 168 aa, Enterobacter cloacae
RCGPMRTFFSPYVMSVYVALAEKGLTFTLKTVDLDSGEHLKPQWQGYALTRRVPVLEIDGFELSESSAIDEYLEDRFAPPEWERIYPHDLQKRARARQIQAWLRSDLVPIRTERSTDVVFAGVKKPALSEEGLSSARKLIETASSLLAQGNPSFHRRRHEGKTYKPGG

SEQ ID NO: 6068 - protein, 239 aa, Enterobacter cloacae
EVLKGVSLEANAGDVISIIGSSGSGKSTFLRCINFLEKPSEGSIVVSGQNINMVRDKDGQLKVADKNQLRLLRTRLTMVFQHFNLWSHMTVLENVMEAPVQVLGLSKQEARERAVKYLAKVGIDERQQIKYPVHLSGGQQQRVSIARALAMEPEVLLFDEPTSALDPELVGEVLRIMQKLAEEGKTMVVVTHEMGFARNVSNHVIFLHQGKIEEQGHPDEVLANPQSPRLQQFLKGSLK

SEQ ID NO: 6069 - protein, 349 aa, Enterobacter cloacae
  UNSURE (336)
HNLLFQTRQDKQTNLIDINFLALPMNLRDDRRIDMRNSMNAFSPAQFRAQFPALADAGIYLDSAATALKPQAVIEATRQFYSLSAGNVHRSQYADAQRLTAQYEAARDQVARLINADSGKNIVWTRGTTEAINMVAQCYARPLLQPGDEIIVSEAEHHANLVPWLMVAEQTGAQVVKLPLGADFLPDVARLPELITPRSRILALGQMSNVTGGCPDLARAIEIAHASGVVVMVDGAQGVVHFPADVQALDIDFYAFSGHKLYGPTGIGALYGKPELLARMTPWLGGGKMITEVTFDGFKTQDVPYRLEAGTPNVAGVIGLSAALEWLAKTDVVQAXSWNRGLATLVEKD

SEQ ID NO: 6070 - protein, 166 aa, Enterobacter cloacae
RRCAGFRRRPRPGITGGLMTSSALAGHPFGTVITEETLKQTFVPLTQWEDKYRQLILLGKQLPALSDELKLQAKEIAGCENRVWLGFSVSGEKLHFFGDSEGRIVRGLLAVLLTAIEGKSAAELLAHSPLALFDELGLRTQLSASRGQGLIALNDAVLDAARQAQA

SEQ ID NO: 6071 - protein, 69 aa, Enterobacter cloacae
FRGRAHSDMVTLLAGYGIALRAGQHCAQPLLAAIGVSGTLRASFAPYNTKSDVDALVSAVDRALELLVD

SEQ ID NO: 6072 - protein, 377 aa, Enterobacter cloacae
GGGTTTSAPGEDNERSWAKYLMTGAMVAILAACSSKPTDRGQQYKDGKLSQPFSLVNQPDAVGAPINAGDFSEQVYQIRKASPRLYGAQNNVYSAVQDWLRAGGDTRNMRQFGIDAWQMEGADNYGNVQFTGYYTPVVQARHTRQGEFQYPIYRMPPKRGRLPSRAEIYAGALSENYVLAYSNSLMDNFIMDVQGSGYIDFGDGSPLNFFSYAGKNGHAYRSIGKVLIDRGEVKREDMSMQAIREWGEKHSEAEVRELLEQNPSFVFFKPQNFAPVKGASAVPLIGRASVASDRSIIPAGTTLLAEVPLLDNNGKFNGKYELRLMVALDVGGAIKGQHFDIYQGIGPDAGHRAGWYNHYGRVWVLKTAPGTGNVFSG

SEQ ID NO: 6073 - protein, 270 aa, Enterobacter cloacae
GFMSVVISDAWRQRFGGTARLYGEKALQLFADAHVCVVGIGGVGSWAAEALARTGIGAITLIDMDDVCVTNTNRQIHALRDNVGLAKSEVMAERIRLINPECRVTVIDDFVTADNVAEYMSKGYSYVIDAIDSVRPKAALIAYCRRYKVPLVTTGGAGGQIDPTQIQVADLAKTIQDPLAAKLRERLKSDFNVVKNSKGKLGVDCVFSTEALVYPQADGSVCAMKSTAEGPKRMDCASGFGAATMVTASFGFVAVSHALKKMMAKAERQA

SEQ ID NO: 6074 - protein, 69 aa, Enterobacter cloacae
LLKEIIMKKTAAIISACALTFALSACSGNNYVMHTNDGRSIVSEGKPTTDNDTGMICLHTRRWKIRYCV

SEQ ID NO: 6075 - protein, 153 aa, Enterobacter cloacae
  UNSURE (93)
  UNSURE (135)
  UNSURE (142)
HLLCIDSKTHEFRLPERPRASNLARYFLPPVNRITAMPRANEIKKGMVLNYNGKLLIVKDIDIQAPSARGAATLYKMRFSDVRTGLKVEERFXGDDIVDTVTLTRRYVDFSYIDGNEYVFMDKENYPRISSPKIXSKKSCCXFLKVGCRTCRC

SEQ ID NO: 6076 - protein, 423 aa, Enterobacter cloacae
FFVAILTLPSVYLMTGGVNSASLCYSQRLNMHNTPAAASPKPFDLTSTAFLIVAFLTGIAGALQTRTLSLFLTNEVHARPAMVGFFFTGSAIIGIFVSQFLAGRSDRKGDRKSLIVFCCLLGVFACLLFAWNRNYFILLFVGVFLSSFGSTANPQMFALAREHADHTGREAVMFSSILRAQVSLAWVIGPPLAYALAMGFGFTVMYLSAAVAFVVCGAMVWFFLPSMRKEPKVATGTLEAPRRNRRDALLLFIICTLMWGTNSLYIINMPLFIIDELHLPEKLAGIMMGTAAGLEIPTMLIAGYYAKRFGKRFLMRVAAVAGLLFYVGMLTVHTPALLLALQLLNAIYIGILAGIGMLYFQDLMPGQAGSATTLYTNTTRVGWIIAGSLAGVVAEIWNYHTVFWIALVMCVMTLSCLTRIKDV

SEQ ID NO: 6077 - protein, 331 aa, Enterobacter cloacae
TGAESDWRRHRGRSGGGRIMSRRVATITLNPAYDLVGFCPEIERGEVNLVRTTGLHAAGKGINVAKVLKDLGIDVTVGGFLGKDNQDGFQQLFSELGIANRFQVVQGRTRINVKLTEKDGEVTDLNFSGFEVTPADWERFVADSLSWLGQFDMVCVSGSLPSGVSPEAFTDWMTRLRSQCPCIIFDSSRDALVAGLKASPWLVKPNRRELEIWAGRKLPELKDVIDAAHALREQGIAHVVISLGAEGALWVNASGEWIAKPPSMEVVSTVGAGDSMVGGLIYGLLMRESSEHTLRLATAVAALAVSQSNVGITDRTQLAAMMARVDLKPFN

SEQ ID NO: 6078 - protein, 388 aa, Enterobacter cloacae
AETIQFQQERRIMFQLSVQDIHPGEQAGNKEEAIRQVAAALVQAGNVADGYVNGMLAREQQTSTFLGNGIAIPHGTTDTRDQVLKTGVQVFQFPQGVLWGEGQVAYVAIGIAASGDEHLGLLRQLTHVLSDDAVAEQLKSATTAEELRALLMGEKQSEALKLDNETLTLDVVASDLVTLQALNAARLKEVGAADSAFVTRAINDKPLNLGQGIWLNDSAEGNLRSAIAVSRAAVAFETDGERAAMLVTVAMTDDQPVSVLKRLGDLLLNNKAEKLLNADAATVLALLTSDDALTDDLLSAEYVVRNEHGLHARPGTMLVNTIKQFESEITVTNLDGSGKPANGRSLMKVVALGVKKGHRLRFTAQGADAEQALKAIGDAIAAGLGEGA

SEQ ID NO: 6079 - protein, 585 aa, Enterobacter cloacae
NLLTNSRRGIMKTLLIIDSGLGQARAYMAKTLLGAAAQKAHLDIIDNPGDAEMAIVLGDKIPADSALNGKKVWLGDINRAVAHPELFLSEAKGHATVYSAPVEAAPVAAVGPKRIVAVTACPTGVAHTFMAAEAIETEAKKRGWWVKVETRGSVGAGNAITPEEVAEADLVIVAADIEVDLAKFAGKPMYRTSTGLALKKTAQEFDKALAEAKPYQATGAAKTATEGKKESAGAYRHLLTGVSYMLPMVVAGGLCIALSFAFGIEAFKEPGTLAAALMQIGGGSAFALMVPVLAGFIAFSIADRPGLTPGLIGGMLAVSTGSGFIGGIIAGFLAGYVAKLISSKLKLPQSMEALKPILIIPLISSLVVGLAMIYLIGKPVAGILEGLTHWLQTMGTANAVLLGAILGGMMCTDMGGPVNKAAYAFGVGLLSTQTYAPMAAIMAAGMVPPLALGLATIIARRKFDKAQQEGGKAALVLGLCFITEGAIPFAARDPMRVLPCCIVGGAVTGAISMAVGAKLMAPHGGLFVLLIPGAITPVLGYLLAIVAGTLVAGLSYAVLKRPEAEVVAKAPSVFSTRRRGSALSQ

SEQ ID NO: 6080 - protein, 831 aa, Enterobacter cloacae
KRWGCHCWRSLVLKLTTLLVPWRAKRKKASRPVLISTGDKDMAQLVTPGITLINTMTNTILGPEEVVAKYGVPPELIIDFLALMGDSSDNIPGVPGVGEKTAQALLQGLGGLDTLYAESDKIAGLTFRGAKTMAGKLADNKEVAYLSYQLATIKTDVKLELTCEQLEVQEPAADELLGLFRKYEFKRWTADVEAGKWLQAKGAKPAAKPKETIVVDAEEQAEEEAIALSFDNYETILEESRLVAWIEKLKKAPVFAFDTETDSLDNITANMVGLSFATEPGVAAYVPVAHDYLDAPEQISRERALELLKPILEYEKALKVGQNLKYDRGILQNYGIELRGIAFDTMLESYILDSVAGRHDMDSLSDRWLKHKTITFEEIAGKGKNQLTFNQIALEEAGRYAAEDADVTLQLHLKMWPKLQKHEGPLNVFRNIEMPLVPVLSRIERNGVKIDPTVLHNHSGELAQRLTELEQKAHELAGEAFNLSSPKQLQTILFEKQGIKPLKKTPGGAPSTSEEVLEELALDYPLPKVILQYRGLAKLKSTYTDKLPLMINPKTGRVHTSYHQAVAATGRLSSTDPNLQNIPVRNEEGRRIRQAFIAPEDYLIVSADYSQIELRIMAHLSRDKGLLTAFAEGKDIHRATAAEVFGLPLESVTNEQRRSAKAINFGLIYGMSAFGLSRQLNIPRKESQKYMDLYFERYPGVLEYMERTRAQAKEKGYVETLDGRRLYLPDIKSSNAARRAGAERAAINAPMQGTAADIIKRAMIAVDAWLEKEKPRVKMIMQVHDELVFEVHKDDLETVSQKIHELMENSMKLDVPLLVEVGSGENWDQAH

SEQ ID NO: 6081 - protein, 85 aa, Enterobacter cloacae
NIMKKPTSAAGAKRPAKARRKTREELNQEARDRKRDKKHRGHAAGSRANGGGAPSASGKRQPAEKILVSAIKTPIQLGRERHPGH

SEQ ID NO: 6082 - protein, 156 aa, Enterobacter cloacae
CFHPSVASFTHKFITGTDIMVQIPENPLILVDGSSYLYRAYHAFPPLTNSAGEPTGAMYGVLNMLRSLILQYHPTHAAVVFDAKGKTFRDELFEHYKSHRPPMPDDLRAQIEPLHAMVKAMGLPLLAVSGVEADDVIGTLAREAEKSKPPGSDQYR

SEQ ID NO: 6083 - protein, 220 aa, Enterobacter cloacae
SPQITIFGDDHVTTWNYQQTHFVTSAPDIRHLPSDTGIEVAFAGRSNAGKSSALNTLTNQKNLARTSKTPGRTQLINLFEVAEGKRLVDLPGYGYAQVPEEMKIKWQRALGEYLEKRMCLKGLVVLMDIRHPLKDLDQQMIDWAVASDIAVLVLLTKADKLASGARKAQVNKVREAVLAFNGDVQVEPFSSLKKQGVDKLRQKLDSWFNDLEPATEAEAE

SEQ ID NO: 6084 - protein, 216 aa, Enterobacter cloacae
TRWIFAGVVKTGETLDNELLDELSHSPEMQQTWESYHLIRDTLRGDTSEVLHFDISARVMAAIENEPVHQTTPLIPEAQPAPHQWQKMPFWHKVRPWASQLTQMGVAACVSLAVIVGVQHYNTQSEANQQPEAPVFNTLPMMGKASPVSLGVPADASASGGQQQQVQEQRRRINAMLQDYELQRRLHSEQLQFEQAQTQQAAVQVPGNQTLGTQSQ

SEQ ID NO: 6085 - protein, 544 aa, Enterobacter cloacae
LFNYMKNIRNFSIIAHIDHGKSTLSDRIIQICGGLSDREMAAQVLDSMDLERERGITIKAQSVTLDYKASDGETYQLNFIDTPGHVDFSYEVSRSLAACEGALLVVDAGQGVEAQTLANCYTAMEMDLEVVPVLNKIDLPAADPERVAEEIEDIVGIDATDAVRCSAKTGVGVPDVLERLVRDIPPPEGDPDAPLQALIIDSWFDNYLGVVSLVRIKNGTMRKGDKIKVMSTGQVYNADRLGIFTPKQVDRTELKCGEVGWLVCAIKDILGAPVGDTLTGARNPADKALPGFKKVKPQVYAGLFPVSSDDYENFRDALGKLSLNDASLFYEPESSTALGFGFRCGFLGLLHMEIIQERLEREYDLDLITTAPTVVYEVETTSKEVIYVDSPSKLPPLNNIQELREPIAECHMLLPQEFLGNVITLCIEKRGVQTNMVYHGNQVALTYEIPMAEVVLDFFDRLKSTSRGYASLDYNFKRFQASNMVRVDVLINGERVDALALITHNDNAPYRGRELVEKMKDLIPRQQFDIASLHTRLAGSALRY

SEQ ID NO: 6086 - protein, 163 aa, Enterobacter cloacae
IQGCAMIKEWATVVSWQDGVALVSCDVKASCSSCASRAGCGSRVLNKLGPQTSHTITVPSAQPLVAGQKVELGIAEGSLLTSAMLVYLSPLAGLFVMGGVFQMLFGTDLAAMCGAALGGVGGFWLAKGVSPRLAAREAWQPVILSVALAPDQLRVETLSSKAR

SEQ ID NO: 6087 - protein, 340 aa, Enterobacter cloacae
AGPNPAGCCAGARKPNFRNAIAVMKQLWFAMSLMAGSLFFSANASADVSSGALLQQMNLASQSLNYELAFISINKQGVESLRYRHARLDNQPLAQLLQMDGPRREVVQRGNEISYFEPGLEPFTLNGDYIVDSLPSLIYTDFKRLAPYYDFISVGRTRIADRLCEVIRVVARDGTRYSYIVWIDAETKLPMRVDLLDRDGETLEQFRVISFDVNSQVGNSMQYLAKASLPPLLSVPAGDSVNFNWVPSWIPQGFSEVSSSRRQLPTIETPVESRLYSDGLFSFSVNINRATANSSEQMLRTGRRTVSTTVRDNAEITIVGELPPPTAKRISDSIKFRAAQ

SEQ ID NO: 6088 - protein, 80 aa, Enterobacter cloacae
RLSLLVGRHLKIYFVFRLQQNAFLHTGLHMRLRKLKLKNFRGYRNSTEIIIDESMTGIVGRNDFGKSTLLEALAIFFETE

SEQ ID NO: 6089 - protein, 271 aa, Enterobacter cloacae
DITSENLDARLERTRVPIELEQLVISFNHMIGKIEDVFTRQANFSADIAHEIRTPITNLVTQTDIALSQDRTQRELEDVLYSSLEEYNRMTKMVSDMLFLAQADNNQLIPDRVMFDLRAEVMKVFEFFEAWAEERNITLKFNGMPCLVEGDPQMFRRAINNLLSNALRYTPEGQAITVSIREQESFFDLVIENPGKPIPEEHLSRLFDRFYRVDPSRQRKGEGSGIGLAIVKSIVEAHHGRVQVESDVHSTRFILSVPRLEKMIPDTQCWE

SEQ ID NO: 6090 - protein, 147 aa, Enterobacter cloacae
PDIWQHLCPLQGHFYQILLQLTGINAKRIFFMKARNTLFAVLMLSLPAISAEHSEMKMTDMSTSASSQEYMAGMKDMHDKMMAAVNESDPDKAFAKGMVAHHEGAIAMAETELKYGKDPKMRKLAQDIIKAQKGEIEQMNKWLDSQK

SEQ ID NO: 6091 - protein, 233 aa, Enterobacter cloacae
FRTPSAGNKDLNDKDVISLSCSKQKPFDIISATYQEGWIALSISGVSGRQEMNIQSPPGEINTSEPVSVMELKTPVVLPRTSLIKKWRVIMKNIVLASLLGFGLISSAWATETVNIHERVNNAQAPAHQMQSAAAPVGIQGTAPRMAGMDQHEQAIIAHETMTNGSADAHQKMVESHQRMMGSQTVSPTGPSKSLAAMNEHERAAVAHEFMNNGQSGPHQAMAEAHRRMLSAG

SEQ ID NO: 6092 - protein, 132 aa, Enterobacter cloacae
LGRVACGLLLLAGCRCCVGFPGGAALRLAVRVRFCRCFAGRLLRALLPLLPSLSVGAGGGLAPFFFSACALPFFLPSSSFPSLPYSVYTIDEHLDMLMVCHHLDPDIAEDVAFAESRIRRETIAAEDVLHDI

SEQ ID NO: 6093 - protein, 255 aa, Enterobacter cloacae
  UNSURE (45)
  UNSURE (46)
  UNSURE (47)
  UNSURE (48)
  UNSURE (49)
  UNSURE (50)
  UNSURE (51)
  UNSURE (52)
  UNSURE (53)
  UNSURE (54)
  UNSURE (55)
  UNSURE (56)
  UNSURE (57)
  UNSURE (58)
RYRTPLPALPRTYQYARPLFLHAGRTGDQRTSETIKRGVRGRKRXXXXXXXXXXXXXXLAAPGSRSMQEWRPARRRRAHRARFVVQTYVGPFEFGLDSVTLLPYSCTESSDMENNLENLTIGVFAKAAGVNVETIRFYQRKGLLREPDKPYGSIRRYGEADVVRVKFVKSAQRLGFSLDEIAELLRLDDGTHCEEASSLAEHKLKDVREKMADLARMETVLSELVCACHARKGNVSCPLIASLQGEAGLARSAMP

SEQ ID NO: 6094 - protein, 117 aa, Enterobacter cloacae
AFIRRTIMENIALIGIDLGKNSFHIHCQDRRGKAVYRKKFTRPKLIEFLATCPATTIAMEACGGSHFMARKLEELGHFPKLISPQFVRPFVNYIKNDFVDAEAICEAASRPSMRFVH

SEQ ID NO: 6095 - protein, 1073 aa, Enterobacter cloacae
  UNSURE (1060)
  UNSURE (1061)
  UNSURE (1062)
  UNSURE (1063)
  UNSURE (1064)
  UNSURE (1065)
  UNSURE (1066)
  UNSURE (1067)
  UNSURE (1068)
  UNSURE (1069)
  UNSURE (1070)
  UNSURE (1071)
  UNSURE (1072)
PKSRIKMYLKSNIGQLMSIITNLRFNRHINVTVLRCPIIYNISYGWKNVTKCPSGREADMPVDFLTTEQTESYGRFTGEPDELQLARYFHLDEADKEFIGKSRGDHNRLGIALQIGCVRFLGTFLTDMNHIPSGVRHFTARQLGIRDITVLAEYGQRENTRREHAALIRQHYQYREFAWPWTFRLTRLLYTRSWISNERPGLLFDLATGWLMQHRIILPGATTLTRLISEVREKATLRLWNKLALIPSAEQRSQLEMLLGPTDCSRLSLLESLKKGPVTISGPAFNEAIERWKTLNDFGLHAENLSTLPAVRLKNLARYAGMTSVFNIARMSPQKRMAVLVAFVLAWETLALDDALDVLDAMLAVIIRDARKIGQKKRLRSLKDLDKSALALASACSYLLKEETPDESIRAEVFSYIPRQKLAEIITLVREIARPSDDNFHEEMVEQYGRVRRFLPHLLNTVKFSSAPAGVTTLNACDYLSREFSSRRQFFDDAPTEIISRSWKRLVINKEKHITRRGYTLCFLSKLQDSLRRRDVYVTGSNRWGDPRARLLQGADWQANRIKVYRSLGHPTDPQEAIKSLGHQLDSRYRQVAARLCENEAVELDVSGPKPRLTISPLASLDEPDSLKRLSKMISDLLPPVDLTELLLEINAHTGFADEFFHASEASARVDDLPVSISAVLMAEACNIGLEPLIRSNVPALTRHRLNWTKANYLRAETITSANARLVDFQATLPLAQIWGGGEVASADGMRFVTPVRTINAGPNRKYFGNNRGITWYNFVSDQYSGFHGIVIPGTLRDSIFVLEGLLEQETGLNPTEIMTDTAGASELVFGLFWLLGYQFSPRLADAGASVFWRMDHDADYGVLNDIARGQSDPRKIVLQWDEMIRTAGSLKLGKVQVSVLVRSLLKSERPSGLTQAIIEVGRINKTLYLLNYIDDEDYRRRILTQLNRGESRHAVARAICHGQKGEIRKRYTDGQEDQLGTLGLVTNAVVLWNTIYMQAALDHLRAQGETLNDEDIARLSPLCHGHINMLGHYSFTLAELVTKGHLRPLKEASEAENVXXXXXXXXXXXXXY

SEQ ID NO: 6096 - protein, 132 aa, Enterobacter cloacae
RDQRAGNIPLSCMAGAHEFRQHGFHARQVGHLLAHVLELVFGQAAGLLAVGAIVEPQQLGNLVQTEPQPLCRFHEFHPNHVRLPIAADAAVRLVRFPQQALALIEADCLHVDPGRLGKNANGQVFQIIFHIA

SEQ ID NO: 6097 - protein, 145 aa, Enterobacter cloacae
RARFFRRTAGSVLRFSACRPKSFRVFQRSIASLNAGPLMVTGPFFSDSSKDRRLQSVGPSSISSCERCSADGISASLFHRRNVAFSLTSEINRVSVVAPGRIIRCCISHPVARSKSRPGRSLLIQLRVYKRRVRRNVQGQANSRY

SEQ ID NO: 6098 - protein, 212 aa, Enterobacter cloacae
IIGHRKTVTLICLLNRKFVIIDMSCPIFDLRYIFMRLFGYARVSTSQQSLDLQVRALKDAGVKANRIFTDKASGSSTDREGLDLLRMKVEEGDVILVKKLDRLGRDTADMIQLIKEFDAQGVAVRFIDDGISTDGDMGQMVVTILSAVAQAERRRILERTNEGRQEAKLKGIKFGGPRQAYRGQERRADASSEGHWCNGNCSSAQYCPLHGL

SEQ ID NO: 6099 - protein, 98 aa, Enterobacter cloacae; identical to SEQ ID NO: 5821

SEQ ID NO: 6100 - protein, 233 aa, Enterobacter cloacae
LRLADNPSIRLQSVQQVFSILNQETEMSYSGERDNFAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKARMNELMAQHTGQPLEQIERDTERDRFLSAPEAVEYGLVDSILTHRN

SEQ ID NO: 6101 - protein, 443 aa, Enterobacter cloacae
EWHLRRHVRHIELKKRFGLMTDKRKDGSGKLLYCSFCGKSQHEVRKLIAGPSVYICDECVDLCNDIIREEIKEVAPHRERSALPTPHEIRHHLDDYVIGQEQAKKVLAVAVYNHYKRLRNGDTSNGVELGKSNILLIGPTGSGKTLLAETLARLLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISHRVETGSGIGFGATVKATSEKPNEGQLLAQVEPEDLIKFGLIPEFIGRLPVVATLNELSEDALIQILKEPKNALTKQYQALFNLEGVELEFRDEALDAIAKKAMARKTGARGLRSIVEAALLDTMYDLPSMEDVEKVVIDESVIGGQTKPLLIYGKPEAQQASGE

SEQ ID NO: 6102 - protein, 564 aa, Enterobacter cloacae
PVYLADTKLRESSMNPERSERIEIPVLPLRDVVVYPHMVIPLFVGREKSIRCLEAAMDHDKKIMLVAQKEASTDEPGVNDLFTVGTVASILQMLKLPDGTVKVLVEGLQRARITTLSDDGEHFSAKAEYLDSPELDEREQEVLVRTAISQFEGYIKLNKKIPPEVLTSLNSIDDPARLADTIAAHMPLKLADKQSVLEMSDVNERLEYLMAMMESEIDLLQVEKRIRNRVKKQMEKSQREYYLNEQMKAIQKELGEMDDAPDENEALKRKIDAAKMPKEAKEKAEAELQKLKMMSPMSAEATVVRGYIEWMVQVPWNARSKVKKDLRQAQEILDTDHYGLERVKDRILEYLAVQSRVNKIKGPILCLVGPPGVGKTSLGQSIAKATGRKYIRMALGGVRDEAEIRGHRRTYIGSMPGKLIQKMAKVGVKNPLFLLDEIDKMSSDMRGDPASALLEVLDPEQNVAFSDHYLEVDYDLSDVMFVATSNSMNIPAPLLDRMEVIRLSGYTEDEKLNIAKQHLLPKQIERNALKANELTVEDSAIVGIIRYYTREAGGLHHGAGRIRP

SEQ ID NO: 6103 - protein, 74 aa, Enterobacter cloacae
ISNGLVWPPMTDSSITTFSTSSIEGRSYIVSSNAASTIERRPRAPVLRAIAFLAIASNASSRNSSSTPSRLNSA

SEQ ID NO: 6104 - protein, 63 aa, Enterobacter cloacae
INASSLSSFRVATTGRRPINSGIKPNLIRSSGSTCASSWPSFGFSDVAFTVAPKPMPEPVSTR

SEQ ID NO: 6105 - protein, 160 aa, Enterobacter cloacae
DDRGGPLHKRGLRPLGALPAHATSVLLNMLLCSRPGKPGFVFCAFYPLFPGERVRVRGSGRTELHIAPGGIDSLRSPCGQPVRYALSLSNWLRQLSNPGRGFSFPAKAYNMRKKSPHFHASSSSNMAVRGGFEPPIRCRIHTFQACSFSHSDTSPYCFAA

SEQ ID NO: 6106 - protein, 372 aa, Enterobacter cloacae
EKTAVVPGSDVNSLWRSRMVASCTGQGKHINRSTRRGGSDSGSDFFTTKFSPSPQQPFSTDVHNGARSRCISSSGNASNGLQGSQPSDVRAHNRADAGACDEYQQLKVLSMGRQKAVIKARREAKRVLRRDSRSHKQREEESVTSLVQMSGVESIGMARDSRDASPIVARNEAQAHYLNAIESKQLIFATGEAGCGKTWISAAKAAEALIHKDVERIIVTRPVLQADEDLGFLPGDISEKFAPYFRPVYDVLVKRLGASFMQYCLRPEIGKVEIAPFAYMRGRTFENAVVILDEAQNVTAAQMKMFLTRLGENVTVIVNGDITQCDLPSGVKSGLSDAMSRFEEDEMIGVVRFTKEDCVRSALCQRTLQAYY

SEQ ID NO: 6107 - protein, 61 aa, Enterobacter cloacae
HRGGLTRCARPAGSLFATLSVCPTGCASCRTPVGGSHSPQRRTTCEKKARIFMRALLQIWR

SEQ ID NO: 6108 - protein, 89 aa, Enterobacter cloacae
RLVAAGLAAGAIRAFHEAGLWNHFQDVAFDLSNVLSTHSLTGTLLEGIFGYQETPSVSEVAMYFIYLVPALILFAMPPRTGSQTSRVAP

SEQ ID NO: 6109 - protein, 384 aa, Enterobacter cloacae
LQHTLKGRVMAIQFRRSALCAGIAALFVSAFAAQAADIPQVKVTVNDKQCEPMTITVNSGKTQFIIQNHSQKALEWEILKGVMVVEERENIAPGFSQKMTANLQPGEYDMTCGLLTNPKGKLIVKGAATADAAKGTALLSLGDAITAYKAYVTKETADLVAGTKAFTDAVKAGDIEKAKSLYAPTRQHYERIEPIAELFSDLDGSIDAREDDYEQKAADPKFTGFHRLEKALFGDNSTRGMEKYAEQLNSDVLELQKRISELAFPPSKVVGGAAGLIEEVAASKISGEEDRYSHTDLWDFQANVDGAQKIVDLLRPQLQKENGELLAKVDANFKKVDAILAKYRTKDGFETYDKLTDADRNALKGPITTLAEDLSLLRGVLGLD

SEQ ID NO: 6110 - protein, 428 aa, Enterobacter cloacae
AMNEHDEYDVAEPSRRRLLKGVGALGGAFALAGGCPVAHAAKPQSAPGTLSPDARMETQPFYGEHQAGILTPQQASMMLVAFDSLASDKADLERLFRLLTTRIAFLTAGGPAPETPNPRLPPMDSGILGAFIAPDNLTITVSVGESLFDDRYGLAKQKPKALQKMTRFPNDSLDAALCHGDLLLQICANTQDTVIHALRDIIKHTPDLLSVRWKREGFISDHAARSKGKETPVNLLGFKDGTANPDSSNTALMNKVVWVTADQGEPAWAVGGSYQAVRIIQFHVEFWDRTPLKEQQTIFGRDKQTGAPLGMKLEHDEPDYARDPNGDVIALDSHIRLANPRTKETQSSLMMRRGYSYSLGVTNSGQLDMGLLFVCYQHDLEKGFLTVQKRLNGEALEEYIKPIGGGYFFALPGARDANAWLAQGLIEA

SEQ ID NO: 6111 - protein, 103 aa, Enterobacter cloacae
LAALALRAACSLRSQSVQLAAPVVEPRSGVLIPRKGVQHAKKKPAFSCELFFKYGGEGGIRTPDTLPYTHFPGVLLQPLGHLTILFCCLTAWGATGRYYRELR

SEQ ID NO: 6112 - protein, 602 aa, Enterobacter cloacae
RRGISSAAFFCSNCPHYFLPGRFKGCHYVRLIRSYAVIRCLRFEESTMSEAEARPSNFIRQIIDEDLASGKHTTVHTRFPPEPNGYLHIGHAKSICLNFGIAQDYQGQCNLRFDDTNPVKEDIEYVESIKNDVQWLGFNWSGDICYSSDYFDQLYAYAVELINKGLAYVDELSADEIREYRGTLTQPGKNSPFRDRSVEENLALFEKMRAGGFEEGKACLRAKIDMASPFIVMRDPVLYRIKFAEHHQTGNKWCIYPMYDFTHCISDALEGITHSLCTLEFQDNRRLYDWVLDNITIPVHPRQYEFSRLNLEYTVMSKRKLNLLVTDKHVEGWDDPRMPTISGLRRRGYTSASIREFCKRIGVTKQDNTIEMASLESCIREDLNENAPRAMAVIDPVKLVIENYPQGGSEQVSMPNHPNKPEMGTRDVPFSGEIWIDRADFREEANKQYKRLVLGKEVRLRNAYVIKAERVEKDAEGNITTIFCTYDAETLSKDPADGRKVKGVIHWVSAQHALPVEIRLYDRLFSVPNPGAAEDFLAVINPESLIIKQGYAEPSLKAAEAGKAFQFEREGYFCLDSRYSTAEKPVFNRTVGLRDTWTKIGE

SEQ ID NO: 6113 - protein, 204 aa, Enterobacter cloacae
  UNSURE (176)
  UNSURE (185)
SMRTFSGKRSALALAIAGVTAMSGLVVAPQAKAAGFIEDSTLTGGIYYWQRERDRKDVTEDKYKTNLSHSTWNANLDFQSGYAADMFGIDIAAFTAIEMAENGDSGHPNEIAFSSSNKAYDEDWSGDKSGISLYKAAAKFKYGPVWARGSYIQPTGQTLLAPHWSFMPGTYQGAEXGANFDYGEXGGVSFSYMWNNEVTSAVAH

SEQ ID NO: 6114 - protein, 666 aa, Enterobacter cloacae
KHSLCASLNKGSRRGNRMNILGFFQRLGRALQLPIAVLPVAALLLRFGQPDLLNVPFIAQAGGAIFDNLALIFAIGVASSWSKDSAGAAALAGAVGYFILTKAMVTINPEINMGVLAGIITGLVGGAVYNRWAGIKLPDFLSFFGGKRFVPIATGFFCLILAAIFGYVWPPVQHAIHADGEWIVSAGAMGAGIFGFINRLLIPTGLHQVLNTIAWFQIGEFTNAAGAVFHGDINRFYAGDGTAGMFMSGFFPIMMFGLPGAALAMYLAAPKARRPMVGGMLLSVAITAFLTGVTEPLEFLFMFLAPLLYLMHAILTGISLFVATLLGIHAGFSFSAGAIDYVWMYNLPAASISVWILMVMGLIFCVIYFVLFSAVVRMFNLKTPGREDAKDDVVTSEANSNTEEGLTQLATTYIAAVGGTDNLKAIDACITRLRLTVGDSARVSDAMCKRLGASGVVKLNKQTIQVIVGAKAESIGDEMKKVVARGPVAAASTDNAPVADAPVAKPQAVPNAVTIAALVSPVTGDVVALEQVPDEAFASKAVGDGVAVKPTDKTVVSPAAGTIVKIFNTNHAFCLETEKGAEIVVHMGIDTVALNGQGFTRLVEEGAEVAAGQPILEMDLDFLNANARSMISPVVCSNIDDFSGLVIQAQGQVVAGQTPLYEIKGK

SEQ ID NO: 6115 - protein, 286 aa, Enterobacter cloacae
NVPEENNGGNCCKKKRRRISPAAKGITLLRSDYLPLISYSGVWPATTCPCAWITRPLKSSMLLHTTGLIMERALAFRKSRSISRIGWPAATSAPSSTRRVKPWPFSATVSIPIWTTISAPFSVSRQNAWLVLKIFTIVPAAGETTVLSVGFTATPSPTALLANASSGTCSSATTSPVTGETSAAMVTAFGTACGFATGASATGALSVEAAATGPRATTFFISSPIDSAFAPTITWMVCLFSFTTPDAPRRLHIASLTRAESPTVRRRRVIQASIAFRLSVPPTAAM

SEQ ID NO: 6116 - protein, 366 aa, Enterobacter cloacae
AGDGGDHPGSAGCADGGSRPFTALLSKINPHTSQQGKDIMKSRAAVAFGPGQPLKIVEIDVAPPKKGEVLIKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKEGDTVAVFGLGGIGLAVIQGAVQAKAGRIIAVDTNPEKFKLAGEMGATDFINPKDYDKPVQEVIVELTDGGVDFSFECIGNVYVMRSALECCHKGWGESIIIGVAGRGSGDQNPSLPSGDRGRMARVGIWRRERPYPAAGHG

SEQ ID NO: 6117 - protein, 103 aa, Enterobacter cloacae
KIQYPPIVSGGRMPHSPEDKKRILTRVRRIRGQVDALERALESGDPCLAILQQIAAVRGAANGLMGEMVEIHLKDELVTGETTPDQRAVRMAEVGHLLRSYLK

SEQ ID NO: 6118 - protein, 103 aa, Enterobacter cloacae
CAQRLSAATKAGARASLSVWPAAGQEIKTRPYHLVTGGVWRGSAFGGVKGRTQLPGMVEDAMVGKIQLDPFITHRLPLEQINEAFDLMHEGKSIRTVIHFGDN

SEQ ID NO: 6119 - protein, 517 aa, Enterobacter cloacae
SFLKCDLSGAFNRNLILRRADDSFTGVFLRILPIRESTVMDNTTSMQAQHKLSFLHHIRLVPLFSSILGGIILLFALSSGLAGYFLLQADNDQQDVTAEIQVRTGLSNSSNHLRTARINMIHAGAASRIAEMEAMKQNIAEAETRIRQSQDGFAAYMKRTIRTPADEALDGDLKARYDAYIAGMQPMLKYAKNGMFEAIINHENETARPLDDAYNAVLLKAIKIRTERANALTAQAHTRTRLGLMFMFGAFGLALALAVITFVVLRRTVINPLQRAATRIENIAKGDLTMPDEPTGRSEIGRLTRDLQTMQHALVTTVGTVRQGAEEIYRGTSEISAGNTDLSSRTEQQAAAIEQTAASMEQLTATVKQNADNAHHASKLAEDASGKASRGGQMVSGVVKTMGNISTSSKKISEITAVINSIAFQTNILALNAAVEAARAGEQGRGFAVVASEVRTLASRSANAAKEIESLINESVSLIDQGSGEVVAAGNTMNEIVEAVKRVTDIMSSARGGSTES

SEQ ID NO: 6120 - protein, 166 aa, Enterobacter cloacae
KDFLLPPNCPQSVFCPQICPRNLLFCVAPSSFESHLFTQFRLISIIATNPFVRLNQRALLFPTNLYFQSDTRLEVSMCGRFAQAQTREEYLAYFADEAVRDIAYDPEPIGRYNVAPGSKVLLLSEHDEQLHLDPVFWGYPPGWWDKAPLINARVETAATSRMFKPL

SEQ ID NO: 6121 - protein, 111 aa, Enterobacter cloacae
QHGRAICFADGWFEWKREEGKKQPYFIHRADGQPIFMAAIGSTPFERGDEAEGFLIVTSAADKGLVDIHDRRPLVLSPEAAREWMRQEVGGKEAEQIAADGVSTRQGEVQR

SEQ ID NO: 6122 - protein, 142 aa, Enterobacter cloacae
NSASQKEIAMTLPSGHPKSRLIKKFMALGPYIREEQCEENRFFFDCLAVCVNVKPAPEKREFWGWWMEMEAQENRFTYSYQFGLFNKDGHWQATSIKDQEVIDRLEHTLKEFHGKARDLLATLDLKLEPADDFSSEAVKLRA

SEQ ID NO: 6123 - protein, 168 aa, Enterobacter cloacae
LRPRPAIKALENIPWVDHTRVGAFGFRFGANVAVRLAYLESSRLKAVACLGPVVHALLSDPARQGSVPEMYLDVLASRLGMHDASDEALRIELNRYSLKTQGLLGRRCPTPMMSGFWKNDPFSPEEESRLITSSSSDGKLLEVPFSPVYQNFDKALKEITRWITQRLC

SEQ ID NO: 6124 - protein, 380 aa, Enterobacter cloacae
LTSFSLIVERQRIMSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNHIVPVINENDAVATAEIKVGDNDNLSALAAILAGADKLLLLTDQQGLFTADPRSNPQAELIKDVHGIDDALRAIAGDSVSGLGTGGMGTKLQAADVACRAGIDTIIAAGSRPGVIGDVMEGISVGTRFHAQASPLENRKRWIFGAPPAGELTVDEGATAAILERGSSLLPKGIKSVTGNFSRGEVIRIRNLEGRDIAHGVSRYNSDALRRIAGHHSQQIDAILGYEYGPVAVHRDDMIIR

SEQ ID NO: 6125 - protein, 359 aa, Enterobacter cloacae
RVFIKSGLKMKKSTLALVVMGVVASASVQAAEVYNKNGNKLDVYGKVKAMHYIRDDDAKDGDQTYVRFGFKGETQINDQLTGYGRWEAEFAGNKAESDSSQKTRLAFAGLKLKDFGSLDYGRNLGALYDVAAYTDMFPEFGGDGLAQTDNFMTKRASGLATYRNTDFFGLVDGLNMTLQYQGKNENRDVKKQNGDGFGTSLSYDFGGSDFSVIGAYASSDRTNEQNLQARGEGKKAEGWATGLKYDANDIYLATIYSETRNMAPISGGFANKAQNFEVVAQYQFDFGLRPSLGYVQSKGKDIEGIGDEDIVKYIDVGATYYFNKNMSAFVDYKINQIDDDNKLGVSSDDIVALGMTYQF

SEQ ID NO: 6126 - protein, 243 aa, Enterobacter cloacae
RKGYPFHKESIVKKALLSALAVTSLFALFGCNNRSETQVLQPTQNEELKPMQQSWRGVLPCADCEGIETSLFLQKDGTWVMNQRYQGAKEPSSFASYGTWARTAEKLVLTDTTGDKTFFRAKGEGMEMLDREGNPIESQFNYTLAPVKATLPATPMAMRGMYFYMADAAIFTDCATGKKVSVANNAQLERDYAVARGNDSKPVLLTVEGHFTLEPNPDSGELVKTLVADKDAKFAAGKDCESK

SEQ ID NO: 6127 - protein, 150 aa, Enterobacter cloacae
SGNSSHGLAARIMIVLSRNVSIPDNELEITAIRAQGAGGQHVNKASTAIHLRFDIRASSLPEYYKESLLAASHHLITSEGVIVIKAQEYRSQELNREAATARLVAVIKELTAVQKSRRATRPTRASKERRLSSKAQKSTVKSLRGKVRHP

SEQ ID NO: 6128 - protein, 187 aa, Enterobacter cloacae
FERSSLMALKATIYKAVVNVADLDRNQFLDASLTLARHPSETQERMMLRLLAWIKYADERLQFTRGLSAEDEPEAWLRNDHLGIDLWIELGLPDERRIKKACTQSAEVALFAYNQRAADIWWQQNKNKCAQFKNLTVWYLDDEQLAQLSAFASRTMALQATIQDGAIWLSDSQNNLEIHLTAWQPAS

SEQ ID NO: 6129 - protein, 60 aa, Enterobacter cloacae
RPTNQDSPPNIPTARKRMQINASKMKANAVLLHTCEVTSGTPGCYRQAVCIGSALNITAK

SEQ ID NO: 6130 - protein, 97 aa, Enterobacter cloacae
ALSAPLIKKSSPCRVSRVWSFTAAASFILSRRITRPMQCAGLRRSAIYGWSLCFTRPWKAAGVPLCVLLVWAEMPEWGSLPPAQPFVPTPSECRWSS

SEQ ID NO: 6131 - protein, 594 aa, Enterobacter cloacae
TTFFVSGWCFSLFQSSKWNRNNMRTSQYLLSTLKETPADAEVISHQLMLRAGMIRKLASGLYTWLPTGVRVLKKVENIVREEMNNAGAIEVLMPVVQPSELWQESGRWEQYGPELLRIADRGDRPFVLGPTHEEVITDLIRNELSSYKQLPLNFFQIQTKFRDEVRPRFGVMRSREFLMKDAYSFHTSQESLQETYDKMYAAYSKIFSRMGLDFRAVQADTGSIGGSASHEFQVLAQSGEDDVIFSDSSDYAANIEFAEALAPKEPRGAATQEMTLVDTPNAKTIAELVEQFTLPIEKTVKTLLVKSAEGSAYPLVALLVRGDHELNEVKAEKLPQVASPLTFATEAEIRAVVNAGPGSLGPVNMPVPVVIDRTVAAMSDFAAGANIDGKHYFGINWDRDVATPEVADIRNVVAGDPSPDGKGTLMIKRGIEVGHIFQLGDKYSRAMNAAVQGEDGRNQVLTMGCYGIGVTRVVAAAIEQNYDERGIVWPDNIAPFQVAILPMNMHKSYRVQELAEKLYAELSAKGIDVLMDDRKERPGVMFADMELIGIPHTIVIGDRNLDSDEIEYKYRRNGEKQMIKTGDILDYLVKAIKG

SEQ ID NO: 6132 - protein, 75 aa, Enterobacter cloacae
VSTLAGGDVNNYCELIRRRYAEIASGDLGYIPDALGCVLNVLNEVASDESLSESVSGTAGFQHAAPDHTVLSPGG

SEQ ID NO: 6133 - protein, 239 aa, Enterobacter cloacae
HYGEMSSFQFEHIGVIRSPYKEKFAVPRQPGLVIHGGGELHLVAPYNQADAVRGLEAFSHLWVVFVFHQTMEGGWRPTVRPPRLGGNARMGVFATRSTFRPNPIGMSLVELKGIRCQRDQVILELGSLDLVDGTPVIDIKPYLPFAEALPDARASYAQDAPQADMPVHFTSEITTQISELEKRYPRLRDFIVEVLAQDPRPAYRKEEEAGKTYAVWLLDFNVRWRVTAAGFEVFALEPR

SEQ ID NO: 6134 - protein, 146 aa, Enterobacter cloacae
ERNWGMKSKIRYVLSGFVVLCAFAGVYKILNNVPVKPDLLDFTGNTFKKTSLFLPCDKSSPSLNIKIADNEKIVINGIASKVTFVEKADPVKSPGFCDDLDLNNSRLVHTASYSLVISETKTGFTLSNFKHLADDESLGGMWFYQK

SEQ ID NO: 6135 - protein, 1226 aa, Enterobacter cloacae
FCSEKQVFVMRKSGLGLALLFSLIAPIKAVYAEAIMISGKLQADLPAVSFDPGPGDFVAYVNSNTITASGAGTACNVTVDDRATSSVDNLVCFFEWLPNTLGLTSNGFILSGVPYTTGDLKLPYKISYFSGSERKKVEIVKGEYSIKSVAPVKPTITGLKSSLNGLVYDGFSFKSYLKDEAIKDIAVSVEPRNYIQYISIGSGSACEVPIGGTSCTIEVGSIKASDTDELLGSRDITITANSKNNYFAPPESKKLVVNWDYRPPVVDHTLWNFTDEAKTIKVGGQDIYTGAKTVAVAVKVPQQETEGEWWLPTAMSLTMTPDGVFKPTTKVTLDDGTEIDFKQSWATPLRRTLQPVSGPQKVGDEYLYIFDLTDLINGSYAATFTVENTSKNSSTYTEPESKLMLSDNPTLMVLKDGQVLTKRAPVYFLNEIIVAAFQGQAGVADIKSVTIDNKVVSLTPTNYKGIYYLPVGDDLAVNSDHEITVVAENLYGKNVNFSTVFTYQPTGFTLKNLEKNVTLYSRVRQYTDLLSQTAGDKCTLFTTEENANAYLAWYGEKSDVTACYPQWNNVPDGLEFYFKGRTPGLTGFFNKTGENLLDYQVYMINGKGSKAVSARNRRTLTTQLPYNPIISYKKNKVIAGINPNTALAYTTGGEAARILAKVVPADVTMIVSQNGSEAVKTSFKNRSSNNDATTFVQRVKVAAAPLWTKNVFDIAVEYSKDPELRTTDTLNVYTVPDFNIRASMEVDDKKTATSLEVPLKVTVGRYNNSTRKSAFDRKTMGEWDVTIYSQKSVYGKDPETGRYKTTYERTALTEALPVNDAGIVETKIKIENMDLGNMRLVGVAKVRSPFSDFEMKRETSAVGIRIYKGEELEGNLSKSLIIGRIPLSTLVSFKSASTANSDALAPTEWQQSSDNGQTWTMLSDMTGKRSVSIKKTEVGKWLYRAKMTNKFTSKISYTDALTVVTYKQPKLSIDVTDILQGSDIPVTLLDNDEPIPAGTAEVLWSEDKVNWVQGDTTYTVASADTLPSTIYARMRYLDSDELAEESSWKETSARLAAAKPKRLSVSVTGVSKVEVGQKVTLEGKFTNPNSKYQNGNNVVEEWKTPDGQTFKGSSLSVTLTEQMLDKQGYAAFEYSAWLADNKENTVSTRRVSVKSWVYKFPEMKISSKLKYDMAPTTLRVALSGIKDGDYPGVTYSREWIYDKENLVITTDVFTTELAGPAPKGMG

SEQ ID NO: 6136 - protein, 159 aa, Enterobacter cloacae
LIIIIKADRMLSRNSLIHGLRRDQLIGVLTISEFPVVMVESHFIQSEVMGIKPVIFNIDELLVSISPISSLKFDWEWAPVDTILIEVIIPPVESDLVSAENDFLRDSGIGHIQCEPGGASIRRTVTFVGGITADNLLYQLRLMCVSALKLLGEELGDEV

SEQ ID NO: 6137 - protein, 198 aa, Enterobacter cloacae
IIRRYVVLSKVTFYMATSDFALKNHNVKAFGQDAALVIEMNNEDVSSSKPSPFSNEIDNYYLTLHVAPRNAKKDYDWGSNRSVLLKLSTNEVMQMASVFLRIMHTLKIDKRKTSHHGHVVYKNISVTPNERGGLLLSAGIVPVDKDGLKPFMHMVPVSQMDCVKIGLYILGYLAQKTPWVSSESIITALRLSEAKNSK

SEQ ID NO: 6138 - protein, 172 aa, Enterobacter cloacae
QFKLLNPLKGVFMAIPAYLWLKDDGGADIKGAVDVQDREGSIEVLGFGHGLHLPTDNMTGKITGTRVHSALVFEKEFDSSSPYLYKAVAKGQTLKSAEFKWYKINDAGQEAEYFNMKLENVKVVSICPMMHDVKNPATEKHNHLESVALRYEKITWKHCDGNIIFSDEWKDR

SEQ ID NO: 6139 - protein, 427 aa, Enterobacter cloacae
ICELNMFALCDVNSFYASCETVFRPDLRGRPVVVLSNNDGCVIARSAEAKAAGITMGEPFFKQKELFRRAGVVCFSSNYELYADMSNRVMTTLEEMSPRVEIYSIDEAFCDLTGVRNCRDLTEFGKEIRATVLKRTHLTVGVGIAQTKTLAKLANHAAKKWQRQTGGVVDLSNIDRQRRLLALVPVEDVWGVGRRISKKLNAMGIKTALDLSEQSTWIIRKHFNVVLERTVRELRGEPCLELEEFAPAKQEIVCSRSFGERVTEYEQMRQAICSYAARGAEKLRGEHQYCRFISAFVKTSPFALNEVYYGNSASMKLLTPTQDSRDIINAAVKCLDKIWKDGHRYQKAGIMLGDFFSQGVAQLNLFDENAPRAGSERLMEVLDHLNAKDGKGTLYFAGQGVQQQWQMKREMLSPRYTTRISDILKVR

SEQ ID NO: 6140 - protein, 157 aa, Enterobacter cloacae
SLSQLKLLYIKTVFEVCNMEFIRPAELREIIALPLFSDLVQCGFPSPAADYVEERIDLNELLVAHPSSTYFVKAAGDSMIEAGISDGDLLVVDSSRTAEHGDIVIAAVEGEFTVKRLQLRPKVQLNPMNSAYSPIVVGSEDTLDVFGVVTFIVKSAS

SEQ ID NO: 6141 - protein, 315 aa, Enterobacter cloacae
RKEFCMNVKPSLDELFERRINFPDFEPQERLARLVGLDEHKDRLSKILGLLVNPYGIQEWAKKYHPDARAAVDTVLRRPPLVVLAGDVGSGKTELAETIGDAVARQEDIDITLYPLSLATRGQGRVGEMTQLVSAAFDYTIEAADKLKNTNGKARGAVLLLIDEADALAQSRENAQMHHEDRAGVNAFIRGIDRIANQKLPAAVLMCTNRLKALDPAVQRRAAEVLTFSRPNDEQRHYLLHSKLTGLGLNSTAIEELVRLTGPRDTNSPGFTFSDITQRLIPSIILTAYPYSAVSVHSALQVVNKMTPTPAFIDR

SEQ ID NO: 6142 - protein, 174 aa, Enterobacter cloacae
NSNLLNNRTICPQVRMHMSGFQEWLLSKATGNYFLYIKRLSANDTGATGGHQVGLYIPSGIVAELFPSIDNTKEQNPSVFLNATYSSHVCSDSEARAIYYNGSFFGKTRNEKRITRWGPGSPLQDPENTGGLSILAFEHEPGSDSKNVDVWVCKNPDEEDIVESILGEIIPGAL

SEQ ID NO: 6143 - protein, 81 aa, Enterobacter cloacae
PKSLLIQLGPNPGTFRRVLNNKKFHLPFPNQKPNEFGSLNTPQLPNGSFPGVPGANTPAGVLSIPLLLPTGDIFPARYELV

SEQ ID NO: 6144 - protein, 104 aa, Enterobacter cloacae
TMICAACRKPAVGAGMTITRSGVMRRAPLAMRLRANSTWAMLEFVFNGMVFLLLGLQLPGQLWKSSAELPAQSRFQNLGNSGIPINRNPCSSNLALILVLSGGF

SEQ ID NO: 6145 - protein, 97 aa, Enterobacter cloacae; identical to SEQ ID NO: 5897

SEQ ID NO: 6146 - protein, 702 aa, Enterobacter cloacae
PERGWEPIMSDSKRTNLHAQENFYRPILEYRSASILLICSVSMLYMGLSSDGLDIAPIVLFTSILLFLLCLYRCKTAAPFLMAHWRVFKRHFMFVSLDSLRVINKSNFFSNERKYRQLVQDYQNKNKDIPERKSYFCDGFEWGPEHADRAYQIANLSSDKREIELPFVFNPIKRHFDAMARKMGGSNAIFAVERREPIFVTEDNWFGHTLITGNVGTGKTVLQRLLSISMLHLGHVVVVIDPKNDAEWRESLMEEAKTLGLPFYKFHPGQPASSVCIDVCNTYTNVSDLTSRLLSLVTVPGEVNPFVQYAKALVSNVISGLSYIEKKPSIYLIHKNMKSHMSIVNLTVKVMESCYARYYGYDVWTEKVKYVANDTLPVRFKRLAEWFTAHFMNYEGSEQIDWLDTVSQLIDYSMSDPEHMAKMTAGIMPVFDMLIEKPLNELLSPNPNSVSSREIVTSEGMFSTGGVLYISLDGLSNPDTAAAISQLIMSDLTSCAGSRYNAQDGDMSANSRISIFVDEAHSAINNPMINLLAQGRAAKIALFICTQTISDFIAAASVETANRITGLCNNYISLRVNDTPTQTLVVENFGKSAISTNMVTYTTGSETSLPHNNFSGSISERKQTTLEESIPKDLLGQVPMFHIVARLQDGRKVVGQIPIAVAEKQMKPNTTLSEMLFKKAGKVTLRQNLDIKNLNKFLRKLH

SEQ ID NO: 6147 - protein, 870 aa, Enterobacter cloacae
RPSTSRLPASGLSSVLSPKSHLKRLFIQHGFGKQLLESGVLFLKRLQALNFRHLHTAILLTPDVKRGIGNGMLAAEFTGGYPSFGFAENTDDLFVGKTLLHGDVLMWLMKTLLTSGCTNQRGAGQRDPIMGLRSNDAAARAISTIKHNFTSININNYNAKPMHIIIVNGEVYLNENAFLDFVLNDFELHKYNFPQGEAGKTVLVESLVQRGYVEPYDDERVVHYFIPGIYSENEISNIFRNGIGKLEFYNLLKLRWIGLIFDSYKIPDSVPGLFSVNANKDFIYIDEQKTVTEYRRPVPGRDVITKITDTVETAVLKVNDLGRSSASIDVDIHSKKNEGSSDDFEKKAESDNEIDNDTQIVKSEGEEAADPVIPDIEESEDESAKDTESHVLVNQLHELLLSAPLSNDYIVCVDAVPYLNIDTTMALLPGLDEKAFSEEPYFQLTFREGSLDGMWIVRDIDDLRLVQLGDNCAGFQLTYHEPRRPTTLKSLFNTSMYQALVINDESSVENSAPRPKQTLELPPPRVNAVEEHSGDVEYHGTDSASATGPLKTEAVEYEHYQHLFEKEDEEHEIIDYTDFSQLSVSRPEVGSCATSSSVHNEKLLSEPSELPELNREQNADPQGTNERSMDVSVGQENSEPDTEGNCPPPAEVVYSQTEAAATSVMASEEPALPPVLEESNGEHAPTDAKGHHLSPALARLFAPTAPVEKQNPKRNRNKSSDKAEVQKPASPVSGHNLNSKVFASTESDQNGEFSLISEGDVTELEFVEIALVLHQILSKMEVAFKRKRKNRFMVSTPNTLYLTQSCVEKFGSQLEAQDLFNKLPQYLVNSGAVINTKCHAFNMPTLLAASDRAKVDIERIINNLKEAGNL

SEQ ID NO: 6148 - protein, 255 aa, Enterobacter cloacae
SSSQHYESFISTGSTMIEIETRQLSEHEIIHAFPAGKGEQPLPTVVFYHGFLSSKLVYSYFAVALAQAGFRVVMPDAPNHGARFTGDEQARLGLFWQTLHGNLTEFAGLRDALLQAGLVEGKRLAVAGASMGGMTALGIMARHPEVTSVACLMGSGYFTSLAKTLFPPQAPQEIETLLSEWDVSHALSQLADRPLLLWHGDADDVVPTGETFRLQQALQREGLDSNLTCLWGAGVRHRITPEALEATVAFFRQHL

SEQ ID NO: 6149 - protein, 252 aa, Enterobacter cloacae
LMTEAQRHQILLELLAQTGFITVEKVIERLGISPATARRDINKLDESGKLKKVRNGAEAISQQRPRWTPMNIHQAQNHDEKVRIARAASQLVNPGESVVINCGSTAFLLGREMCGKPVQIITNYLPLANYLIDQEHESVVIMGGQYNKSQSITLSPQDSENSLYAGHWMFTSGKGLTADGLYKTDMLTAMAEQNMLNVVGKLVVLVDSSKVGERAGMLFSRAEQISMVITGKNANPEILSKLEDQGVTVLRV

SEQ ID NO: 6150 - protein, 76 aa, Enterobacter cloacae
PDPIRQATDVTSGCLAMIPSAVIPPIDAPATASRFPSTSPACKSASRSPANSVRLPCSVCQNSPSRACSSPVKRAP

SEQ ID NO: 6151 - protein, 148 aa, Enterobacter cloacae
MIHNVESWITVSRYFHSKSTSQITLREHSPKTKFADNYTMTIRKRDRFMRRLTALLLVSLLSGCSVLQGTPEPAPPVTDHPQEIRRNQTEGLQRLGTVSAMVRGSPDDAEDAIEAQAVAAKADYYVITMIDETIITGQWYAQGILYRK

SEQ ID NO: 6152 - protein, 110 aa, Enterobacter cloacae
VYSRRIARRIPETREKELTMKRTLALTTLLLSAGLLSTTAQSAEFASADCVTGLNEIGQISVNNITGSPQDVERVVALKADEQGASWYRIVQMQEDHHVNHWRVQAILYA

SEQ ID NO: 6153 - protein, 394 aa, Enterobacter cloacae
  UNSURE (366)
  UNSURE (392)
EGGAMEQTWRWYGPNDPVSLDDVRQAGATGVVTALHHIPNGQVWPVEEIQKRQAQLAEKGLTWSVVESIPVHEDIKTHSGECDTWIANYQQSIRNLAACGIDTVCYNFMPILDWTRTDLEYVMADGSKALRFDQIAFAAFELHILKRPGAEADYTAEEQQQALAWFNAASEADIEKLVRNIIAGLPGAEEGYTLDQFRARLAEYGDIDKNQLRENMAHFLRAIVPVAEEVGVRLAVHPDDPPRPILGLPRIVSTIEDMQWLKETVDSIYNGFTMCTGSYGVRADNDLVRMIETFGDRIHFTHLRATCREENPKTFHEAAHLGGDVNMVAVVDAILSEKVRRKQAGDVRPIPFRPDHGHQMLDDLRXKTNPGYSAIGRLKRMAELPGIQLALXMT

SEQ ID NO: 6154 - protein, 493 aa, Enterobacter cloacae
SGVYYMKTIASTALPAHVQQPRYDREQLRSRIVHFGFGAFHRAHQALLTNRVLNARGGDWGICEISLFSGDVLMRQLRAQDHLFTVLEKGAEGNQPIIIGAVKECLNAKLDSLAAIIEKFCEPQVAIVSLTITEKGYCIDPATGKLDMQNSRILHDLEHPSEPHSAPGILVEALHRRRERGLPAFTVLSCDNIPDNGHVVKNAVLGMAGKRSAELAAWIEAHVSFPGTMVDRIVPAATDASLAEITQELGVEDPCAISCEPFIQWVVEDNFVAGRPEWEVAGVQMVEDVLPWEQMKLRMLNGSHSFLAYLGYLAGYAHINECMQDDSFREAARRLMLNEQAPTLRITNVDLTAYADSLLNRFANPALQHRTWQIAMDGSQKLPQRMLDGIRVHLELNTAWPLLALGVAGWMRYVSGTDEQGNAIDVRDPLSDKFQAIVATSSDAERVSALLTLNEIFGDDLPQNPVFVEAITGAYQRLVRLGAHQAVIETLKI

SEQ ID NO: 6155 - protein, 341 aa, Enterobacter cloacae
VVVTTSQLFIGAHVTKTNLITGFLGSGKTTSILHLLANKDPAEKWAVLVNEFGEVGIDGALLADSGAMVKEIPGGCMCCVNGLPMQVGLNTLLRQGKPDRLPIEPTGMGHPKQILDLLTAPVYEPWLELRATLCLLDPRQLLDEKTINNDNFRDQLASADIIVANKSDRATAESQAAFESWWQQAGGGRQYVQTTQGNIDGALLDLPRLNQTQLPASAEHSHSHGTKQGLAALSLPEHQRWRRNLNSGQGHQACGWIFDADTVFDTIGILEWARLAPVERVKGIMRTPDGLVRINRQGEDFFIETQNVAPPDSRIELISAVNTDWNALQSSLLKLRLSLGG

SEQ ID NO: 6156 - protein, 244 aa, Enterobacter cloacae
FHTLLKTMTTRLPAILLLNAAGLALFFSWYIPADHGFWFPLDSGLFHFFNQALAKSEAFLWLVAITNNRAFDGCSLLAMGCLMLSFWLKEDKTGRRRILIIGLVMLLTAVIINQLAQHLMPVKRASPSLFFPNINRVSELLHIPTKDASKDSFPGDHGMMLLIFAGFMLRYFGKKAFAIALVIVVVFAFPRVMIGAHWLTDIAVGSLTAVLIGLPWVLMTPLSDRVIGIFDRYLPGKFKQVRNK

SEQ ID NO: 6157 - protein, 122 aa, Enterobacter cloacae
EYARDGQIVLNIAPRAVGNLELANDEVRFNARFGGVPRQVSVPLAAVLAIYARENGAGTMFEPEAAYDEEVASLNDEEGGVGTESETVMSVIDGDKPDREDDNDPDDDPPPRGGRPALRVVK

SEQ ID NO: 6158 - protein, 811 aa, Enterobacter cloacae
ITLNRDMTVCKKSRLALCVRAILCGTLPLVVLASPSLYAREVTFDTGIIQSRGLSPDLNHYFAQAPRFLPGTHSVQVKVNGKDRGTAAARFNEDGELCIDKDFLDFAGIMPVPLKAGEACHDIRSDYAQAVVNALPNQDAVELYLPQEAINSLTSNIKHFQQGGTAGLLNYSLFSTRNEYGDSDNSRYSQASLEAGFNTMDWSVRSRYILTDDDGDKNAESIYTYAEHVFVPQRLTMQVGEINAMSGVLSGVPITGVQLMPTNGLERDGTGVSVSGIARSSQARVEVRQSGRLVYSTLVPAGPFTLDDVPVVRNNVDLDVTVVESDGSSSHFIVPASAVRTRKLGRPQGLTMSVGQVRSIDSDYSDPLVANVSDGWRITPWMNVLASGAVAEKYQAAGGSAEFMLSDIWGITTTAAASKEQFGDSNSGLKTELQSDLTLGEHVSLSASATHFSSGYRELADALDDEFQPNDNTYSGNVSFATGIAGTFSAGFNYNQSANYEDSRYLLLSWGKTFKYASITVNWQSAVGNTDDEQDDDMLYVNLSIPLGGSQSLSSYMRKQGDRTTYGVANSGAIGDNTNYYISADRDNDDNENSFNGNINTNLHYTQLSVGGGSSGSNQRNYSATLTGGIAMHKDGVTFSPYAIKDTFAIAKLNEPKSGVEISTPQGTIWTDHWGQAVVPGLNEWRNSRIEIDANKLPPSMTLANGIKYVAAGHASVSEVSFKILNSRRVMLRVKRADGTPLAKGLSIVDEKGNYIVTSVDDGHVFINDADQLKGLYAMDDNNNRLCQIHYTLSDKKDDEAFYEEVNGVCQ

SEQ ID NO: 6159 - protein, 271 aa, Enterobacter cloacae
YFKIGILIKNGINISCLFLSNYTWTWNVVLWIKGVIIMSCLKKTLLKSVIAAALFSAQFSTYAAGMVPETSLLVIDEATHSGTINVKNTDSFPALLYTNVLDLPDDQGLKLISTQPVVRLEPGQTQQLRFILQNKEPLEAEHYKRVTFEGIPPKSDNKNIKIGFNLRQDLPVLIRPAKLAVVTDAWKYLEWNATGTTLTVKNPSKYVVRLAQNVMTQPSGTAGTLPKTYILPGQSMTATLKKTVSGDNKVKFFPASRYGVEVPSFVSELNK

SEQ ID NO: 6160 - protein, 226 aa, Enterobacter cloacae
RMKKVLIATALSLCVASAFAADTAVLQVKGKLTNAACTPELSKGGVVDYGTIHPGSLSASAVNQLGQNNIDLTITCSAATKVSWTMVDDRAETNAGLTVNNAMFTGASLSNSSQTYGVGKTTGGVNIGSYAMFVKVDSVTADGATVDPIYTQNGDTSKWTTSTNGSSQAQNIREFTVAKSGEKVPLAFLSATFPLVTSLAIQDTTTLAITDDTTLDGQLTISLKYL

SEQ ID NO: 6161 - protein, 93 aa, Enterobacter cloacae
QMKKVLLATALSLCVASAFAADTAVLQVKGKLTNAACTPQLSNGGVVDYGTIHLGELSATAVNQLGDKDINLTITCGAPTQVGWVVDDNREFK

SEQ ID NO: 6162 - protein, 75 aa, Enterobacter cloacae
FFLTQIDTVLVLFRLPAWWNDFIAGLVLLGVLVLDGRLRQALARHQRALKYSRFQPGNKGGKHVTPFPKRKKEVA

SEQ ID NO: 6163 - protein, 325 aa, Enterobacter cloacae
MRLNWESALLILLVLEILLFGAINPRMLDINMLLFSTSDFICIGIVALPLTLVIISGGIDISLGSTIGLCAIALGVMMQAGWPMAVAIPLTLLLGLLCGLVNAALIHYTGISPLVITLGTLYLYGGGALLLSGMAGATGYEGIGGFPDSFTAFANLTVLGLPIPLVLFAVITAFFWLITHRGRFGRHLFLIGQNPRAARYAALPVNGMPYALYGLVGVASAIAALVMVSYFGSARSDLGRDLLMPALTAAVLGGANIYGGSGSVVGTALAALLVGYLQQGLQMVGIPNQVSSALSGALLVVVVMGRSLSLHREWVRSLFRKLSGA

SEQ ID NO: 6164 - protein, 325 aa, Enterobacter cloacae
GEGQRHRAAAGARGVHQREHQQIRFLTGEQMADLDDIKDGKDFGIGTPQQNVPYTLKGCGSLDWGMQSRLSRIFNPQSNRTVMLAFDHGYFQGPTTGLERIDLSIAPLFGETDVLMCTRGILRSQVPAATNKPVVLRASGGNSILGELSNECVAVAMEDALRLNVCAVAAQVYIGSEFEHQSINNVIKLVDAGARYGMPTLAVTGVGKEMARDARYFSLASRIAAEMGAQFVKTYYVDEGFEKVTASCPVPIVIAGGKKLPEHEALEMCWRAIDQGASGVDMGRNIFQSSAPLAMLKAVKKVVHENMSAREAFQFWQEEKQGEAK

SEQ ID NO: 6165 - protein, 351 aa, Enterobacter cloacae
VCTANGCDLSSENYPERKMKTKLLVLAMALSFASAQAADRIAFIPKLVGVGFFTSGGNGAKEAGKVLGVDVTYDGPTEPSVSGQVQLINNFVNQGYNAIIVSAVSPDGLCPALKRAMQRGVKVLTWDSDTKPECRSIYINQGTPEQLGGLLVEMAGKQVTKPNAKVAFFYSSPTVTDQNQWVKEAKAKIEKDHPQWQVVTTQFGYNDATKSLQTAEGILKAYSDLDAIIAPDANALPAAAQAAENLKREGVAIVGFSTPNVMRPYVERGTVKAFGLWDVVQQGKIAVNVADRLLKKGDLNVGDSVDVKNIGTLKVEPNSVQGYQYEAKGNGIVLLPERVVFTKENISKYDF

SEQ ID NO: 6166 - protein, 180 aa, Enterobacter cloacae
KSDRQLPGADRYRGGQKAAGARGAGDVLARDRPGRVRRGHGAQHLPVQRAARHAEGGEESGSREHERPGGVPVLAGRETGRSKMNVTLVEINIKPERVDEFLEVFRANHEGAIKEPGNLRFDVLQDPRVKTRFFIYEAYKDEKAVLAHKQTPHYLACVDKLEELMSEPRKKRSFVGLLPE

SEQ ID NO: 6167 - protein, 446 aa, Enterobacter cloacae
ILPNERNGLLYTPGSIHWRHDIMANTITADDIREHFSQAMSAMYQQEVPQYGTLLELVADVNLAVLENNPLLHEQLANADELARLNVERHGAIRVGTAQELSTLRRIFAIMGMYPVSYYDLSQAGVPVHSTAFRPTDDAALCRNPFRIFTSLLRLELIENVALRERAAEILSRRNIFTPRCLELIDLHDAQGHFTEAQAREFVQEALETFRWHRHATVDQETYLALSNEHRLIADVVCFPGCHINHLTPRTLDIDRVQELMPKYGIEPKILIEGPPRREVPILLRQTSFKALEEPVLFAGEHKGTHTARFGEIEQRGVALTPKGRELYDSLLNQAGTGKDNLTHQLHLREIFSAFPDSEMFLRRQGLAYFRYRLTPTGEAHRHAFRPGVDPQPLIERGWVVAQPITYEDFLPVSAAGIFQSNLGYETQARIHGNASRNAFQAAPLP

SEQ ID NO: 6168 - protein, 319 aa, Enterobacter cloacae
LVTRVALFLTSPMEKNGLFSQRIRLRHLHTFVAVAQQGTLGRAAETLNLSQPALSKTLNELEQLTGTRLFDRGRLGAQLTLVGEQFLTHAVKVLDALNTAGQALNRKEEPASDIVRVGALPTAALGILPAAIGQFHRQQKHATLQVATMNNTMLLAGLKSGELDLGIGRMSDPELMSGLNYELLFLESLKLVVRPNHPLLQDTVTLSRVMEWPVVVSPKGTVPRQNAEALLQMQGCTLPSGCIETLSASLSRQLTVDYDYVWFVPSGAVKDDLRRGVLTALPVTSPGAGEPIGILTRVDAPLSEGAQTLLSAIRKSMPL

SEQ ID NO: 6169 - protein, 345 aa, Enterobacter cloacae
ANQVVMKKMLRFVLLLIVALGIAGGAGVWKVRQLAESQILIKDETIFTLKAGTGRQALGQQLYDDKIINRPRVFQWLLRIEPDLSHFKAGTYRFTPGMTVREMLQLLESGKEAQFPLRFVEGMRLSDYLRQLRDAPYIKHTLKDDRYQTVADALKFEHPEWVEGWFWPDTWMYTAGTTDVAILKRAHNKMVAAVDAAWKGRAEGLPYKDQNQFMTMASIIEKETAVAAERDQVASVFINRLRIGMRLQTDPTVIYGMGENYNGRISRKDLETPTAYNTYVISGLPPGPIATPSEASLKAAAHPAKTPYLYFVADGKGGHTFNTNLASHNRSVQDYLKALKEKNAQ

SEQ ID NO: 6170 - protein, 253 aa, Enterobacter cloacae
YSADCYAVATGAAGMKWYPWLRPHFEQLIGSYQVGRGHHALLIQALPGMGDDALIYAITRFLMCQQPEGHKSCGKCRGCQLMQAGTHPDYYTLEPEKGKNTLGIDAVREVSEKLYEYARLGGAKVVWLKDAALLTEAAANALLKTLEEPPENTWFFLSCREPERLLATLRSRCRLHHLAVPQESWSLAWLEREVTVSQDAARSALRLCSGAPAAALALLQPEVWSQRETLCRAVESALESSPRELDRIPAYAH

SEQ ID NO: 6171 - protein, 432 aa, Enterobacter cloacae
VLSFVVPRISFFIPPWRTSVSKRRVVVTGLGMLSPVGNTVESTWKALLAGQSGISLIDHFDTSAYATKFAGLVKDFNCEEIISRKEQRKMDAFIQYGIVAGVQAMQDSGLEITEENATRIGAAIGSGIGGLGLIEENHTSLMNGGPRKISPFFVPSTIVNMVAGHLTIMFGLRGPSISIATACTSGVHNIGQAARIIAYGDADAMVAGGAEKASTPLGVGGFGAARALSTRNDNPQAASRPWDKDRDGFVLGDGAGMIVLEEYEHAKKRGAKIYAEVVGFGMSSDAYHMTSPPENGAGAALAMENAIRDAGITPAQIGYVNAHGTSTPAGDKAEAQAVKSIFGESASRVLVSSTKSMTGHLLGAAGAVKSIYSILALRDQAVPPTINLDNPDEGCDLDFVPHEARQVSGMEYTLCNSFGFGGTNGSLIFKKV

SEQ ID NO: 6172 - protein, 272 aa, Enterobacter cloacae
GATMFLINGLEQDTLPASDRATQFGDGCFTTARILDGDVCLLGAHILRLQKACETLLIPFSQWDILESEMRRLASEKASGVLKVIISRGSGGRGYSGSACLHPTRILSVSDYPSHYAHWREEGVALALSPVRLGRNPMLAGIKHLNRLEQVLIRTHLEQTEAGEALVLDSEGYITECCAANLLWRKGSEVFTPSLEQAGVNGIMRQFCMHLLARAGFRVVEVNAKEEALLAADEVVICNALMPVVPVRAYGRKCWSSRELFQFLAPLCEQTR

SEQ ID NO: 6173 - protein, 219 aa, Enterobacter cloacae
RHLRKKMRSKYIVIEGLEGAGKTTARNVVVDTLTSLGVADMVFTREPGGTQLAEKLRSLVLDIKSVGDEVITDKAEVLMFYAARVQLVETVIKPALAEGKWVIGDRHDLSTQAYQGGGRGIDQTMLATLRNAVLGDFRPDLTLYLDVTPEVGLKRARARGELDRIEQESFDFFNRTRARYLELAGQDKTIRTIDATQSLEDVTRDIQQTVTQWLQEQQA

SEQ ID NO: 6174 - protein, 335 aa, Enterobacter cloacae
LVEYMTIKVGINGFGRIGRIVFRAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIIEGLMTTVHATTATQKTVDGPSHKDWRGGRGAAHNIIPSSTGAAKAVGKVLPELNGKLTGMAFRVPTPNVSVVDLTVRLEKAASYEEIKKAIKAASEGPMKGVLGYTEHDVVSTDFNGEVCTSVFDAKAGIALNDNFVKLVSWYDNETGYSNKVLDLIAHISK

SEQ ID NO: 6175 - protein, 299 aa, Enterobacter cloacae
TEDCLMINKIFALPVVEQLTPVLSRRQIDGADIIVVDHPRVKASVALNGAHLLSWKPEGEEEGLWLSEATSFKRGAAIRGGVPICWPWFGPSAQQGLPSHGFARNQQWTLKAHNEDENGAVLTFELQANDETRALWPHEFTLYARFKLGKTCEIELEAHGEFETTSALHTYFNVGDIQAVKVSGLGDTFIDKVDNAKEGKLDDGVQTFPDRTDRVYLHPEACSVIHDSALNRGIDVVHHHHSNVVGWNPGPALSVSMADIPDDGYKTFVCVETACVTAPQKTSEEKPSRLGQTIKIVKR

SEQ ID NO: 6176 - protein, 525 aa, Enterobacter cloacae
  UNSURE (525)
KTKGRHAMNIFDHYRQRYEAAKDEEFTLQEFLTICRQDRSAYANAAERLLMAIGEPNMVDTALEPRLSRLFSNRVVARYPAFEEFYGMEDAIEQIVSYLKHAAQGLEEKKQILYLLGPVGGGKSSLAERLKALMQRVPIYVLSANGERSPVNDHPLCLFNPQEDAQILEKEFGIPHRYLGTIMSPWAAKRLHEFGGDITKFRVVKVWPSILEQIAIAKTEPGDENNQDISALVGKVDIRKLEHHAQNDPDAYGYSGALCRANQGIMEFVEMFKAPIKVLHPLLTATQEGNYNGTEGISALPFNGIILAHSNESEWVTFRNNKNNEAFLDRVYIVKVPYCLRISEEIKIYEKLLNHSELVHAPCAPGTLETLSRFSILSRLKEPENSSIYSKMRVYDGESLKDTDPKAKSYQEYRDYAGVDEGMNGLSTRFAFKILSRVFNFDHAEVAANPVHLFYVLEQQIEREQFPQEQAERYLEFLKGYLIPKYAEFIGKEIQTAYLESYSEYGQNIFESSPRGSKDHERSRX

SEQ ID NO: 6177 - protein, 257 aa, Enterobacter cloacae
LFDYRKEWIVTKLKLLALGILAATAASTVQAESQWTVGAGAGVINSPYKQYDRDVYPVPVVTYEGDNFWFRGLGGGYYLWNDTADKLSIMAYYDPTHFKPGDSDSNALRQLDKRRSSLMAGLSYVHNTEYGFLRTALAGDTLDNSNGFIWDLAWLYRYTNGAVTLTPGIGVQYSSENYNDYYYGVSKAESRRSGLNSYSADDGWDPYLELTASYNFLGDWNVYGTGRYIRLSDEVKDSPMVDKSWSGIFSVGVTYKF

SEQ ID NO: 6178 - protein, 61 aa, Enterobacter cloacae
NVDFLQGDFRDELVLKALLDRVGDSKVQVVMSDMAPNMCGNTGGGYPPRHVSGGTSVRNVS

SEQ ID NO: 6179 - protein, 310 aa, Enterobacter cloacae
SVCLYLKPWSLLRGFSYLFNHINPRDFTMKLFAQDSHLDLTHPHVMGILNVTPDSFSDGGTHNSLIDAVKHANLMINAGATIIDVGGESTRPGAAEVSVEEELARVVPVVEAIARRFEVWISVDTSKPEVIREVARVGAHIINDIRSLTEPGAIEAAAETGLPVCLMHMQGQPKTMQEAPKYEDVFADVTRFFIEHIERCERAGIAKEKLLLDPGFGFGKNLSHNYALLARLSEFHQFGLPLLVGMSRKSMIGQLLNVGPSERLSGSLACAVIAAMQGAHIIRVHDVKETVEAMRVVEATLAAKENKRYE

SEQ ID NO: 6180 - protein, 95 aa, Enterobacter cloacae
VTVRSRLSCRIWRQICVETPAVDIPRAMYLVELALEMCRDVLAPGGSFVVKVFQGEGFEEYLKEIRSLFAKVKVRKPDSSRARSREVYIVATGRK

SEQ ID NO: 6181 - protein, 652 aa, Enterobacter cloacae
YEVNPLSDMAKNLILWLVIAVVLMSVFQSFGPSESNGRKVDYSTFLQEVNQDQVREARINGREINVTKKDSNRYTTYIPVNDPKLLDNLLTKNVKVVGEPPEEPSLLASIFISWFPMLLLIGVWIFFMRQMQGGGGKGAMSFGKSKARMLTEDQIKTTFADVAGCDEAKEEVGELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGAEHVSTGASNDIKVATNLARNMVTQWGFSDKLGPLLYAEEEGEVFLGRSVAKAKHMSDETARIIDQEVKALIERNYARARQILNDNMDILHSMKDALMKYETIDAPQIDDLMARREVRPPAGWEDPGASNNSDNNGTPRAPRPVDEPRTPNPGNTMSEQLGDK

SEQ ID NO: 6182 - protein, 375 aa, Enterobacter cloacae
KPCVWWKPHWQRRKTNAMSNRKYFGTDGIRGRVGDAPITPDFVLKLGWAAGKVLARHGSRKIIIGKDTRISGYMLESALEAGLAAAGLSASFTGPMPTPAVAYLTRTFRAEAGIVISASHNPFYDNGIKFFSIDGTKLPDDVEEAIEAEMEKEITCVDSAELGKANRIVDAAGRYIEFCKGTFPNELSLAHLKIVVDCANGATYHIAPNVFRELGAKVITIGCEPDGLNINEEVGATDVRALQARVLAEKADLGIALDGDGDRVIMVDHEGNKVDGDQILYIIAREGLRQGQLRGGAVGTLMSNMGLELALKQLGIPFVRAKVGDRYVLEKLQEKGWRIGAENSGHVILLDKTTTGDGIVAALHFSLGVAEPRIE

SEQ ID NO: 6183 - protein, 725 aa, Enterobacter cloacae
  UNSURE (65)
HASTGVENSPTPVPITYPASGRLFFVFHFFELSVDNIIVFRVVRRSISARLLLCVLLLSDFHQLXRNLCQLLHLRFDVRFVFAFQRRFQRAQCSFDCSFVFRWQFIARFFNLLTGAVQQMVTLVTGLNQLFKLTVGFRVSFGITNHFFDFRFVQARRCLDGNLLLFTAVFVFRRHVQDTVSIDVEGDFDLWHAAWCRVNTVQVELTQRFVIRRALTLTLNHMDGYRRLVVFSGREHLAVFRRDSGVFVDERSHHTAHGFDTQRQRGNVQQQYVFHFTGQYTTLNRSTDSNRFVRVHVFTWLFTKEFSHFLLNHRHTSLTTYQDNVLNVRHGQASVLQCNFQWLDRTVHQVFYQAFQFRTGHFDVHVFWTGRVCSDVRQVHVGLLSGRQLDLRFLSGFFQALHSQRVVTQVNALIFLELVNEVVDQTGIEVFTTQVGITVGCQNFEGFFAVNIVDFDNRNIEGTTTQVVNRDSTVANFFIQTVSQCCCGWFVDDTFYFQACDTASIFGCLTLSIVEVSRYGDNSFSYRFTQVIFRSFLHFLQHFSRDLRRCSFGAFHIKPCIAVIGCDDFVRHDGNVTLNFFVLEAAANQAFDRKQGVLRVCHCLTFSRLTNQSFTILGISNDRRRGAIALGVLQHTCSSAIHNRYTRVGSTQVDTNNFTHLNVSTKNSVNMWLCTCNKGRTCFFNCPDLIFFRSTHCGCLQDGVTTASIKGGRIKNFLISPPMRS

SEQ ID NO: 6184 - protein, 228 aa, Enterobacter cloacae
SGRYRDYRAVLHQRSVRSVAERGGRGYCGAGVAERLQRPTHGDLYSGGDGAVDGGAEVWRACHAGGRHRWLLYSAEGTGRQIACQTAGACASSVGGFYDPAAVCVCQRGCFPWPGVTLDGLTSVLPLGIIAGLFIGKPLGISLFCWLALKLKLASLPNGTTFSQIMAVGVLCGIGFTMSIFISTLAFGASAPELIVWAKLGILIGSFLAAVMGYTLLKVKLSGQAVQT

SEQ ID NO: 6185 - protein, 637 aa, Enterobacter cloacae
MGKIIGIDLGTTNSCVAIMDGTTARVLENAEGDRTTPSIIAYTQDGETLVGQPAKRQAVTNPQNTLFAIKRLIGRRFQDEEVQRDVSIMPYKIIAADNGDAWLDVKGTKTAPPQISAEVLKKMKKTAEDYLGEPVTEAVITVPAYFNDAQRQATKDAGRIAGLEVKRIINEPTAAALAYGLDKEVGNRTIAVYDLGGGTFDISIIEIDDVDGEKTFEVLATNGDTHLGGEDFDTRLINYLVDEFKKDQGIDLRNDPLAMQRLKEAAEKAKIELSSAQQTDVNLPYITADATGPKHMNIKVTRAKLESLVEDLVNRSIEPLKVALQDAGLSVSDIQDVILVGGQTRMPMVQKKVAEFFGKEPRKDVNPDEAVAIGAAVQGGVLTGEVKDVLLLDVTPLSLGIETMGGVMTALINKNTTIPTKHSQVFSTAEDNQSAVTIHVIQGERKRAADNKSLGQFNLDGINPAPRGMPQIEVTFDIDADGILHVSAKDKNSGKEQKITIKASSGLNEAEIEKMVRDAEANAESDRKFEELVQTRNQGDHLLHSTRKQVEEAGDKLPAEDKTAIETALSALETSLKGEDKADIEAKMQELAQVSQKLMEIAQQQHAQQQAGADASANNAKDDDVVDAEFEEVKDKK

SEQ ID NO: 6186 - protein, 336 aa, Enterobacter cloacae
SVFTDLFALILWFYRGIVVKESLNVKLLHRFFSSEASGGVILIIAAAAAMLLANMGMTRDLYHAFLETPVELKVGALEINKNMLLWINDALMAVFFLLVGLEVKRELVSGSLASRQRAAFPVIAAIGGMIVPALLFLAFAWQDPVARDGWAIPAATDIAFALGVLSLLGSRVPVALKIFLMALAIIDDLGAIVIIALFYTSDLSVLSLSVAAVAIAVLALLNVFNVRRTGIYILVGMVLWTAVLKSGVHATLAGVIVGFFIPLKEQDGKSPARQLEHVLHPWVGFMILPLFAFANAGVSPGPGLPWTDSPLCCRWVSSPVCLLVSRWASACSAGWR

SEQ ID NO: 6187 - protein, 328 aa, Enterobacter cloacae
SCPDRLSRHNRKPGEGKPSPDKLSGSENVMSHLNYNHLYYFWHVYKQGSVVGAAEALYLTPQTITGQIKALEERLQGKLFKRKGRGIEPSELGELVFRYADKMFTLSQEMLDIVNYRKELNLLFDVGVADALSKRLVSGVLDAAVVEDEQIHLRCFESTHEMLLEQLSQHKLDMIISDCPIDSTQQEGLFSVKIGECGVSFWCINPPPEKPFPACLEERRLLVPGRRSMLGRKLLNWFNSQGLNVEILGEFDDAALMKAFGEAHNAIFVAPTLYVHDLYSDDKITEIGRVDNVMEEYHAIFAERMIQHPAVQRICNRDYSALFTPPAI

SEQ ID NO: 6188 - protein, 371 aa, Enterobacter cloacae
AFRKLRKSVKSKKAYKRLAMKFHPDRNQGDKEAEAKFKEIKEAYEVLTDAQKRAAYDQYGHAAFEQGGMGGGGFGGGGFGGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQACPHCHGRGTLIKDPCTKCHGHGRVEKTKTLSVKIPAGVDTGDRIRLAGEGEAGEHGAPAGDLYVQVQVKQHAIFEREGNNLYCEVPINFAMAALGGEIEVPTLDGRVNLKIPGETQTGKLFRMRGKGVKSVRGGAQGDLLCRVVVETPVGLNDKQKQLLKELQESFGGPTGEKNSPRSKSFFDGVKKFFDDLTR

SEQ ID NO: 6189 - protein, 105 aa, Enterobacter cloacae
RGASGGSWAKVLTTDQKREAVMLMCDATGLSQRRACRLTSLSLSTCRYEAHRPAADAHLSGRITELALERRRFGYRRNLANCCPVKGFMLIISAGTGFITSVAWA

SEQ ID NO: 6190 - protein, 97 aa, Enterobacter cloacae; identical to SEQ ID NO: 5897

SEQ ID NO: 6191 - protein, 186 aa, Enterobacter cloacae
  UNSURE (7)
KGWQQNXCRCSVPAAPNLTWSMDFVMDALSTGRRIKCLTCVDDFTKECLTVTVAFGISGVQVTRILDSIALFRGYPATIRTDQGPEFTCRALDQWAFEHGVELRLIQPGKPTQNGFIESFNGRFRDECLNEHWFSDIVHARKIINDWRQDYNECRPHSTLNYQTPSEFAAGWRKGHSENEDSDVTN

SEQ ID NO: 6192 - protein, 805 aa, Enterobacter cloacae
GTGNWLQNCNVETSKKTVTTHYPDYKEFYCNSPKQDNFSSCTITRDFSVPVYISGGNGDMSMCGDNCVRIWFGRRDDNYWSDGVYDNELTLKFHPDAKLASAKIVNAEWDDHMRVTLDGTQIFAHIDGAYRESDYPAPKGSWELKKSWKLDKVYDVTDKVRKSVYEEPDREVTMASRVWVGGKGEGYFEVELTFENMKLEDKHVQEPAGCYDAVQAPNTFCRFDRFKDMDVGTKRLPESVLSLAKPLYEGDKGFLTWKTNLEGYFCDPLAKDKICSYDASGKIMKDANGKDLCYNYEEIKSMPDACSAYKNDAACVLDKQTCAEGWFDEGTNSCYMYEQKYTCDRGKDVVREVESSTNACVGMIPCSGGTCETGPKEENNDFGKVAAYSNMVQYMQGEAKCEDPNDANSCSVFEGKPEWCGRSVGFVNGLAKTDCCEAPQGTAGALEGIMLAGSMIRNTNWTRVNAQLIKWTGGDTGTWASMSNAVGEWTASAGKTVGQMWNNVTSSLTSVYENVAGNLSRAVGSSATSGGAGGAGQLAQETMSSFGIGQLKQMAMKKAYELLPDTVRDFVFKNVATTGGEVVFSAAVQNFMLALNVIGWIYTAYQVTKMLLEMLVACDQKEMEASIHKNQKSCFTLDTERCVKYLNVGFTKKCVKKATDMCCYNSMLSRVIMQQAYPQLGIDPVASNCVGLSIKQIQQLDFDKIDLTEWINDAVQVGEVPDQYSKFSEESIVENLPFQNENYQLPSERTKEAMGGEENMIKARQENAQAIKEENVDCSYLPRPAICEVGSTTLDPVTGKQLPKY

SEQ ID NO: 6193 - protein, 560 aa, Enterobacter cloacae
LLKRSNEVEMGKPTEEQRPVIENASANNMVIAAPGSGKSFTMIEAVISILKKYPYARIGMVTFTRAATNALAAKLQKRLSKKDLDRVLVDTFHGLVKKQLDMIRWPGKMLIGPAQRSVIHRALKESGVTMKFAEAEFVIDAIGREMDTDVISVRHNRQQIHLFNTYQALCQKDHVADLNALSKFVVGQMHSGKMRTLDLTHLIVDEVQDTDSIQFSWIALHTRAGVYTSIVGDDDQAIYSFRSSGGVKIFQQFEKHFRPNIFYLNTCFRCEPEILEVAGALIGKNVYRYAKELRSAKKGGGKVTFRSYVDMEEQIQGILSLINQDPHGWAILSRNNAHLDELESLIEQPVIRYGGKSFWDEKETSDVLSLMAFFRQSNDPRLMKRVLALFGEQESVLDEVALSMRGRKVTFGDLAIPEDSSLETKTLHSNFVRFTQESSDKVEIAKRFANLTKWMESSSIKMRSNKGTATLTKIALDTCKQWAEKTGWMNMINRAAAMSLGPRKKDEEYSPEKVVLSTLHGSKGLEWNKVIIMSCNADQIPSKRSVGEEAIKKERRLLYV

SEQ ID NO: 6194 - protein, 106 aa, Enterobacter cloacae
LKVYLMKKTTSRKAARRPAKHTDLYRQITDRIVVALENGVAPWRKPWRAAAGSGLAGLPLNATTGRHYSGVNVLLLWMSAEEQGFRNNRWLTYRQAQPGRRPGAKG

SEQ ID NO: 6195 - protein, 299 aa, Enterobacter cloacae
MSRFSKQLCKQLVTLARQGRGSYKTVADRSRIAERFSERLSELNIQIRDVKHIKTSHIEKYIESRKADNLSLRTLQNEMSAIRSVLLSAGRNKLADPSHINLSNQALGISGANRDGTKLPITDEKLNAVVSFAQRKDEGVALAVQLSRYLGLRTQKTVQSAKSLKTWRQALINNHERVRVVFGTKGGRPRETTVFNREKVLSILDKAIHYVSEHNGKLIDNPSLHSAIDRYRNIVREAGMNGKNAPHSLRYAYSRDAVNHHIKNGMSRDEAEALVSMDLGHGDGRGRYIKQVYFRGEAE

SEQ ID NO: 6196 - protein, 242 aa, Enterobacter cloacae
LTGRRSQAGGQVRKGEKATLAVVYKDWTKQAEDREGNRLYDSDGKPLTETVPMLKPLQLFNAEQCEGLPAEVAASPEQPPAVDEDGILSPDVMDRVLRMVNATGVKHRMLPQNRAYYRPLTDEIVMPVAGQFFTEADWWSTLLHELVHSTGHTKRLNREGITSSSRQFGDPVYAFEELIAEMGSAFLCAQLGVSGEVQHDSYVDHWLKVLKSDKKALFRACRHAREASEYLLALPGRQTVAA

SEQ ID NO: 6197 - protein, 63 aa, Enterobacter cloacae
EYFADRQLRGEDIQELEHQSGKLADWVRDLLCRKSNFVVTCALANKLARIAWALTARQQTYVA

SEQ ID NO: 6198 - protein, 159 aa, Enterobacter cloacae
RNDIDFGLELATTSSTRSGHGLPLVALGAGKRLTMQNRGELFHKVVVVQFQFVHALVQTVVRHYRRNCGEQTDCGRDQCFCDTRCNHLQRCLLHRPQGDKGVHDPPHRTKQADIRADGANGSEERNMRFKIFQFAVHGDAHRTRRPFYHGFRRMAVSAM

SEQ ID NO: 6199 - protein, 149 aa, Enterobacter cloacae
RSLKAPTFLVLPGCKVNTTLFRWPVRVYYEDTDAGGVVYHASYVAFYERARTEMLRHHHFSQQVLLAERVAFVVRKMTLEYFAPARLDDMLEVQTEITSMRGTSLVFTQRIVNAENTVLNSAEVLIVCVDPTIMKPRALPKSIVAEFKQ

SEQ ID NO: 6200 - protein, 376 aa, Enterobacter cloacae
LSLFDHLRSFWEPIVSKATEQNDKLKRAIIVSAVLHVFLFAALIWSSFDEHLDASGGDGGSSIDAVMVDPGAVVQNYNRQQQQQASAKRAEEQREKQAQQQAEELREKQAAEQERLKQLEKERLQAQEAAKEQAEQQKQAEAAAKKAQEQQKQAEEAAAKAAADAKAQADAQAKLAAEAAKKAAADAQKKAEAEAAKKAAADAKKKAEAEAAKKAAADAQKKAEAEAAKKAAQEAEKKAAADAAKKAAAAEKAAAEKAAAAEKAAAEKKAAAEKAAADKKAAAEKAAAKKAAAAEKAAAAGVDDLLGDLSSGKNAPKTGGGAKGSNAAPAGSGNTKNNGASGAEINDYKNQIAAAIASRLNDKSVLHRRGWKEEPS

SEQ ID NO: 6201 - protein, 504 aa, Enterobacter cloacae
RFLFVPLTLGMAFLLAIMETVYVLSGKQIYKDMTKFWGKLFGINFALGVATGLTMEFQFGTNWSYYSHYVGDIFGAPLAIEGLMAFFLESTFVGLFFFGWDRLGKVQHMAVTWLVALGSNLSALWILVANGWMQNPIASDFNFETMRMEMVSFAELVLNPVAQVKFVHTVASGYVCGAMFVLGISSYYMLRGRDFAFAKRSFAIAASFGMAAILSVIVLGDESGYEMGDVQKTKLAAIEAEWETQPAPAAFTLFGVPDQEAQENRFAIQIPYALGIIATRSVDKQVTGLKDLMVQHEERIRNGMKAYSLLEQLRAGSTDQAVRDQFNDVKKDLGYGLLLKRYTPNVSDATEAQIQMATKDSIPRVAPLYFAFRIMVGCGIIMLLIIAASFWSVIRNRIGEKKWLLRTALYGIPLPWIAIESGWFVAEYGRQPWAIGEVLPTAVANSSLTAGDLIFSMLLICGLYTLFLVAELFLMFKFARLGPSSLKTGRYHYEQSVATTQPAR

SEQ ID NO: 6202 - protein, 384 aa, Enterobacter cloacae
DRSHQMIDYEVLRFIWWLLIGVLLIGFAVTDGFDMGVGMLTRFLGRNDTERRIMINSIAPHWDGNQVWLITAGGALFAAWPMVYAAAFSGFYVAMILVLASLFFRPVGFDYRSKIEDTRWRNMWDWGIFIGSFVPPLVIGVAFGNLLQGVPFHVDEYMRLFYTGNFFQLLNPFGLLAGVVSVAMIITQGATYLQMRTVGELHLRSRATAQVAALVTLVCFALAGVWVVYGIDGYVVTSAINHTAPSNPLTKEVARQAGAWLVNFNNTPALWAIPALGVLLPLLTVLTSRLEKGALAFVFSSLTLACIILTAGIAMFPFVMPSSTMMNASLTMWDATSSQLTLNLMTYVACVFVPIILLYTTWCYWKMFGRITKEHIESNTHSMY

SEQ ID NO: 6203 - protein, 100 aa, Enterobacter cloacae
RKALMNIIATLYAVMDKRPLRALSLIMALLLAGCIFWDPSRFAAKTSELEIWHGFLIMWAVCAGVIHGVGFRPKALHWQGIFCPLIADLVLLAGLIFFFF

SEQ ID NO: 6204 - protein, 231 aa, Enterobacter cloacae
AVTDMNILDLFLKASLLVKLIMLILIGFSIASWAIIIQRTRILNAAGREAEAFEDKFWSGIELSRLYQESQGRRDNLSGSEQIFYSGFKEFARLHRANSHAPEAVVEGASRAMRISMNRELENLETHIPFLGTVGSISPYIGLFGTVWGIMHAFIALGAVKQATLQMVAPGIAEALIATAIGLFAAIPAVMAYNRLNQRVNKLELNYDNFMEEFTAILHRQAFTSTESNKG

SEQ ID NO: 6205 - protein, 143 aa, Enterobacter cloacae
TMARSRGRGRRELKSEINIVPLLDVLLVLLLIFMATAPIITQSVEVDLPDATESQAVSTNDDPPVIIEVSGVGQYSVVVEKDRMDQLPPEQVIAEAQRRLESNPKTVFLIGGAKDVPYDEIIKALNLLHSAGVKSVGLMTQPI

SEQ ID NO: 6206 - protein, 300 aa, Enterobacter cloacae
LTQYHVIRDPREHILNRLPSSASALACTAHALNLIEKRTLDHEEMKQLNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFSNSGTESVEAAIKLAKAYQSPRGKFTFIATSGAFHGKSLGALSATAKSTFRKPFMPLLPGFRHVPFGDINAMRTMLGECRKTGDDVAAVILEPIQGEGGVILPPQGYLPAVRQLCDEFGALLILDEVQTRDGAHRQDVRL

SEQ ID NO: 6207 - protein, 191 aa, Enterobacter cloacae
SSTKCKPGMGRTGKMFACEHENVQPDILCLAKALGGGVMPIGATVATEEVFSVLFDNPFLHTTTFGGNPLACAAALATINVLLEQNLPAQAEQKGDMLLDGFRQLGREYPDLVQDARGKGMLMAIEFVDNETGYSFASEMFRQRVLVAGTLNNSKTIRIEPPLTLTIEQCEQVLKAARKALAALRVSVEEA

SEQ ID NO: 6208 - protein, 201 aa, Enterobacter cloacae
PMTDKVNIMTDAGADVAQVSLAVANRIRSWRKEKKLSLDELSRRASVSKGMLVEIEKGAANPSIAILCKLAAALGVSVADIVNVSSEPQIHIIREEAIPVLWQGAQGGYARLLAGTAGPDMIELWQWEMHPGETFTSPGHPAGTFELLHVNEGMLTLTVDETVTQVAAGASAVAKTEAAHGYANESDTVLRFTMTVAEFHR

SEQ ID NO: 6209 - protein, 137 aa, Enterobacter cloacae
ILNSSEQTVNLGQYRTAKFTKVGDTTSNIPFTIELNDCDPAVAKTAAVAFTGQIDATDKTLLAVSSGNNDNSAKGVGIEILDSKSSTLTPDGATFSAAQNLIEGTNTLNFTARYKATAATTEPGQANADATFVMKYE

SEQ ID NO: 6210 - protein, 203 aa, Enterobacter cloacae
CLSTGMWLASGKRSFDRLYRERRMTRTGILLCALAIAPAVNAHTVVIDGGKVHLRGELVNGGCAVAPDSQNMRVDMGQYRTNAFSGVGSFSTVNVPFTVRLLDCSVDVSRTVGIQFQGVTPAEDPQVFLATSRPGENAVSSGVGLALFDEQQRQIIPNATAVSWLPINTRELVFHFSARYRAISEHLVPGTIQSNVWFTLIYP

SEQ ID NO: 6211 - protein, 861 aa, Enterobacter cloacae
RQPVSRDRAMNTQWRYCPVALALMATLWPLAGWGESYFNPAFLSDDTANVADLSRFEKGHQQAPGVYRVDIWRNDEFIGTQDVRFEQADNTPPVAGGLSPCITRAMLDRFGVNIAAFPELSNVQGDTCVPLTTAIPGSEAAFNFASLRLNVSLPQVAMQNSARGYIPPEQWDEGIPAALLNYSFTGNRGSDDDSYYLNLQSGLNYGAWRLRNNGAWRYTESNGQRHSSWQNIGTWAQRTIIPLKSELVLGDSNTGNDVFDSVGFRGGRLYSSDSMYPDSLQGYAPTVRGIARTPAKVVIRQNGYVIYQSYVQPGAFAITDLNPTSSSGDLEVTVEEKDGSQQRYTVPYSTVPLLQREGRWKYDLVAGDYRSGNSEQDTPFFTQGTMIAGLADGYTLYGGTQLASRYTAIAIGAGKNLGDWGAVSLDLTHARSQLADDSRHEGQSLRFLYAKSLNGFGTNFQLLGYRYSTKGFYTLDDVAWRTMEGYQYGDDQDDDGVPDVQSYHNLTLNKKGRFQLNISQSLGDYGSVYVSGSQQNYWGTSESNVWYQLGYAGGVKGVSYALSWSWNKAVGIDGTDRIASFNVSVPFSLFTRHGYRRDNAIDRAYATASASRNSDGDTSWQTGISGTLLKDRNLNYSVTQGHTSNNGASGSASANWQATYGTLGVGYNYTRDQHDLNWQLSGGVVGHSDGITFSQPLGDTNVLIKAPGASGVSVENQTGVKTDWRGYAVMPYATVYRYNRVALDTNTMSNNTDIENNVSSVVPTNGALVRASFDTRIGVRALLTVKRDNQPVPFGAVVRETQSGVTSMVGDDGQIYLSGLPLSGELLIQWGDGKQSQCRAPYSLPEQSLQQAITLKGIRCE

SEQ ID NO: 6212 - protein, 245 aa, Enterobacter cloacae
FIPDACELIIKGTVVMNTLIKPGLFLSFILMMVSASTNASGGIALGATRVIYPADAKQTSLAITNSNKQERYLINAWIENANGQKEKTFAVTPPLFVSEPASENTLRIIYAGPALPADRESLFYMNVKAIPSVSKKHQDGNNVLQLAILSRIKLFVRPANLAMPPEEALSQLRFERVGNHLKVSNASPYYVTLVNLKLGGQTLDNLMVAPKSSAQQVLPAATSGTLSWQSVNDYGAITPARSVSL

SEQ ID NO: 6213 - protein, 367 aa, Enterobacter cloacae
FSGETGSSPSVVRPTACQNRACNRRSHLRGSAVNKIHYLGLSLLAFLPLSQAFATVCVNENGVPTEVYYDLTDKFNSSNNQVGQIVTLSEKSQWVGVNAVCPKGTSGNTTKRSYVTDYPVTGTSDGYQYLKLNDYLDGAMKITDSYAGTFYPPRKYIQMGSHPNVSKNKPFGVQDSSLVFRLKVTRRFINMVVIPRATMFRVYVTTTSSDPLTTPVYTISYSGTIQVPQSCEINAGNVVEFDFGDIGASLFSKAGIGNKPEGISAQSKTIGIKCTNVEANAMLTMRVEAEKVSGSTLVSDNADVGFVIANSNGVPLTPNNLTSKIPFRLDDSAQAQVGIRAWPVSVTGKKPAEGRFTSRGYLRVDYD

SEQ ID NO: 6214 - protein, 79 aa, Enterobacter cloacae
TYFLFPNMRGKGYLHFKGIDMKLSNIASTVIATLALVAGAAHAEDPVAPVSVNGGTVHFKGELVNAACSVNTELFRADG

SEQ ID NO: 6215 - protein, 165 aa, Enterobacter cloacae
PSRCFALCSPAHAEMALGEINIQLYGNIVDFTCVAEGDDSNKTVTIGTWPTKQLRTTGSRTQPVLFTLKLTGCPPGAASVTFTGKMDGHDNSLLALNDASAASNVSVEILDRDKTRLALQQASQTVAVDAQGNAELSFYANYIATADNPQPGRADADATFMINYN

SEQ ID NO: 6216 - protein, 167 aa, Enterobacter cloacae
RYLRIFPRLIPLFSDLNQLLSSRLVVNIETRASPIIDLLDRLRRHSLLAPYLTPYMFFRADDYDARLFCKAAGPFHVLARQLTALDMQQTLMEAPAPAGNRKEWFSRDEWPILQALSQGSSLRQIAQLQNRPYSCIIYSLSCILAKLGLNYRHELLHLLNNLSDFTY

SEQ ID NO: 6217 - protein, 91 aa, Enterobacter cloacae
QRRSLLTKYRQSPLSNVTDGIFSLMAAKIIDGKTIAQQVRSEVAEKVKARKAAGFRAPGLAVVLVGSNPASQIYVGSKRKACEEVGFVSRS

SEQ ID NO: 6218 - protein, 211 aa, Enterobacter cloacae
KMKPASVIIMDEHPIVRMSIEVLLQKNKNIQVKLKSGDSHEVLDCIRNHPIDLVILDIEMTDTDGFVLLKRIRNLNKDIKVLFLSSKSEALYAGRAIRAGDNGFVSKRKDLGEIYNAVEMILTGYSFFPSETLSFINHLGSRTGAAVDMPLSNREVTVLRYLANGLSNKEIADQLLLSNKTISAHKSNIFSKLGVQSIVELIDYAKAHELL

SEQ ID NO: 6219 - protein, 250 aa, Enterobacter cloacae
HSMNLQTYESTSAITMSAISNAILNGLSPLRVTIPMTGVEWADKYFYLPEGSSHIAGRWKTQPVQLAMLNMMTNDAIKIVSIRKSARLGYTKVMVVALLYFAEHKKRSSVAYQPVDDEAEGFVSDEIDPAICEMPVIQKIFPDWDSSNERNNIKRKEMSGAILDFRGANSPGNFRRLTKQVVAGDEVDGWPLEVSKKGKGEGSPIELALVRIKGASYPKAIFGSTPTVTGKSQIEMLEDGADLVFRFYLP

SEQ ID NO: 6220 - protein, 110 aa, Enterobacter cloacae
GAVMTTESCQPDDFFVGPDVTTTTGIMASGVNIAKYTPVMIDATAGTFKSWDGTPGKAVGITAMAVNASAGQVEFSYYNGGTFRASYLNWSADAVKRKSAFAGTPVSIQE

SEQ ID NO: 6221 - protein, 179 aa, Enterobacter cloacae
LNRSSPVMKSTAGRLKSRRKARAKGRRLNWLWYVLRARHTRKPFSALLRPLPAKARLKCSRMAPIWSSGFICLSAQAASNELARVMSIIGCEEAKGREQQAHALAAIPGMTLDQAKAVLAAAPQTAQARTETALDALMTKESPEAVAYMPAQHNHSADGSAAKISLLVQAGKSLIEEQL

SEQ ID NO: 6222 - protein, 344 aa, Enterobacter cloacae
MSDSYTTQELIAATQQVFKFQPLFLSLFFKETYTFDTEDVFLDKIPGEVSMAVYCSPLITGKVDRTRGFKTTHFKPGYTKPKHTVNPHTVIKRSAGEHIGQPKTPAERRAEIIMQNLKDEELSIQQLEEYQAVQAVLKGKYTISGPNIDTTEIDMQRSVANNIVQSGSTAWSAQNKDTFDPSNDIEEYAEHASGTINVMVLDGKAWKTLKSFKLFREALDTRRGSNSKLELALKNLGDVVSFKGYYGDTAVIVYKGQYIDPDTKAKTKYMPDNTIALGNLQSKGYRTYGAVQDEDALREGITEATRYPKIWTTTGDPSITQTMTQSAPAMVLADADAFVIVTLA

SEQ ID NO: 6223 - protein, 147 aa, Enterobacter cloacae
EPKGSFLYPETKMANKTELLARISDLSAQLGRELSTTGTNEALQAVIDSAEAELKLLNEDDGETLPLQPLPGGSNSGTLLTASSPDENDEADADGAAYRLVKLRATLHVVHYVNQKPVREIVPAGQSIYVDPEEAALLIAANHVYAL

SEQ ID NO: 6224 - protein, 329 aa, Enterobacter cloacae
FLIVAFEASRIANEVSMIKQKTIKNIVELSGIGLHSGSSIHMKIMPATANSGIRFRRTDLNPSVDIQLRAEQVHDTMLATSLINPQGIRVSTIEHFLSAVSSLGIDNLLVELDAPELPILDGSAREFIDSLINAGSIEQCALKKYLLIKKTVSVKDGDKWALLHPDSKFSVDFTIDFKHPLISADTNKLNIEMSKEKYIEEIAGARTFGFVHDVEKLQKIGLVLGAGLNNAIGLDEYSVLNPEGLRFNNELVRHKVLDAIGDLFVSGYNIIGAYHAYKSGHALNNKLMLALLNDTDAWEFVNLHDYSRGKLKVNMLPAINKECPVSLTI

SEQ ID NO: 6225 - protein, 150 aa, Enterobacter cloacae
  UNSURE (6)
YHRIAXGERMSTIGDAARLSGVSAKMIRYYEEAGLIPSVSRTAAGYRIYKDVDVYKLHFIRRCRELGFSLSQTGDLLSLWGNHSRQSADVKKLVESHINDLTSKIEELQRIASTLTTLSDCCAGDDKPDCPILRALYLAETSRKDKENSP

SEQ ID NO: 6226 - protein, 311 aa, Enterobacter cloacae
LMKFPHFFIQRPIFAIVLSLFMLIAGALAFFQLPLSEYPSVTPPTVQVTASYPGANPNVIADTVAAPLEQAINGVEGMLYMSSQTSSDGRMVLTISFRQGTDPDIAQIQVQNRVSRALPRLPSEVQQIGVVTEKTSPDILMVVHLFSPDNRYNPLYVSNYAMLNVRDELSRLPGIASIALWGEGEYAMRVWLDPNKIASRGLTASDVTSAIKEQNVQVAAGSVGQQPNTSSSFQVTVNALGRLTTEEQFGDIIIKSGTDGQVTRLRDVARIELGSDNYSLRSLLDNKDAVGMQIVMTPGANALDVSASVRS

SEQ ID NO: 6227 - protein, 1212 aa, Enterobacter cloacae
GHCIWRRLRVRTRKIVLDVIIATYLESLQPGFIVRNLYAVNFNGNHCLHKEQLQLSKDHFLLVRFTMLNIIPGYCTLCRSRCGTLNEVIEDLLFLVRPNPVLPFGKAMCMKGKAAPELVDSANRILHPMKRTHPKGAENPGWQRISWEEAMSTIAGQLKKFKNENGAESVAFGFTSPSGTPLSDAIEWLERFVRIYGSPNTSYGTEICNWHKDVAHRWTFGCGIPVADYSHAELIILWGHNPANTWLAQANAIGTGRNNGAKLIVIDPRPTPLAKEANAWLNVCPGTDGALALGLSHLLVERHMFNQEFVRDWTNGPLLIRNDNGYFLREIDINPFATSNRYVVWDEHIQQVIFIDSETRTEETLTPTAALESDVEVTLADGGKISCHTAFSSFKNILANYSPENVSRITGISVASIEAAASMIGNAKKIAYHSWSGVAQHTNATQTERAIATLYALTGCFDQEGCNRIYASHPVNVVNSPTLMPKTQWEKALGLEERPIGPPSQGWVHSQDIWHSVLEGTPYKIRGLIGFGANILLSQSDTSLGQQALEALEFYAHVDLFETPTSKYADILLPVNTAWEREGLRAGFESSAAAQEHIQLRKQMVSPRGESRSDLEIVFDLACRLGMNEAFFDGNIESAWNYQLKPLGLTVEMLRNKPEGYDIPLEHKVRKYALKDQKTGYLTGFNTETKRAEFYSEVLHRHGYNPLPEYVQPQEYQRNDPDFPLMLTSVKSGFFCHSQHRSLTSLRKKASYPTVEISVTLADEEKIKTGDWVEIETRVGQARFRAKVEEKLSHETVIAEFGWWQGCPDFGKPSYPVIGEFSSNFNSLISGDSYDPVSGALPLRSFRCRIRRLNEFELVRRPWDGRRTFQVISLKKETDNVTTVTFQSKAEGFLPDYEPGQHVTISCYPLIDSEDIVTRAYSLTGPAFVDARKTYSISVRHQTARDENGEFVEGIMSSFINTRLQVGSFVEITPPGGNFIVPLNAMQPVVIFAGGIGITPFICYLESIDPDETGPEIWLFYANQNSKQHAFKKRIQELSSLISRLKVINVYNQPLDCDVLGEDYDRAGFAGAGDVDAHLIENNARYYMCGPMPMMEAISKGLQQRGVPAFAIFYEIFRSPAKINDDPSLRHKVTFAKSGREEIWTTDKGTLLNFGEKLGISMPSGCRVGQCESCSTKVITGSVQHLNNVEPSDEGACLTCQCIPAGDITIDA

SEQ ID NO: 6228 - protein, 432 aa, Enterobacter cloacae
EIATGANFGLSEGFWGTKRVIMMKMSIRTMVMAVAVAITASTSVAVAKEDGSGKTSTAQIPAGPQVPVAEVISRNIIPSAEFTGSLAAIKTVELRPRVGGTIESVSVPEGSLVHKGQLLFQIDPRPFQVALDSAKAQLRQAEAQAFQANRNFERVSRLVNNGAVSRKDYDDAASDKNARIAQVNVAQAAVEAAKLDLSYTRVTAPIDGRVDRILITEGNLISNSEGGAATLLTTIVSSNPLYAYFDIDEATFLNTVSKARPDAMEGSKEKLPVHVGLATEKGYPHSGTLDFVGNQIDRNTGTVRVRAIIPNTDGLLTPGAFARVQLGTGKAQQVILINDQAVGTNQGNKYVLVIGDDSKAQYRPIELGPVVDGLRIVAKGLQAGEKIIIKGLVRPGMAVTPSMVSMQSLESSLDAKPATQGKASDSNNKGGN

SEQ ID NO: 6229 - protein, 182 aa, Enterobacter cloacae
TVRCSGRDPPSSERVEAGYGRTGHIKKSRGVLRKAVRLRYAFIRDNSRCWPVRLLCRVLDVHPSGFYFWLQQPHSQRHQTDQMLTGQIKQFWLESGCVYGYRKINLDLRDTGQQCGVNRVWRLMKRAGIKAQVGYRTPRARKGESSIVTPNMLQRQFNPDSPDERWVTDITYIRTHECWLYL

SEQ ID NO: 6230 - protein, 96 aa, Enterobacter cloacae
REVPMSGKRYPEEFKIEAVKQVVDRGHSVSSVATRLDITTHSLYAWIKKYGPDSSTHNEQSDAQAEIRRLQKELKRVTDERDILKKAAAYFAKLSD

SEQ ID NO: 6231 - protein, 793 aa, Enterobacter cloacae
RQRLWEMKKNIENFETFIIEQKAWFEENLAADFAESWDSFVWICGIKGSGWLRGNGANLLRFDEVNRLKGIDDRHTVSEPYQLFMKAMLVLVYRGRNRSISSAVAVATLIILKRWYCALIKLTGQTHPIYLTTDVVRSAMDTLSAASRPGDTNLANYKGRCVKIQKLVNHHAFTLVTLQYVSDDCYTNQTNLTRKARETISLKEKDKLDDTSTDGEDTLITIKGFLNIVSLIQRVESGTEKIALNCLLLLIVTGFRSVEAFNLRQDALVKRHIDNSDLSKRLRNKGLPDYFLGIRYVGVKGAGERTHWVEPLAVPLVENIFKSVKLLTAEFRKHIEYLRSKKFSDYLPKPISDITGELVELDDIVKYMVQSSSELRGRAGLRDKASKALEKRGFIPAKVILKSGNEKEKYFTKSDLSNFLKSEFGDNSANTPCTHAWAENGKRYEIKYEELLFLFPKGSLTLKRVLQLKATPLPLNNNGLNKFLGNVAGYVSVFSKYSLLEDDGRPTQLRTHIPRHNINTFLAIAEISDHLQAMLMGRVDITQNQHYQHLALKERRKAASLTPLVPTVPEQSAFTAVDVDSPLDMVKQSGLMTFNSSQSLETNIKANLHTFDDRYDVAGFIEASSGDGLFEDIAAAFEEISKNEGPLQASEMVQRHAVLHPLKLGSCMRDVNLWGCPYRMKCQALKPCEHFTLTGRIDEYSTIAVKGRALNEASLAFEQYIAALPDNQLIQGNIEENLTHLDALSDQLRRRSNLLQVLSAQEILSGEIKVEGEIRTLAQLFALEHHKNKEEEN

SEQ ID NO: 6232 - protein, 92 aa, Enterobacter cloacae
RFTVGNNDVLEVGVAEQLEFFPVQSPCRGICQVDERGYCRGCMRTRDERFNWQNFSDAQKQEVLRLCRQRLLRKIRANKAVEPEEPQQPSLF

SEQ ID NO: 6233 - protein, 306 aa, Enterobacter cloacae
HYFLEENVMVQRITLAPQGPEFSRFVMGYWRLMDWNMSPVQLADFIEEHLDLGITTVDHADIYGGYQCEAAFGEALKRAPGLRERMEIVTKCGIATTAKPEHALGHYITDSAHIVKSAEQSLVNLATDRIDLLLIHRPDPLMDADEVAEAFLTLHQSGKVRHFGVSNFTPAQFALLQSRLPFTLATNQVEISPVHQPLLLDGTLDQLQQLRIRPMAWSCLGGGRLFNDEAFQPLRNELETVARELNAESIEQVVYAWILRLPSKPLPIIGSGKIERVRAALVAEELDMTRQQWFRIRKAALGYDVP

SEQ ID NO: 6234 - protein, 190 aa, Enterobacter cloacae
NLRLWYRLKVQKITRGGHMKRFALAMVTLVVCAGAQAASEDVEMNLVTSQGVGQSIGTVKITETDKGLEFAPDLKALPPGEHGFHVHAKGSCQPAMKEGKPTAAEAAGGHLDPQNSGKHEGPEGMGHLGDLPVLVVNNDGKATDPVVAPRLKKLDEVKGKALMIHVGGDNMSDQPKPLGGGGARYACGVI

SEQ ID NO: 6235 - protein, 93 aa, Enterobacter cloacae
NLPLWPSFHRKGSLLVTLFSFSAGLPLQDLIVGASVYFPPLFKAVMVGFVIWLIAHRLLRDWMYSGEIWHPMLMDLSLFTLSVCLGLAVLTVW

SEQ ID NO: 6236 - protein, 699 aa, Enterobacter cloacae
STAERHYPGLWHNLHCRHRIAMMNLGALSWRNTPWIKATRPQWRYALRNGIAMCLALTVAYYLNLDEPYWAMTSAAVVSFPTVGGVISKSLGRVAGSLLGATAALLLAGHTLNDPWLFLLSMSAWLGLCTWACAHFTNNVAYAFQLAGYTAAIIAFPVVNVLDTTELWDIAQARVCEVMVGILCGGVMMMILPSTSDGTTLITALKTMHARLLEHASLLWQPDSSDDIRLAHEKVIGQILTMNLLRIQAFWSHYRFRRQNTLLNYLLHQQLRMTSAISSLRRMLLNWPTPPAHTREIIEALLATLARSDADIYTVARIIAPLAPADEYDYRHRAFWQRLNYFCRLYLRSSRWLKAVENATPVTEFSVPGSPALARHTDAMEALWSGFRTFCALTAVGAWAITTQWDAGSAALTLAAISCVLYSVAASPFNSLTLLLRTLVLLSLFSFVVKFGLMVQITDLWQFLLFLFPLLTTMQLLKLQMPKLAGLWGQLIVFMGSFISVTNPPVYDYADFLNDNLAKILGVGLAWLAFAVLRPGSDARKSRRHIRELRRGFVDQLSRRPHLRESEYESLVYHHVSQLNNSQDSLSRRWLLRWGVVLLNCSHVVWQLRAWETRSDPLSQVRDNCISMLRDVMSERGVQQRPLSVTLAELQRICDTLAHHHQPAARDLASIIWRLHCSLSQLEQAPPPGTIGDQITPQA

SEQ ID NO: 6237 - protein, 314 aa, Enterobacter cloacae
NLAPDVNGSLPVYPLRLSWPCRVNRVVRIALKTLKYFSTLFVLALALIAGWWLWNYYMQSPWTRDGKIRAEQVSITPQVSGSISALLVKDNQSVHAGDVLFRIDETPFHIAVLNAQAQLAKAQSDLAKANNEAERRRHLSRNYISAEDLDTANINVKAMQASLKVAEATLKQAEWQLTQTVVKAPVDGWITSLSTRVGDYATTGQPVFALVDSRSFYVVGYFEETKLRHIREGAPARITLYSGAETLQGHVSSIGRAIYDQSVETDSGLVPDIKPNVPWVRLAQRVPVRVEFDQLPKDITLVSGTTCTVAIGSR

SEQ ID NO: 6238 - protein, 399 aa, Enterobacter cloacae
NQCIPVSRMKNQSVIRQFSESELHQQLETFGNHDKQLSRLIRYFSHLRYNTAKTYLHWLRVWNEWYLANARLHTDWPVSSLPVSEDALLAFMGHLEGKLSRSSINSCLQALNSIHKKGLNLPGIITSEAWYMLEALKQSEARKRKTTKQATPFLIGDLKALIKLRSTTNSVRKLRDLCLIWTGFETLLRSSEIRRIRLKDLSLDSMTGEFNLTVYRTKTNISTLLTYRLTRQLTNCLLRLMNLVKMDQHSHPDEYLFQAVNFHDTGYMPPGWKLRSKGNELSELLKRHNLPYRAKQSLLNDEDEEDTVDDAGMLSKNSLLRAFKEMWNELYPNETKTRYWTGHSVRVGGAIQLDIEGYSLPQIMEMGNWSNEEMVMRYIRNIEAGKKAMIKLMRNAFDE

SEQ ID NO: 6239 - protein, 343 aa, Enterobacter cloacae
HLCSARSAWAAKLIGNNMSLEKRMSYDDLPYFRDQILERIDSLKCFFSNTPPMMANLMTVSTVSRTEERLKQVKPIRVSIKDDASVEEIIQALTDICVDDIESLSHDSTKVTTKYPGLIIVPERADLLESLITSINEAKNDFAAAMRRIDNKKNVRFDKVHKKLPGLVAMHSTRNILFIKSQLKKVTFSWRLNRNQEVKTAEQLVSLLERRRASEVKNVATTNLNVVSNIDKALHRLEFHPLKQGESYRLCRTNSFPVPIAHIFAFRPEGQERNGNKYAETDYSVVKASLPIFAAGNIPQLKTLSDWAPENSQGPSNQRKLSLKYTELVPGAELGIFIVSPEN

SEQ ID NO: 6240 - protein, 202 aa, Enterobacter cloacae
FSQIEKMGRRFNFNSSASRYSLNPLGYAGIGADGAFNTAISFTTNTNWQWYSGEAAMSNLSQMLALTIHNFLSAATGIALAFALFRGFARREATGIGNFWADVTRVTLYVLLPISVVYGVFLIASGVPQTLAASVDVSTLEGVRQTLGLGPVASQEAIKMLGTNGGGFFNANSAHPFENPDALTNFIELLVFTTDSRIRTSG

SEQ ID NO: 6241 - protein, 101 aa, Enterobacter cloacae
ILICALIVSVLLLIPLAMVLSPWLLGVLRFLLGAADGALLPAVLTLLVFFSSFLIAGRFFCFFQSFRDLGIVSGPLVGAGISACFGFRAVFIVTAGVVLFN

SEQ ID NO: 6242 - protein, 145 aa, Enterobacter cloacae
WPSMPDSSGCGMPYWKRGLTMIVKFHPRGRGGGAGPVDYLLGKDRQRDGASVLQGKPEEVRELIDASPYAKKYTSGVLSFAEQDLPPGQRLKRLMASFQRVLMPGLDKDHYTVLWVEHRDKGPAGAELPDPKPRNCLTANGPTIL

SEQ ID NO: 6243 - protein, 143 aa, Enterobacter cloacae
MPLTRLRLAQHRADREKISRPSRRYQEAGLADKRSKMLTMWVTEDEHRRLLERCDGKQLAAWMRQTCLDEKPARAGKLPSISPALLRQLAGMGNNLNQIARQVNAGGSSGLDRVQVVAALMAIDAGLERLRHAVLEKGADDDR

SEQ ID NO: 6244 - protein, 330 aa, Enterobacter cloacae
ARTRRFVMVHRSMLMSKKEQTLMTPYLQFNRSQWAALRDSVPMTLTEGEIARLKGINEDLSLEEVAEIYLPLSRLLNFYISSNLRRQAVLEQFLGTNGQRIPYIISIAGSVAVGKSTTARVLQALLSRWPEHRSVELITTDGFLHPNEVLKERGLMKKKGFPLSYDMHRLVKFVSDLKSGVPHVTAPVYSHLIYDRIPDGDKTVVQPDILILEGLNVLQSGMDYPHDPHHVFVSDFVDFSIYVDAPEDLLQRWYINRFLKFREGAFTDPDSYFHNYAQLSEEEAISVATGLWNEINYVNLKENILPTRERASLILTKSEKHAVDQIRLRK

SEQ ID NO: 6245 - protein, 394 aa, Enterobacter cloacae
IISRVFSLSLWERAGVWGVHAPPHPNPLPQGEGIYICEQYRRHATECASSERIRVMLQFILRRLGLVIPTFIGITLLTFAFVHMIPGDPVMIMAGERGISPERHAQLLAELGLDKPMWQQYLHYIWGVLHGDLGISLKSRLPVWDEFVPRFKATLELGICAMIFATAVGIPVGVLAAVKRGSIFDHTAVGLALTGYSMPIFWWGMMLIMLVSVQWNLTPVSGRVSDMVFLDDTNPLTGFMLIDTAIWGEEGNFIDAVAHMILPAMVLGTIPLAVIVRMTRSSMLEVLGEDYIRTARAKGLTRMRVIIIHALRNAMLPVVTVIGLQVGTLLAGAILTETIFSWPGLGRWLIDALQRRDYPVVQGGVLLVATMIILVNLLVDLLYGVVNPRIRHKK

SEQ ID NO: 6246 - protein, 303 aa, Enterobacter cloacae
GAIMSQVTQNKVVTAPVPMTPMQEFWHYFKRNKGAVVGLVYVSIMILIAVFANVLAPYNPADQFRDALLAPPAWQDGGSLAHLLGTDDVGRDVLSRLMYGARLSLLVGCLVVVLSLIMGIVLGLVAGYFGGIVDNIIMRVVDIMLALPSLLLALVLVAIFGPSIGNAALALTFVALPHYVRLTRAAVLVEVNRDYVTASRVAGAGAMRQMFISIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 6247 - protein, 343 aa, Enterobacter cloacae
CREANTMSTHQATTQQPLLQAIDLKKHYPVKKGIFAPERLVKALDGVSFSLERGKTLAVVGESGCGKSTLGRLLTMIETPTGGELYYQGQDLLKHDPQAQKLRRQKIQIVFQNPYGSLNPRKKVGQILEEPLLINSNLSKEQRREKALAMMAKVGLKTEHYDRYPHMFSGGQRQRIAIARGLMLDPDVVIADEPVSALDVSVRAQVLNLMMDLQQDLGLSYVFISHDLSVVEHIADEVMVMYLGRCVEKGTKDQIFTNPRHPYTQALLSATPRLNPDDRRERIKLTGELPSPLNPPPGCAFNARCRRRFGPCTQLQPQLKDYGGQLVACFAVDQDENGEKPHA

SEQ ID NO: 6248 - protein, 75 aa, Enterobacter cloacae
GWCYKPFEDLIQPARATDDHNKRIELYKQAQVVMHDQAPALIVAHSTVYEPVRKEVKGYVVDPLGKHHFENVSVE

SEQ ID NO: 6249 - protein, 333 aa, Enterobacter cloacae
SSKRHEMALLNVNKLSVHFGDEGTPFRAVDRISYSVNQGEVVGIVGESGSGKSVSSLAIMGLIDYPGRVMAENLEFNGQDLKRISEKQRRQLVGAEVAMIFQDPMTSLNPCYTVGFQIMEAIKVHQGGNKKTRRQRAIDLLNQVGIPDPASRLDVYPHQLSGGMSQRVMIAMAIACRPKLLIADEPTTALDVTIQAQIIELLLELQQKENMALVLITHDLALVAEAAHKIIVMYAGQVVETGSSHDIFRAPRHPYTQALLRALPEFAQDKARLASLPGVVPGKYDRPQGCLLNPRCPYATDKCRAEEPELNLLADGRQSKCHYPLDDAGRPTL

SEQ ID NO: 6250 - protein, 406 aa, Enterobacter cloacae
QSSTIVMSFCTEVVMKDVVIVGALRTAIGCFQGALARHSAVDLGSVVVRALVERSGIAAHEIDEVILGQVLTAGAGQNPARQAALKGGLPNTVSAITINDVCGSGLKALHLATQAIQCGEADVVIAGGQENMSRAPHVLTDSRTGAQLGNSQLLDSLVHDGLWDAFNDYHMGVTAENLAREYGISRELQDAYALSSQQKARAAIDSGRFRDEIVPVSTQRQNGEALIVDTDEQPRTDASAEGLAKLDPAFETLGSVTAGNASSINDGAAAVMMMSESKAQELALPVLARIKAFASVGVDPALMGIAPVYATRRCLERAGWELSDVDLIEVNEAFAAQAISVGKMLEWDPLRVNVNGGAIALGHPIGASGCRILVSLVHEMKKRNARKGIATLCIGGGQGVALAIER

SEQ ID NO: 6251 - protein, 238 aa, Enterobacter cloacae
KRNVILIEGFFMFKKSLLLASLISASFAASAVTVDLRHEYIDSGSNADRVAVSHRFDNGFGFSVEAKWKSGGDKADQPFADVVGNGHEDQISWRWKATDNIALTPAFTIESTDSRTIYKPNLHVQYSFDNGFYVAARYRYEYTRYPSSSNKDDDKVNRGDAWVGWVLGDWRTELNYVYAKSSEGVARNNNKDYSNEYNAKLAYKWDKNWAPYVEVGNVGVKDTDERQTRFRLGVAYSF

SEQ ID NO: 6252 - protein, 108 aa, Enterobacter cloacae
SRYIMRYSPEALTAFVETVAAGSFSAAARRLRKSQSTISTSIANLEADLGFELFDRSARHPVLTAQGEQVLGYVQSILAASARLDELAVSLTAQKEGPVLTFVLSDTL

SEQ ID NO: 6253 - protein, 184 aa, Enterobacter cloacae
PAVLEQMMSKFDQRFPHTEFECLIGEEEDVIDLLQKERAQIGLTEARDSYPTDIGATRLPMQTRMAIYVSAGHPLAGQHETQADELHGWRELRLSTYLEREAPLARGPVWSAPNYLLLLSMAVQGFGWCALPCALVDEFAASKSLVQLNVPGWPRSIAIDLVWNKRTPPGVAGSWLRQYLQDAR

SEQ ID NO: 6254 - protein, 92 aa, Enterobacter cloacae
YVALMSKIWSKEETLWSFALYGTAVGAGTLFLPIQLGSAGAIVLLITALVAYPLTYWPHKALAQFILSSKTKGNAGITSSPAGAGRIQRNAY

SEQ ID NO: 6255 - protein, 475 aa, Enterobacter cloacae
  UNSURE (238)
PVTLTTLNTLSGKTRRFDMAYQTVNPATNQLIKEYPSHTDADVEAALKAADALYHSEWAKGDISQRLPVLHKLADLIDERVEDLAKIASQEMGKLIEQSRGEVKLCAQIARYYADNAKQFLAPVKYDSELGEAWVEHHPIGVLMAVEPWNFPYYQLMRVLAPNLAAGNPVIAKHASIVPHCAETFAQLVRESGRPRKGAWTNLFISSEQVANIIADDRVQGAALTGSEKPGSVVAAQXAKHIKKSTLELGGNDVFVVLDDAELEKAVKIGVNARLNNAGQVCTAAKRFILHEKIADAFLSKFTEAFKQVKIGDPLDESTTLGPLSSKDALETLTKQVNEAVKNGAKLHHGGKPVQRDGSFFEPTILTNISRDNPAYFEEFFGPVAQIYVVKNDDEAVALANDSHYGLGGAVFSQNIERAKKMASRIETGMVYINWLTDTAAELPFGGVKRSGYGRELSDLGIKEFVNQKLVVVRK

SEQ ID NO: 6256 - protein, 620 aa, Enterobacter cloacae
IGRRNMAIIIPTVSSCSEKITAGEKRLARLLEGGLSEQCTCWYDTRMGDKDDHPDFVILAPDKGLLFIEVKDWYITKIKSANKTHINYETKNGIEPLKNPLEQVRQYTFHIINSLKKDPLLRQKQGDHEGGFIMPYGYGVYLSNITRAQLEKSFTPEELNEILPASQVICKDELNEFMTREQISGRLESLLKHHFVHNTTPQQLDRIRWHLYPDVRINPSVTRVGLDNFTFHTPDVVCMMDRNQEQLARSMGAGHRVIHGVAGSGKTLILHHRCIELANNIENTKPILVICYNITLAKKLKAQLEQHSLRLPVEVIHFHAWCYQQLNAHRRLPPRSKNFIELMENALTVAFEEGAITPEQYSAVLIDEGHDFKPEWLRILAKMPDNKDSSLLFLYDDAQSIYQKKKALDFTLSSVDIKAQGRTTILDTNYRNTRQILHFASSVPFNYLNNHIEASLKYQQPAAGGLSGKYPALASFDNQDEEITRVLDWVTEQRQEGVAWSEIAILCPSTYSISGMLAPRLEARKIPYQMIVSSDDKKHWSPQNDYLCVMPLPSSKGLEFNSVAIMDAAKERDSEDLSDDIKRLYVGITRARQNLLVTMHGTGSLRDHLVETWEKSVKSI

SEQ ID NO: 6257 - protein, 188 aa, Enterobacter cloacae
FDDEETRMKKLNVLILSALTAVSGSALAMGGSIEQGKNFTNLNVEMGKSTSGLYTEGNWLKNTDDGTTTGGVGAGYNFEVGPVMLNAGAKALYVGPKKGDNGVAFPVGGGVNVALTDSIRVFGEGYVAPDGLNNSVKNYVEANGGVSWTPVKPVTLKVGYRHVSVDGKDGRPNHTLVDGAYFGGGVSF

SEQ ID NO: 6258 - protein, 73 aa, Enterobacter cloacae
GILQMAKIKGQVKWFNESKGFGFITPADGSKDVFVHFSAIQGNGFKTLAEGQNVEFEIQDGQKGPAAVNVTAI

SEQ ID NO: 6259 - protein, 592 aa, Enterobacter cloacae
IRALINSPGVKVKKKTITTTGNFTPARFALLCLAIFCSLAFLLGRVAWLQIIKPDNLVKQEDMRSLREVAIDAPRGMIVDREGRPLAVSVPVQAVWADPKTVLEKGGIGYDSRWQALANALHLSLSTLASRINSNPHGRFIYLARQVDPSQAKWIDKLRLPGINLRDESRRFYPAGHVAANLIGFTNIDGQGIEGVEKSFNTQLTGKAGVRLVRKDRYGHVVENLTEVAPVPAHNIQLSIDERLQTITEDALDNAVAWNKAESGASVLINIQTGEILAMASFPDFNPNNREGATLDDFRNRAISDTFEPGSTVKPLVLMTALQQGLVQPDSVIDTHPYTIDGHRIRDVGYYPELTMTGILQKSSDTGVSRLSLAMPVQRLLDTYKHFGFGESTGLGLTGESAGLLPQRKFWSQLDRATFAFGYGLMVTPLQLAHVYATIGSYGIERPLSITRIDPPVIGKRVMPEEIVHEVEHMMESVALPGGGGIKAAVRNYRVAIKTGTAKKIDEHGKYVDKYVAYTAGVAPASDPRFALVVVINDPQNGAYYGGAVSAPVFSEIMGNVLRLENVKPDGLPADSDHLIVMHHPAVYNPGE

SEQ ID NO: 6260 - protein, 284 aa, Enterobacter cloacae
RYTSPFGLRPGAVMSFSCPLCHAPLTRAEKTFICPQGHQFDRAKEGYVNLLPVQHKRSRDPGDSAEMMQARRAFLDAGHYQPLRDAVVALLREYLTEGASAMLDIGCGEGYYTATFADVAAEKGAETYGLDVSKVAIRAAAKRYSAVTFCVASSHRLPFEEASMDAVVRIYAPCKAEELARVVKPGGWVITVTPGPRHLLELKGLIYDEVHLHAPHSEQLAGFALKQAQSVAYEMTLQGSEAVALLQMTPFAWRAKPEVWETLAAQTEFRCQTDFSIHCWQREG

SEQ ID NO: 6261 - protein, 141 aa, Enterobacter cloacae
NSIPRPRLRLLFNAVRLLTRYYGVAYGYRKGVDIVKDMGGGFLQKLTEGASILGLFVMGALVNKWTHVNIPLVVSTITGQDGQTRVTTVQTILDQLMPGLVPLLLTFACMWLLRKKVNPLWIIVGFFVIGIAGYAVGLLGL

SEQ ID NO: 6262 - protein, 152 aa, Enterobacter cloacae
MTVTDTVLVLFIVALLAYAIYDEFIMPRRHGETLLTLPLLRRGRIDAFIFAGLVVILIYNNVTSHGAILTTWLLCALALMAIYLFWIRSPKLIFKKHGFFFANVWIEYNRIKEMNLSEDGVLVMQLEQRRLLIRVRNIDDLEKIYKLLVKTQ

SEQ ID NO: 6263 - protein, 257 aa, Enterobacter cloacae
GCARRWGVADFLPAGNVRVNILVEKRGAYGSFLSTITVPEAIRRDHRYINCCLLGAVMCHMDIPGLDALMNISATILLAFGMSMDAFAASIGKGATLHKPKFSEALRTGLIFGAIETLTPLIGWGLGMLASQFVLEWNHWIAFVLLVFLGGRMVIEGFRGNGDEDDAPLQRHGFWLLVTTAIATSLDAMAVGVGLAFLQVNIIATALAIGCATLIMSTLGMMVGRFIGPLLGKRAEILGGIVLIGIGAQILWAHFAG

SEQ ID NO: 6264 - protein, 67 aa, Enterobacter cloacae
FSRLEYLPVTQGVAGSSPVRSANIQAHVTCNVGLFVFPLSHVFLNFCSGTSAENHIYTILFFVFNQF

SEQ ID NO: 6265 - protein, 1208 aa, Enterobacter cloacae
ISPRTLSMTENKVILAVNNGDGKTRLLTADAGRTVKVKLIPGNKYLLKNVNDDFAPENITLQRVGKALHIIQEGDTQPSIIIENYFDGDSKNPTLMGMAEDGLLYAYIPLSGESYDNGYLMAEGGLAPVALGGEPLGAGGPLLSAPDDENDMLFGMLGWFALAAAGVGAAFALSELDKDESDSQPAPEKPSIGKAVDDEGSIKGPLKSGDVTDDSTPSLIGKGKPGDTIHIIDNDKEIGSVIVDDEGEWSYTPDKPLGEGEHDLSVVVEDPDGNMSPPSDPITIVVDTVAPDAPTIEHIMDKVGKVTGEILEDAYTDDPKPEMSGTGEAGATITIYDNGKKIGETSVNDDGRWYFKPSENLTDGNHSITVSQTDKAGNVSEPSDERDFIVLTEPPGKAETPSVIDDNGPVTGPLKPGDVTDDTKPSFSGEGTPGNTIVIKDNDKEIGSVIVDDEGKWTYTPEKDLSEGEHNVEVIEEDPLGNVGQPSDPIQIIVDTTPPARPDRVYAEDNTGPITGQLKGGDVTDETRPVFSGKGEPGDTVTIYDGDEVLGSTVIDDEGNWSLKPEKPLGEGDHSITVTQTDKAGNTSDPSEALEFEVDTTAPAASADVLKITAVADDVGDRQGNVASGEITDDSKPLISGIGEAGNTVYVYTTDASGKHLIGSAVVGSDGTWSLTPETPLTEGLNQLTLETQDPAGNRVAGDAPSYDINLMIPISTQPSINSVVDNSEPHVGPLQKGDATNDTTPTLSGSAAPGDIVSILDNGKVIGSVTADSNGKWTFTPDAALADGKHTFTVTATDAAGNSRTSGSFPIVIDTAAPSPAENIVINDNVGDKQGPVGSGDTTDDQSPTLSGEAEPGSVVDIYDNDEKIGSVIVDDEGKWSYTPDKPLDKGDHEITTTVTDPSGNTSEPSPGISFTVDPDPNQVTVGEVVDDQGPIVGNLKPGTVTDDVRPELSGKGKPGSTVTIKDGDDVLGSTVVDPDGNWTFTPEQDLADGNHSLTVVSKDPAGNEVTSPSFDITVDATAPEKPVLGSATDDVGTIRGDLSNGSTTDDANPTFNGSAEPGIHQLVKRFQGRFGMLITQRQPDNGCQRGERTAGKDHYANHGAHRELARVDQIHTQHNNTDRGNLLNEGDKIGSQHGKVAGFHGGSGSQRAEIIPALLHNAFTLRSFQGFKSLNAFNQQALLERNLANVFFHIATQRPLNNDAGN

SEQ ID NO: 6266 - protein, 189 aa, Enterobacter cloacae
NKCVCPSFRTEQQGECNGSEFYIWPENNSFLIEGILQYFNNITVKIISQPIVVIDFNYKNINFFLTNSWLDRFKNARLILITDKKMAAIAHYWFYNDTSETIISTVIFHDDIIDDIKFKIRQSFLGKITRPSEKKAKLSANEYALFSELYKGQLPKKIAMKNATNVKNIYAMKIRIENKLGVPISRLAS

SEQ ID NO: 6267 - protein, 601 aa, Enterobacter cloacae
KNINLDQSTYNILNHAVVYLYCVHIRLTLHYDIASACNFTITISHKLRTYGCSWSILIACLHFIFKVRNVTTGLDSIMNTHLSTVKFNSEHDFNNIEEPRKDSLLWGVEWLCAHHAKYASKEVLYAGLPKSDKLEPEMALRMLDQMGISAGWVKRDLNSISSWLFPLLIARKDGTYCIITARNGKRGQFTYQIVVPENEGILTVSAADLLEVYGGYALVTTPKPSLDARADDLLLPKAQNEGHWLYSTLWRYRHYFYSAALAALLANILTLAGTFFTMNVYDRVIPTQAYVTLWSLAIGVVIANIFEFSSRQIRAYLIDIAGKKADLILGAKLFRQVMSMRMEYKPQSSGTFANQLRDFEAVRDFITSATLATLSDLPFCVLFMFIIYMIGGPLAVVPLVAMPLILIASIVIQWPLGRYMEENVREISLKQGLLIESIEGLEALKAAQGEGVMQKRWDDFSALAAASSMKTRNLSMLTTNFVSFVQQITTVCIVVLGVYLIHAGELTMGAMIGVVILSSRSLAPLASVVGLALRYQHAKTALKSLNQLMDARLCRAVEGWVCVVGGAAVAQIAANSAHVIRCGSQHRFFRRGRIDGDIEGR

SEQ ID NO: 6268 - protein, 329 aa, Enterobacter cloacae
KTAALPGAQGGRMSAFARRLETLHATRPVTVLGAAVIDVIADAYALPWRGCDIELKQQGVNIGGCALNIAIALKRLGIAAQNALPVGHGVWADIIRNAMAKQDLHSAVEAETGDNGWCLALVEPDGERTFMSFSGVENQWQQRWLDGLSVPAGSLISLSGYQLASPSGELLTAWLESLQDATLFIDFGPRIADIPDPLMARIMACKPIVSLNRQEAELAAEWLGVSVEELGTRWQQRFGAALIIRHDKDGAVWYDGDASGHVPAFPATVVDTIGAGDSHAGGTLAGLAAGWSLPEAVQLGNAVAAWVVSHRGGDCAPTREALLLAHKDV

SEQ ID NO: 6269 - protein, 334 aa, Enterobacter cloacae
MKQDRILGALYGQALGDAMGMPSELWPRKRVKAHFGWIDRFLPGPAENNAACYFKQAEFTDDTSMALCLADAIIECEGEINPDVIGKHILDWALDFDAFNKNVLGPTSKIALNAIRDGKPVSQLENNGVTNGAAMRASPLGCLLPATRLAHFVEQVALASSPTHKSDLAIAGAVVIAWAVSRAIDGERWQNIADALPGIARAAQEANTTTFSASLSARIELALKTVREANGTESASEQIYQLIGAGTSTLESVPAAIAMVELAGTDPNRCAVLCANLGGDTDTIGAMATAICGALHGVQAIDPALKNELDAVNRLDFGHYCEKLLHFREHREGV

SEQ ID NO: 6270 - protein, 411 aa, Enterobacter cloacae
WFIWGAWFVPLWLWMSKSGFTAGEIGWSYACTAIAAILSPIMVGSLTDRFFAAQKVLAVLMFAGAILMYFAAQQIQFSTFFPLLLAYSLTYMPTIALTNSIAFANVDDVEADFPRIRVMGTIGWIASGLACGFLPQMMGYSDISDTNIPLLMTAASSLLLGVFALFLPNTPPKSTGKLDFKVMLGLDALILLRDKNFLVFFFCSFLFAMPLAFYYIFANGYLTEVGMKNATGWMTLGQFSEIFFMLALPFFTKRFGIKKVLLLGLITAAIRYGFFVYGGAEQYFTYALLFLGILLHGVSYDFYYVTAYIYVDKKAPVHMRNAAQGLITLCCQGFGSLLGYRLGGVMMEKMFAYKEPVNGLTFNWAGMWTFGAIMIVVIAVLFMLFFRESDKEITAIEVVDGDTALTRGEVK

SEQ ID NO: 6271 - protein, 298 aa, Enterobacter cloacae
TTYPFGSWPASRCVKTLCLRVSGRALRAGGTGMTRINALTIAGTDPSGGAGIQADLKTFSALGAYGCSVITALVAQNTRGVQSVYRIEPDFVAAQLDSVFSDVRIDTTKIGMLAEADIVEAVAERLKRYQIKNVVLDTVMLAKSGDPLLSASAVDTLRKKLLPQVALITPNLPEAAALLDAPHAQNEREMKEQGNALLAMGCRAVLMKGGHLDDAESPDWLFTHDGAQRFTAPRVQTKNTHGTGCTLSAALAALRPRNANWADTVQEAKIWLSDALAKADSLEVGHGIGPVHHFHAWW

SEQ ID NO: 6272 - protein, 262 aa, Enterobacter cloacae
AVYWHKTLCQRKTEMEQAHTRLIAQLKERIAAPDNTPLYLKFAETVKNAVRSGVLAHGNILPGERDLSQLAGVSRITVRKAMQALEEAGVVTRARGYGTQINNIFEYSLKEARGFSQQVVLRGKTPNTLWVNKRVVKCPEEIARHLSLAPDSDVFLLKRIRYVDDDAVSIEESWVPVGLIPNPDDIGVSLYDYFRSQNIFPQRTRSRVSARMPDSEFQAHIKMDDKIPVLVIKQVALDQQHRPIEYSISYCRSDLYVFVCEE

SEQ ID NO: 6273 - protein, 542 aa, Enterobacter cloacae
TNIMNTTPELHCDVLIIGSGAAGLSLALRLAEHQNVIVLSKGPMSEGSTFYAQGGIAAVFDETDSIASHVEDTLIAGAGIVDEHAAEFVASNARHCVQWLIDQGVLFDTQVQPNGEESYHLTREGGHSHRRILHAADATGKAVETTLVSKALSHPNIRVLERSNAVDLIISDKIGLPGTRRVVGAWVWNRNKEKVETCQAKAVVLATGGASKVYHYTTNPDIASGDGIAMAWRAGCRVANLEFNQFHPTALFHPQARNFLLTEALRGEGAYLKRPDGSRFMPDFDPRGELAPRDIVARAIDHEMKRLGVDCMYLDISHKPADFIRQHFPMIYEKLLSLGIDLTRDPVPIVPAAHYTCGGVMVDDHGRTDVDGLYAIGEVSYTGLHGANRMASNSLLECLVYGWSAAEDITKRMPYARPTTHLPAWDESRVENPDELVVIQHNWHELRLFMWDYVGIVRTTKRLERALRRIMMLQQEIDEYYANFRVSNNLLELRNLVQVAELIVRCAMMRKESRGLHYTLDYPEPLETSGPSVLTPQVHIKR

SEQ ID NO: 6274 - protein, 443 aa, Enterobacter cloacae
NMTVTTFSELELDESLLNALESKGFTRPTAIQAAAIPPALEGRDVLGSAPTGTGKTAAYLLPVLQHLLDFPRKKSGPPRILILTPTRELAMQVAEHARELAANTHLDIATITGGVAYMNHAEVFSENQDIVVATTGRLLQYIKEENFDCRAVETLILDEADRMLDMGFAQDIEHIAGETRWRNQTMLFSATLEGDAIKDFAERLLEDPVEVSATPSTRERKKIHQWYYRADNLEHKVELLKHLLKQEEATRTIVFVRKRERVHELAEMLRNAGINNCYLEGEMAQVKRTEGIKRLTDGRVNVLVATDVAARGIDIPDVSHVINFDMPRSGDTYLHRIGRTGRAGRKGIAISLVEAHDHLLLQKIGRYVEEPLKARVIDGLRPTTRAPSEKMTGKPSKKALAKRAERKEKEKEKPRVKQRHRDTKNIGKRRKPSSAASETKTEE

SEQ ID NO: 6275 - protein, 131 aa, Enterobacter cloacae
GRQHMITGIQITKAANDDLLNSFWLLDSEKNEARCVVAKAGFAEDEIVPVSKLGEIEYREIPMQVQPEVRVEGGQHLNVNVLRRETLMDAVEHPEKYPQLTIRVSGYAVRFNSLTPEQQRDVIARTFTESL

SEQ ID NO: 6276 - protein, 362 aa, Enterobacter cloacae
FFTRKVEQMLQHRQQVGCCLPRAGWRRTEHIAALKRRRNGRGLNGGRACKAFALKGIEQAFIEFKFGKSRYSHVLPLCGALIIDVTAVIFICLYGYRFSTTSLSPMLLQFHSEGCPDMSQLKAQLRRDGFTFKQFFVAHDRCAMKVGTDGILLGAWAPVAGVKRILDIGTGSGLQALMLAQRTEEHVTIDAVELDPQAARQASENAADSPWAERIRVECADVLTWAPEQTARYDLIVSNPPYFTPGVECGTPEREQARYTGSLDHKALLTSAAELISEEGFFCVVLPESTGNTFIEIAHEIGWNLRLRTDISDTEGRLPHRVLLALSPKEGECFIDRMVIRGPDQRYSEDYTALTQAFYLFM

SEQ ID NO: 6277 - protein, 138 aa, Enterobacter cloacae
SGVSITRGIWFGETLPRMSEQLTDQVLVERVQKGDQKAFNLLVVRYQHKVASLVSRYVPSGDVPDVVQESFIKAYRALDSFRGDSAFYTWLYRIAVNTAKNYLVAQGRRPPSSDVDAIDAENFESGGALKEISNPDNL

SEQ ID NO: 6278 - protein, 304 aa, Enterobacter cloacae
YVFITKTERCFVIYLCLRARSILEVYVDVRQSIHSAHAKMLDTQGLRSEFLVEQVFEADKYTMVYSHIDRIIVGGIMPVAKTVSVGGEVGKQLGVSYFLERRELGVINIGGPGTITVDGQCYEIGHRDALYVGKGAKEVVFASSDASKPAKFYYNCAPAHTTYPTKKVTPADVAPVTLGDNLTSNRRTINKYFVPDVLETCQLSMGLTELAPGNLWNTMPCHTHERRMEVYFYFNMDEDACVFHMMGQPQETRHIVMHNEQAVISPSWSIHSGVGTKAYTFIWGMVGENQVFDDMDHVAVKDLR

SEQ ID NO: 6279 - protein, 256 aa, Enterobacter cloacae
GTNMILDAFSLQGKVAVVSGCDTGLGQGMALGLAEAGCDIVGINIVEPTETIERVTALGRRFLSLTADLRKIDAIPELLDRAVAEFGHIDILVNNAGLIRREDAINFSETDWDDVMNLNIKSVFFMSQAAAKHFIAQGKGGKIINIASMLSFQGGIRVPSYTASKSAVMGVTRLLANEWAQHNINVNAIAPGYMATNNTQQLRADEERSAAILERIPAGRWGLPSDLMGPVVFLASPASDYINGYTVAVDGGWLAR

SEQ ID NO: 6280 - protein, 518 aa, Enterobacter cloacae
RISLLRQETMTSVNDSTLMPAALRDTRRMNQFVSVAAAVAGLLFGLDIGVIAGALPFITDHFTLSNRLQEWVVSSMMLGAAIGALFNGWLSFRLGRKYSLMVGAILFVAGSLGSAFATNVEVLLLSRVLLGVAVGIASYTAPLYLSEMASENVRGKMISMYQLMVTLGIVLAFLSDTYFSYSGNWRAMLGVLALPAVLLIVLVIFLPNSPRWLAQKGRHVEAEEVLRMLRDTSEKAREELNEIRESLKLKQGGWSLFKANRNVRRAVFLGMLLQAMQQFTGMNIIMYYAPRIFKMAGFTTTEQQMIATLVVGLTFMFATFIAVFTVDKAGRKPALKIGFSVMALGTLILGYCLMQFDNGTASSGLSWLSVGMTMMCIAGYAMSAAPVVWILCSEIQPLKCRDFGITCSTTTNWVSNMIIGATFLTLLDAIGAAGTFWLYTVLNVAFIGVTFKLIPETKGVNPGTYLNATLKKMGKTPVISGFYVIARGVPPTFRGALLPFAPSVTTLVSACSPQHFSS

SEQ ID NO: 6281 - protein, 247 aa, Enterobacter cloacae
FSTYITRSKECIMAKGMRVKLNYEVSRDPDTGVEVTRLTPPEVTCHRNYFYQKCFFNDGSHLLFAGEFDGHWNYYLLDLKNAEAVQLTEGAGDNTFGGFLSPDDKSLYYVKNDRTLLEVDLQTLAEREVYRVPEEWVGYGTWVANSDCTKLVGIEIARCDWTPLNDWKIFHDFFHKGPHCRLLRVDLKTGESTTIHDEKIWLGHPIYRPFDDNTVAFCHEGPHDLVDARMWLVNEDGSNVRKVKTHA

SEQ ID NO: 6282 - protein, 286 aa, Enterobacter cloacae
YGLDPATGPIGRPAMVSKKKTRVVDDVVKNAPLKTKTYEQELRRLHVELVKLQQWVVAKGLKVCIVFEGRDGAGKGGVIKAITERVSPRVFRVVALPAPTDKEKSQLYFQRYVPHLPSAGEIVIFDRSWYNRAGVEKVMGFCTEEQAEKFLDGTPVMEKAMVDAGIILLKYWLEVTPKEQERRLRDRINDGRKIWKLSPMDIKSFNLWDEYTLARDAMFKATDTAWAPWFVARSEDKKRVRLNIISHLLSQIPYKEIHVDKVDLPKRKIGKVKPTKYPFRYIAERF

SEQ ID NO: 6283 - protein, 309 aa, Enterobacter cloacae
RIDAISFPFDFLKTGRVMDRKRATLTGLAAILLWSTMVGLIRSVSEGLGPVGGAAMIYTVSGLLCLVTVGFPDLRRFSRRYLFAGSILFVSYEMCLALSLGYAATRSQAIEVGMVNYLWPSLTIAFAILFNGQKSTLWVIPGLLISLLGVCWVLGGENGLQLNDIMQNVVSSPLSYGLAFAGAFIWAAYCTVTSKYAKGQNGITLFVLLTALSLWVKYAVSDQPEMVFSVPVVVKLLMCGVALGFGYAAWNIGILHGNVTVLAAVSYFTPVLSAALAAIVLSSPLSFSFWQGALMVCAGSLLCWYATRK

SEQ ID NO: 6284 - protein, 177 aa, Enterobacter cloacae
GLFKMKLKLVAVAVTSMLAAGVVNAAEVFNKDGNKLDLYGKVTGLHYFSDDAGSDGDKTYVRLGFKGETQINDQLTGYGQWEYEFKGNRSEAQGSDGNKTRLAYAGLKFDEFGSFDYGRNYGVAYDIGAWTDVLPEFGGDTWTQTDGFMTGRTTGVATYRNTDFFGLVDGLNVAAQY

SEQ ID NO: 6285 - protein, 93 aa, Enterobacter cloacae
FDAIKKGALLLVCRAKSYQITRTTMDVSRRQFFKICAGGMAGTTAAMLGFAPKMALAQARNYKLLRAKEIRNTCTYCSVGCGLLMYSLGDGAK

SEQ ID NO: 6286 - protein, 110 aa, Enterobacter cloacae
SRGALCPERGGAVGLRSTVKTVLRYPEYRAPGSDKWQRISWDDAFSRIAKLMKADRDANFIEKNEQGITVNRWTSTGMLCASAASNETGMLTQKFVRSLGMLAVDNQARV

SEQ ID NO: 6287 - protein, 819 aa, Enterobacter cloacae
HGPTVASLAPTFGRGAMTNHWVDIKNANVVVVMGGNAAEAHPVGFRWAMEAKNNNDATLIVVDPRFTRTASVADIYAPIRSGTDITFLSGVLLYLIENNKINAEYVKHYTNASLLVREDFAFEDGLFSGYDAEKRQYDKSSWNYQFDENGYAKRDETLSDPHCVWNLLKQHVSRYTPDVVENICGTPKADFLKVCEVLASTSAADRTTTFLYALGWTQHTVGAQNIRTMAMIQLLLGNMGMAGGGVNALRGHSNIQGLTDLSLLSTSLPGYLTLPSEKQTDWQSWLDANTPKATRPDQVNYWSNYPKFAVSLMKSFYGDAAQKENDWGFEWLPKWDQAYDVIKYFNMMDKGDVTGYICQGFNPVASFPDKNKVVRSLSKLKYMVVIDPLVTETSTFWQNHGESNDVDPASIQTEVFRLPSTCFAEEDGSIANSGRWLQWHWKGQDAPGEARNDGEILAGIYHRLREMYRTEGGKGAEPLLKMSWNYKQPDHPESEEVAKENNGVALADLYDANGNLVAKKGQLLNSFALLRDDGTTASSCWIYTGSWTEQGNQMANRDNADPSGLGNTLGWAWAWPLNRRVLYNRASADVNGKPWDPKRMLIEWNGTKWTGNDIPDFNTAAPGSNTGPFIMQPEGLGRLFAIDKLAEGPFPEHYEPMETPLGTNPLHPNVVSSPVVRIYEDDVLRLGKKDKFPYVGTTYRLTEHFHTWTKHARLNAIAQPEQFVEISETLAKAKGIANGDRVKVSSKRGFIRAVAVVTRRLQTLNVHGQQVETVGIPLHWGFEGVAQKGYIANTLTPNVGDSNSQTPEYKAFLVNIEKA

SEQ ID NO: 6288 - protein, 238 aa, Enterobacter cloacae
FITTSVSGRIKRWMTTRRSIMSKSKMIVRTKFVDRACHWTVVICFFLVAVSGISFFFPTLQWLTETFGTPQMGRILHPFFGVLIFVVLMFMFVRFVHHNIPDKQDIPWLKGIVEVLKGNEHKVAKVGKYNAGQKMMFWTIMSMIFVLLVTGVIIWRPYFAHYFPIQVVRYALLIHATSAIILIHAILIHMYMAFWVKGSIKGMIEGKVSRRWAQKHHPRWYRDVERLEAQKESSEGLK

SEQ ID NO: 6289 - protein, 89 aa, Enterobacter cloacae
FELVHHTSLINNARCVFFNSGRGMKKTIFSLALATFGLGMAEFGIMGVLTELAHDTGISIPSAGNMISFYPFGVVISAPIVALFSTNFR

SEQ ID NO: 6290 - protein, 294 aa, Enterobacter cloacae
MAMETQDIIKRSATNPITPAPRARDYKAEVAKLIDVSSCVGCKACQVACSEWNDIRDEVGHCVGVYDNPADLSAKSWTVMRFSETDQNGKLEWLIRKDGCMHCEDPGCLKACPSAGAIIQYANGIVDFQQDNCIGCGYCIAGCPFNIPRLNKEDNRVYKCTLCVDRVSVGQEPACVKTCPTGAIHFGTKKEMLEVAQQRVDKLKARGYDKAGIYNPQGVGGTHVMYVLHHNDQPELYHNLPKDPAIDTSINLWKGALKPLSAAGFIATFAGLIYHYIGIGPNKEVDDDEEEHHE

SEQ ID NO: 6291 - protein, 99 aa, Enterobacter cloacae
WRNCVRIETSLFTTPECMKAITLYDVARVAGVKKKKKKKKKKKKKKKKKKKKKKVRQAMAALHYVPNRGAQQLAGKRTRTLGPITSIYLAAGTIQRLQL

SEQ ID NO: 6292 - protein, 150 aa, Enterobacter cloacae
PGQRCCCCGSRCVSCRGLGTISNVICIVQAADASMALIPELTSLPVRITLLVSGIVVNALATGMYIGAGFGAGPRDGLMTGIHARLGWSIRSVRTAIEVTVLIVGYLLGGAFGVGTVLYALTIGPLIQLCLPWFRQRPRIQKAAQPERIV

SEQ ID NO: 6293 - protein, 160 aa, Enterobacter cloacae
LQGQAHEGGFMKIGELARKAGCPVETIRYYEKEGLLQAPLRDIENNYRHYDNNHLEKLLFIRRCRSLDMTHEEIRALLLAINNNGKECGPIDAIISAHLAHVQHRINELIALEKQLQELNDVCNADRSVDECGIVQKLTAEDEDRDLPLTVPTDHLGGVH

SEQ ID NO: 6294 - protein, 155 aa, Enterobacter cloacae
VMNIGKASSESGISAKMIRYYEQIGLIPATGRTEAGYRDYAPNDIHRLIFIRSARDLGFSLEEIEGLLKLWNDKSRQSSDVKRLAQEHINDLDRRIESMRQMADTLRVLIQSCAGDERAECPILHRLTIADDISHSGKREGAVQRRSRGNRVSKD

SEQ ID NO: 6295 - protein, 80 aa, Enterobacter cloacae
NLVIRGHMITKTYADSVVKDIVQWVENSLTSTLLVEEIAEKSGYSRWHFQRIFKHATGIALGEYVKPDDYLCCRRVETNY

SEQ ID NO: 6296 - protein, 546 aa, Enterobacter cloacae
GCSISEPNDEKYIMSIQKKQHSNDAETQVSLPIEGMTCASCVGRVEAALTKVEGVESVSVNLATERADILLNTPVERMALIKAIENVGYEVPLTSVELSVQGMTCASCVGRVEKALRAVEGVKDATVNLATERATIRGVAGTDDLIAAIEKVGYEASLVDTRGQNNVEAAEKKDAEKAALKKDLVLATILALPVFIMEMGSHLIPGMHQWIMDTIGLQESWYLQFVLTLLVLVIPGRRFYLKGIPALIRLGPDMNSLVSVGTLAAFGYSMVATFAPGLLPQGTVNVYYEAAAVIVALILLGRFMEARAKGRTSEAIKRLVGLQAKEAHVLRNGVVVDIPINDVVLDDIIEVRPGERVPVDGEVSEGTSFVDESMITGEPIPVEKVPGSLMVGGTVNQKGALRLRATAVGGQTMLSQIIRMVEQAQGSKLPIQAVVDKVTLWFVPVVMLAALLTFLAWLTFGPSPALSFALVNAVAVLIIACPCAMGLATPTSIMVGTGRGAEMGILFRKGEALQLLKDAKVVAVDKTGTLTEGAPRNDRPGVSRRV

SEQ ID NO: 6297 - protein, 851 aa, Enterobacter cloacae
LTGEAIKMSGSVKNSKTQVREESAGCCEKINLIVGSKMQRSEEPAKAHGHAHDHKDCSAELSHKEHGHGSDKHLHREQGHVKGGHAHEGCSHEHSHTDEEHDHGEEEHSHGDHQHKGCNHDHAQDDQADEHHGHSGDCCSGAPTNLSNLGGSKVVAGGLRTEIRIMQMDCPVEENLIKKKLGAMTSVKELDFNLMQRVLTVTHTPDSLEPILVAIRSLGFVPEVSDNNGEKKNIQEKKKPWWPLALAGVAALAAEVMHWADMPDWLEAGLALIAVLLSGLTTYKKGWISIRNGNLNINALMSIAVTGALVLGQWPEAAMVMVLFTIAELIEAKSLDRARNAIGSLMSLTPETAMVQQTDGSWQEVDASSVQPGSIVRVKPGERIGLDGEIVKGQTTINQAPITGESLPVDKMAGDSVFAGTINQSGSFEYKVTAAANNTTLARIIHAVEQAQGAKAATQRFVDRFSQIYTPVVMGISVAVAVLPPLFGAGTWQEWIYKALVMLVIACPCALVISTPVTIVSGLTAAARKGILIKGGVYLEQGRKLKALALDKTGTITHGKPVQTDVMVFNGESELEVRTVAASLASYSDHPVSQAVVNASVDLKKQSVENFEAIVGRGVHGVIAGKDFYLGNLRLAEDLLSCPLEVKATVQSLESLGKTVILFNDGKQVLGLFAVADTVKNTSREAIQQLHHLGVKTVMLTGDNPHTAKAIASQVGIDEARGSQLPEDKHQVVQEYSRIGVTGMVGDGINDAPALAAADIGFAMGAMGTDTAIETADVALMDDDLRKIPAFVKLSRQTYSLLVQNISLALGIKAIFLVLTLMGMGTMWMAVFADVGASLLVVANGLRLLRK

SEQ ID NO: 6298 - protein, 315 aa, Enterobacter cloacae
LRGRPVMTDLELAEGFELNEVLAKVAAVESRSEHPIARAIVESALEKGISLPILTEFDSITGMGVRAIVDGECIEVGADRFMRELGLDVEHFSQTSVRLGNEGKSPLYVAIGGRLAAIIAVADPIKSSTPIAINALHQLGLKVAMITGDNANTAHAIARQLGFDEVVAEVLPEGKVEAVRRLKESYGKVAYVGDGINDAPALAVADIGLAIGTGTDIAVESADVVLMSGNLQGVPNAIGLSKATIGNIRQNLFWAFGYNAALIPVAAGLLYPAYGLLLSPIFAAGAMALSSVFVLGNALRLRRFQPPLMEDAGNH

SEQ ID NO: 6299 - protein, 288 aa, Enterobacter cloacae
TCQRFAAIFRAPVVRALMARLYPNGPADINHFQAAGGVPVLMRELLKGGLLHEDVNTVAGFGLHRYTLEPWLNNGELDWREGASDSLDPQVIATFEQPFSPHGGTKVLSGNLGRAVMKTSAVPEENQVIEAPAVVFESQHDVLPAFDAGLLDKDCVVVVRHQGPKANGMPELHKLMPPLGVLLDRRFKIALVTDGRLSGASGKVPSAIHVTPEAYDGGLLAKVRDGDMIRVNGQTGELTLLVDEAELAARQPHIPDLSASRVGTGREMFGALREKLSGAEQGATCITF

SEQ ID NO: 6300 - protein, 226 aa, Enterobacter cloacae
DDLILTIWREKTLMKNWKTSAEAILTTGPVVPVIVVNKLEHAVPMAKALVAGGVRVLEVTLRTACAMDAIRAIAKEVPEAIIGAGTVLNAQQLAEVTEAGAQFAISPGLTEPLLKAATEGSIPLIPGISTVSELMLGMDYGLKEFKFFPAEANGGTKALQAIAGPFSQVRFCPTGGISPVNYRDYLALKSVLCIGGSWLVPADALEAGDWDRITKLAREAVEGAKQ

SEQ ID NO: 6301 - protein, 839 aa, Enterobacter cloacae
LIMSGESEVAQRQDTLNRYLLYFPRSKNVISDVHSFTGKEILSEPYRYTIRFTSPDLNIAINAVLNQRAEFILRAPNLEASWHGQTSWLPVRQINGTITQFSRLMSSGDEALYECVLEHELALLDQNYRSAVYMNMTVPELVTKLMKDSGHFDGYNIDFDQLSHSYPRREMIVQWKETDLRFIRRLLAEIGIWFRFENHNKVKTETVVIFGDSARRYNFSDKQMPYVRHSGMTSYSEYITDLEDQHGLIPKNVLVRTYFYRDPQSPQTDKTVKTSDIPEGVTTGQHYHYADHYLTAGDFHGEEAETAAFYARLRYERLLNGQSLLGATTSDPELQPGIMFYPSGPVPDGFKSGFVITAMTIRGSRAEHYRAVLSGIPYIQGYTFRPEYLSRPVIAGTVPARVKAIGGDKTYAGLDAVGRYRVKFDFDLDEKRVGFESALVRLGRPYAGDTFGIHFPLLEGTEVAVGFEGGDPDRPFIAHVMHDGSHPDLVTNRNDTRNVIRTAALNKIRLEDRRGQEHIKIATEYGKGQVSVGHLVDAEGKKRGEGVEARTDDWMALRAAKGVMITTEAQPRAGGKQLDMTAAIAQLEKALSLAMTLQQSALTAGASNVETDRQNALSQTLSHLAEPGILAYGKSGIALVTPDSLQLSAGKDLIATAGGNASVNVVKKFSLAVGEKLSLFARKLGIQMIAGAGDITTQAQRGEMHMLSQQDFTLTSTAGKMNGSARKGMQFVCGGGGIRISPTGLVTIFSPTGIELKAPSLKYDGPESVSVPTPSFEKGAFKLRYKLHAGDDPEQILANKKFRLTSASGQVVEGVTDSCGRSPLLDADDLDSYKMEIME

SEQ ID NO: 6302 - protein, 436 aa, Enterobacter cloacae
KNALLLRRSAHAGTGALFPLVRRQPASKNVSQRRAARKRAGAREKLYNRARRVAGVFIYPFTSRLVYSGAIMSAEKLFTPLKVGAVTAPNRVFMAPLTRLRSIEPGDIPTPLMGEYYRQRASAGLIISEATQISAQAKGYAGAPGLHSPEQIAAWKKITAGVHAEDGRIAVQLWHTGRISHSSIQPGGQAPVSASALNANTRTSLRDENGNAIRVDTTTPRALELDEIPGIVNDFRQAVANAREAGFDLVELHSAHGYLLHQFLSPSSNQRTDQYGGSVENRARLVLEVVDAVCNEWSADRIGIRVSPIGTFQNVDNGPNEEADALYLIEELAKRGIAYLHMSEPDWAGGKPYSEAFRQKVRERFHGVIIGAGAYTAEKAEDLIGKGLIDAVAFGRDYIANPDLVARLQKKAELNPQRPESFYGGGAEGYTDYPSL

SEQ ID NO: 6303 - protein, 144 aa, Enterobacter cloacae
SIPLVNEEIMRLLHTMLRVGDLQRSIDFYTNVLGMKLLRTSENPEYKYSLAFVGYGPESDEAVIELTYNWGVDSYELGTAYGHIALEVGNAAEACERIRSNGGNVTREAGPVKGGTTVIAFVEDPDGYKIELIEAKDAGRGLGN

SEQ ID NO: 6304 - protein, 222 aa, Enterobacter cloacae
ETLMSDNAQFTGLCDRFRGFYPVVIDVETAGFNAKTDALLEIAAITLKMDEQGWLVPDTTLHFHVEPFEGANLQPEALAFNGIDPTNPLRGAVSEYEALHAIFKMVRKGMKENDCSRAIMVAHNATFDHSFTMAAAERASLKRNPFHPFVTFDTAALSGLALGQTVLSKACITAGIAFDGTQAHSALYDTERTAELFCEIVNRWKRLGGWPLPMGDEADLQS

SEQ ID NO: 6305 - protein, 282 aa, Enterobacter cloacae
LLLILWIRIDRFCKSHAGMHCGLHLSGDCPVARITKISMTLCALLFTTLSFTPAANASEQARHSAVQKTHLAKSTERKKKTTSKTVKKKITAQTKKTASSKTKTLRSGTHKTTRTTASLVNEKCTVRKGHKTKCAKVTKLADVHKARMQKAQKTAMNKLMGQIGKPYRWGGTSPRTGFDCSGLVYYAYKDLVKFRIPRTANEMYHLRDAAPVNRGELQNGDLVFFRTQGRGTADHVGVYVGNGKFIQSPRSGQDIQITSLSEDYWVRHYVGARRVMTPKTIR

SEQ ID NO: 6306 - protein, 202 aa, Enterobacter cloacae
SKGMSRHTEHDTREHLLATGERLCMHRGFTGMGLSELLKTAEVPKGSFYHYFRSKEAFGVAMLERHYASYHQRLAAHFASGEGDYRDRVLNYYQETLTQFCQQGIISGCLTVKLSAEVCDLSEDMRTAMDKGASGVIALLAQALESGRNEKTLSFSGDPLTQAQVLYSLWLGANLQAKMSRSAVPLESALAHVKNCITAPGV

SEQ ID NO: 6307 - protein, 588 aa, Enterobacter cloacae
GRNTCLWSRHNKMACSATDVCHKQDIKVSLIFHSYTRRIDITNGLLIMWFAKKLHCNDIKFTLGCAFFFTVLNALFIQRSWSIIAPAHLHDVLFAASVPLVLFCGWVIVFSLLNIPYIRKPLLIVLTLGCAAATWFMYTYGAVIDQNMIVNVFETNSQEATALVTPQMILWLVVAGLVPSVVLALTRIRTGKWWYALLTRFAAMLGALLVIILVASVFYKDYASLFRNNKSIVKMVTPANYVSAVVKYSKMRWFAGDQTLVRIGEDAHKGALIASQRKKTVLVVVVGEASRAANYSLNGYPRETNPELKKQDVINFPRASSCGTETAVSVPCMFSGMTRKKYDADLAHHQEGLLDVLNHAGFNLLWRDNDGGCKGACDRVPHTDMTQWKLDQFCKDKSCIDDVNLYRLDNVLDGIKQDTVLVIHLMGSHGPAYYKRYPDSFRKFTPTCDTNEIQDCDHQSLINTYDNTILYTDSVVSRTIDALKARQANMNTALIYLSDHGESLGESGIYLHGTPYMLAPEQQTHIPFMFWLSPDYAKNFGVNTDCLRDHAAKEAVSQDNLFATVLGMMDVKSAVYQPQLDILSQCRR

SEQ ID NO: 6308 - protein, 273 aa, Enterobacter cloacae
IYPVTAQRSGHSDHLSQRRLLGAPLCGCAPRDDAKNHPLAPALPPLWQGKFLFCIPFQFAILSLLSVRLLATYKTIRREAMSFELPALPYAKDALAPHISAETLEYHYGKHHQTYVTNLNNLIKGTDFEGKTLEEIVRSSDGGVFNNAAQVWNHTFYWHCLAPNAGGEPDGELAAAINAAFGSFADFKAKFTDAAVKNFGSGWTWLVKEADGKLAIVSTSNAGTPLTTSATPLMTVDVWEHAYYIDYRNARPNYLEHFWALVNWEFVAKNFAA

SEQ ID NO: 6309 - protein, 137 aa, Enterobacter cloacae
RRNYLGGKFADRSVSGTLKGFLTLLIVIMVAIPWLARNEVGAAIAMVVWGAATFAVVPPLQMRVMRVAHEAPGLSSSVNIGAFNLGNALGAAAGGAVISGGLGYSFVPVMGAIIAALGLLLVIMSGRKQPQAVCTAE

SEQ ID NO: 6310 - protein, 119 aa, Enterobacter cloacae
RKQDMSTTIEKIQRQIAENPILLYMKGSPKLPSCGFSAQAVQALSACGERFAYVDILQNPDIRAELPKYANWPTFPQLWVDGELVGGCDILIEMYQRGELQQLIKETAAKYKTEEPDAE

SEQ ID NO: 6311 - protein, 210 aa, Enterobacter cloacae
SRRGSARALSGGRLHYKACRLPSPARTCADRRYHVSPALQSDTARLLLRSDRCRRSGKYRSGRHEYQCGLRSTHYRQHPPLQAPDARGFQRCRRTGRYAGWKKGTGTDAAGNRAQSAAQPGRSPLHERWRRPDGNHSQYPGSRPAPARVAWWCQRGSHYRFHRAGKCGYWRSGQKQKPAPDRQAGCCCVRYDRCATAEPQYGHLQHEHLR

SEQ ID NO: 6312 - protein, 76 aa, Enterobacter cloacae
GNIMKRFLSVALLAALLAGCAHDSPCVPVYDDQGRLVHTNTCMKGTTQDNWETAGAIAGGAAAIAGLTLGIVALTK

SEQ ID NO: 6313 - protein, 990 aa, Enterobacter cloacae
RPYPLSICAPAVKITQVIEQNMNGIDNLMYMSSTSDSAGNVTITLTFESGTDPDIAQVQVQNKLQLAMPLLPQEVQQQGIGVEKSSSSFLLVAGFVSDNKNLTQDDISDYVASNVKDAISRTSGVGDVQLFGAQYAMRIWLDSNAMNKYQLTPLDIINQLKTQNDQIAAGQLGGTPSVPGQQLNASIIAQTRLKSPEEFGRVTLKVNQDGSMVHLKDVARIELGGENYNMVTKINGQAATGLGIKLATGANALDTAAAIKSKLAQLQPFFPQGLKVVYPYDTTPFVKISIHEVVKTLFEAIVLVFLVMYLFLQNLRATLIPTIAVPVVLLGTFAVLAAFGFSINTLTMFGMVLAIGLLVDDAIVVVENVERVMVEDKLPPKEATQKSMEQIQGALVGIAMVLSAVFIPMAFFGGSTGAIYRQFSLTIVSAMALSVLVALILTPALCATLLKPVSSEHHEKKGGFFGWFNALFDKSVEHYSNSVSGILRKTGRYLLVYVIIVGGMAVLFLRLPSSFLPEEDQGVFMTMVQLPAGATQMRTQQVLDQVQDYYLTKEKANVESVFTVNGFSFSGQGQNSGIAFVSLKPWEERPGKENGVEAIVSRATKAFSQIKDGLVFPFNLPAIIELGTATGFDFELIDQANLGHTQLTQARNQLLGMVREHPDLLVRVRPNGLEDTPQFKLDVDQEKAQALGVSVSDVNQTISTALGGTYVNDFIDHGRVKKVYVQADARFRMLPGDINGLYVRSANGEMVPFSAFSSSHWVYGSPRLERYNGMPSMEILGESAPGKSTGEAMALMENLASKLPSGIGYDWTGMSYQERLSGNQAPALYAISLIVVFLCLAALYESWSIPFSVMLVVPLGVIGALLAASMRGLNNDVYFQVGLLTTIGLSAKNAILIVEFAKDLMDKEGKGIIEATLEASRMRLRPILMTSLAFILGVMPLVISSGAGSGAQNAVGTGVMGGMLSATLLAIFFVPVFFVVVRRRFTKHKD

SEQ ID NO: 6314 - protein, 164 aa, Enterobacter cloacae
LSLSPATLVVWFRNAGTLSMKKIAIIGSGPTGIYTFYSLLNNAAPLSITVFEKADQPGVGMPYSDEDNSRLMLANIASIEIPPIFITYLDWLKQQNAARLARYNVDSEKLHDRQFLPRILLGEYFHDRFLAGAAEANNAGFHIEVHPTAEIPDINADANAWPFH

SEQ ID NO: 6315 - protein, 105 aa, Enterobacter cloacae
TLADGCAHIAQKSIFFRRILRSEKHMTLNSNHSDWRDMLMKRQDINALKNFDFLARSFARMYAQGQPVDIDAVTGNMSNKQQAWFRERYDHYRKQAERARVIELR

SEQ ID NO: 6316 - protein, 173 aa, Enterobacter cloacae
HLFLLKKGIAMADSFQNEVPKARINLKLALHTGGAQKKIELPLKLLTVGDFSNGKENRPLSEREKINVNKNNFNSVLSEFNPEVNLTVPNTMAGDGSEESIKLNFSDIKDFEPEQVARQIPQLRAMLAMRNLLRDLKSNLLDNATFRKELEKILKDPALSQELRDEMSALAPK

SEQ ID NO: 6317 - protein, 145 aa, Enterobacter cloacae
GDALSMMTSIMDTDMKTRILLLTVSVLFNMQADAARGRQPCSGSKGGIAHCTSDGRFVCNDGSLSQSKRFCSGYGASELPRQVKPSPSARKAQTKKRIAVKGQEQRVVENNAQFDTQPRQPTCAPLYMANKPGFTHLPICSGNQY

SEQ ID NO: 6318 - protein, 180 aa, Enterobacter cloacae
KAGKEHLPIRHELFEYSFLLFRRYMMTLRTFPVLNDLSDSLFADRFNRIDRLFSQLTGSTPLPSTPSYNIRRLGDNRYELTLSVPGWKESELEIETVGGQLNISGKREEEKTENGEEGWIHRGISRSDFRASYSLPEHVKVTGASLENGLLAIELHQDIPEEEKPQRIAINNNPAIEHKP

SEQ ID NO: 6319 - protein, 222 aa, Enterobacter cloacae
ITWGFIMFNEVHSLPGHTLLLITKPSLQATALLQHLKQCLSLNGKLHNIQRSFDDIASGSIILLDMMEADKKLIHYWQDNLSRKNNNIRVLLLNTPDEYPFREIESWPHINGVFYVTEEENRVVEGLQGILRGECYFSQKLASYLITHSGNYRYNSSESALLTHREKEILNKLRIGASNIEIARSLFISENTVKTHLYNLFKKIAVKNRTQAVSWANDNLRR

SEQ ID NO: 6320 - protein, 149 aa, Enterobacter cloacae
VLTTIPISEAVMRLAHTVISLMLIAPLSWAGNMTFQFRNPNFGGNPNNGAFMLNQAQAQNSYKDPSYDDDFGIETPSALDNFTQAIQSQILGGLLTNINTGKPGRMVTNDFIVDIANKDGQLQLNVTDRKTGKTSTIQVSGLQTSSTDF

SEQ ID NO: 6321 - protein, 149 aa, Enterobacter cloacae
LLKIARRRCRGQTITSGVNSMKRTLSWIAAAGIMLAAGNLQAVEVEVPGLLTDHTVTSVGHDFYRAFSDKWESDYPGNLTINERPSARWGSWITITANQDVIYQTFLFPTKRDFDQNVAFALAQTEEAINRLQLDKALLSTGDLAKDEF

SEQ ID NO: 6322 - protein, 288 aa, Enterobacter cloacae
FLNNPEIRTIIMQRFFILVAVCLLSGCLTAPPKEAAKPTLMPRAQSYRDLTHLPVPTGKIFVSVYNIQDETGQFKPYPASNFSTAVPQSATAMLVTALKDSRWFIPLERQGLQNLLNERKIIRAAQENGTVGVNNRMPLQSLTAANIMVEGSIIGYESNVKSGGAGARYFGIGADTQYQLDQIAVNLRVVNVSTGEILSSVTTSKTILSYEVQAGVFRFIDYQRLLEGEIGYTSNEPVMLCLMSAIETGVIFLINDGIDRGLWDLQNKSDVSNAVLVKYREMSVPPES

SEQ ID NO: 6323 - protein, 188 aa, Enterobacter cloacae
RNKNMNEFSILCRVLGTLYYRQPQDPLLVPLFTLIREGKLAQSWPLEQDELLERLQKSCDMQQISTDYNALFVGEECRVSPYRSAWQEGATEAEVRAFLSERGMPLTDMPADHIGTLLLAASWIEDNAGDDENEAIETLFETYLLPWVGTFLGKVEAHATSPFWRTLAPLTRDAIAAMWDELEEENEE

SEQ ID NO: 6324 - protein, 192 aa, Enterobacter cloacae
LESQKSCNDTFQLARNVLLISFLWCASAKMRTMNILLCIAITTGILSGLWSWVAVSLGLLSWAGFLGCTAYFACPQGGLKGLFISGCTLLSGVVWALVIMKGSALAPHVEILGYAMTGIVAFLMCVQAKHLLLSFVPGTFMGACATFAGQGDWKLVVPSLMLGLLFGYAMKNSGLWLAARREKSQSVPAVSK

SEQ ID NO: 6325 - protein, 266 aa, Enterobacter cloacae
RIAQLEGRLGVRLIQRTTRQFAVTEVGQTFYQHCKAMLVEAEAAEEAVAALQDEPRGMVRITCPVTLLHVHVGPMLARFMARYPGINLQLEATNRRVDLVAEGVDVAIRVRPRPFDDSELVLRVLADRGHCLVAGPALIERMGNPAMPSELSEWPGLSMGAGKHLHKWELNGPEGAKAEIHFTPRLVTTDMLALREAAMAGVGVVQLPILMVKDQLASGELVRVLNAWEPRREVIHAVYPSRRGLLPSVRTLVDFLTEEYAKMVED

SEQ ID NO: 6326 - protein, 144 aa, Enterobacter cloacae
LFVGRVSVAPPDTITAGAAKFESPTGVQHVKKKPAFSCELFFKYGGEGGIDSLRSPFGQPVRYALSLSNWLSPVAEPRSGGLIPPYENIKEKSPYFRTSSHHEYGGEGGIRTPDTLPYTHFPGVLLQPLGHLTILSSRCCRDGR

SEQ ID NO: 6327 - protein, 316 aa, Enterobacter cloacae
KAMTMDIIFYHPTFDTAYWINALTAALPGARVREWKQGDNEHADYALVWHPPVEMLQGRRLKAVFALGAGVDSILSKLKAHPEMLPEDIPLFRLEDTGMGQQMQEYAVSQVLHWFRRFDDYQAFKQQSHWEPLPDYQREDFTIGILGAGVLGSKVAEALAPWGFPLRCWSRSRKEYPGVESFAGTDELPAFLKGTRVLINLLPNTAETVGIINGTLLNQLAEDSYLMNLARGVHVVEDDLLKALDSGKLKGAMLDVYSREPLPKDSPLWAHPRVAMTPHIAAVTRPAEAVAYISHTISEIEKGNAVTGQVDRQRSY

SEQ ID NO: 6328 - protein, 257 aa, Enterobacter cloacae
LLSFGKTAEERKMYPVDLHMHTVASTHAYSNLHDYIAQAKLKGIKLFAITDHGPDMADAPHYWHFVNMRIWPRLVDGIGILRGIEANIKNTDGEIDCTGPMLTSLDLILAGFHEPVFAPQDKETNTAAMIATIASGNVHIISHPGNPKYPIDIQAVAQAAAKHRVALEINNSSFVHSRKGSEANCREVAAAVRDAGGMVALGSDSHTAFTLGDFSECLKILRDVNFPEEQILNVTPRRMLDFLESRGMAPIDEFADL

SEQ ID NO: 6329 - protein, 508 aa, Enterobacter cloacae
VITKKVSNTKAWTGSLHGDATFQGNHDSGDIFQTNAYACGPLIDGLLGAKVTGLLSRRAEDKIVNGYNEQKMRNGGITLNFTPDEKNDFDLDFARELQDRNSTPGMSKAAETCRGTTCTPNTKSDSRYEHTTYSLTHSGYYEDFNTTSYIQQEETNNPGREMRSYNTTFNNQNQIFLGDHTLTLGGQYRYEKLRDNGNQLEAADGLNKLTRWSWALFAEDEWSMTESFTLTGGLRMDKDQNYGTNWTPRGYGVWHLADQWTLKGGVSAGYRAPDLRQSSASWGQVTGGGRLDGIIVGNPDLKPEKSLSEELALLWDNNDDLNAGVTLFNTDFKDKITEVRRCNSSADPACTIGGHSYDFVSDRVNVDKANMRGVESSFGWKITRDVNWTANYTYTESEQKSGQFSGKPLNKMPKHMFNTTLDWQATPDVGFWSRLNLRGKTSEYLSRTSMSQGTPSYTQVDVGMRYNANKNLLVTAGVYNVLDKQIDYDTYDTVLDGRRYTVGMTYSF

SEQ ID NO: 6330 - protein, 367 aa, Enterobacter cloacae
SILFLSQSAVTFSQTKEKVMSEITLQHHRTVWHFVPGLALSAVVTGVALWGGSIPAVAGAGFSALTLAILLGMVVGNTVYPHIWKSCDGGVIFAKQHLLRLGIILYGFRLTFSQIADVGVSGIAIDVLTLSSTFLLACFIGQKIFGLDKQTSWLIGAGSSICGAAAVLATEPVVKAEASKVTVAVATVVIFGTLAIFLYPAMYPLVAHWFSPETYGIYIGSTMHEVAQVVAAGHAINPEAENAAVIAKMLRVMMLAPFLIFLAARVKQLAPAGGSEKSKITIPWFAILFIVVAVFNSFHLLPKAMVDMLVTLDTVLLAMAMAALGITTHVSALKKAGAKPLLMALVLFIWLIVGGGAINLAVHSLLA

SEQ ID NO: 6331 - protein, 290 aa, Enterobacter cloacae
AFRVNRSLFMKYVGAHVSAAGGLANAAIRAAEIEATAFALFTKNQRQWRAAPLTAEVIDDFKAACEKYGYGPGQILPHDSYLINLGHPVAEALEKSREAFLDEVQRCEQLGLTLLNFHPGSHLMQIDEDACLARIAESINMTLDKTQGVTAVIENTAGQGSNLGFKFEHLAAIIDGVEDKSRVGVCIDTCHAFAAGYDLRTTEATKNTFEEFERIVGFKYLRGMHLNDAKSAFGSRVDRHHSLGEGNIGHDAFRFIMQDVRFEGIPMVLETINPDIWAEEIFWLKAHQTP

SEQ ID NO: 6332 - protein, 290 aa, Enterobacter cloacae
ATMHITLRQLEVFAEVLKSGSTTQASQMLALSQSAVSAALTDLEGQLGVQLFDRVGKRLVVNEHGRLLYPRALALLEQATEIEQLFREDNGAIRVYASSTIGNYILPEVIARYRRDFPTLPLEMSVGNSQDVINAVIDFRVDIGLIEGPCHNVDIIAEPWLEDELVVFASPASSLLQGEVTLERLAQAQWILREQGSGTREIVDYLLLSHLPQFQLGMELGNSEAIKHAVRHGLGISCLSRRVIAEQLETGSLVEIPVPLPKLVRTLWCIHHRQKHLSSSLQRFLRYCEM

SEQ ID NO: 6333 - protein, 518 aa, Enterobacter cloacae
SSLITEYFCRKQRRSSATIAPHLLNGQHFHMVSETKTTQAPALRRALKARHLTMIAIGGSIGTGLFVASGATISAAGPGGALFSYILIGLMVYFLMTSLGELAAYMPVSGSFSTYGQKYVEEGFGFALGWNYWYNWAVTIAVDLVAAQLVMTWWFPDTPGWIWSALFLAVIFLLNYISVRGFGEAEYWFSLIKVATVIIFIVVGVAMIVGIFKGAEPAGWSNWTIGDAPFAGGFSAMIGVAMIVGFSFQGTELIGIAAGESENPEKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFSKLSRGGVPRNALYATTVIAGLCFLTSMFGNQTVYLWLLNTSGMTGFIAWLGIAISHYRFRRGYVKQGHDLNNLPYRSGFFPLGPIFAFVLCLIITLGQNYEAFLADTIDWGAVTATYIGIPLFLIIWFGYKLTKGTRFVRYSEMDFPERFK

SEQ ID NO: 6334 - protein, 202 aa, Enterobacter cloacae
RTGKMSSLDSEAKPDNAGHSVLALTTSHSLVVSSSETFLPDMRKELGIIADLVESYNDELCLLKHMAVQFKTHNHQKLYSYLSGYNHSISEADALFAENALRSEYWKRVMALTDVLPIMSDAKRNEWDKQFTADRYIMPPQVIPDFTADAVVGTVVALLNDRNQFIKERVYDVFQSLSRSHKTNKAFGVLHPHDHYRSLRAV

SEQ ID NO: 6335 - protein, 390 aa, Enterobacter cloacae
AAVIRQTKLLGFSTRMITTGVCEPSKYPWQKLRVDFKESGISPLSELRVICAFFRGEQVKAIHNTKSLVEALVEHEGFRKWICIDGNSIRFRVYKNGSMHIDVHPDIAERLNNILSAIVPLALPADRMAHSKKSLEAFPVLKQCIDFDTRMQLSELMFKNDGDNKWSCWTSLGSLAERKSSSVAADTLRFLGATVTKYDVTFSYDPCEVIRYIGQIGEMPDIVSHQFYPSSCRISEYVYSLLGAGEGDTLLEPNIGHADLLKSFPAGVIVTGIELDTLNCLISRAKGYDTTEADFLTWSKSNQQKKFDYVVMNPPFADNRARLHLQAAASHLAAGGSLAAVLPLSLQGLDNLLGEEFRTEWMDVFENEFENTTVSVRILYAERIQQEEVL

SEQ ID NO: 6336 - protein, 395 aa, Enterobacter cloacae
AEKCNGAPMSVLLTEPTQQANDKVFKTAHVAFSVVTGTGRYVTGLKQFRDANPELCTEVSDQKAWAIHPSVIQVTPGFNSREMGMGDDYYKLPEVEEHIYNIKNAYIRGDYVDPIRVRVIDGVPFVRQGHCRLKAAMMACDEDHDITILCVEIKEDEIGCELATIDGNRGLALSPVALGESYRRLHSLAGWSLERIAQRENKSPTTISSLIRLTTCSVVIKKWIHADAISYVNVLSLIDELGETEAISRIKKMIAELEQADANGITVKKTQHGQVRVRPSDFKPARIPPVIATKAVEGVKLITTSLLQKLGDIELPEMTDSSADEEINITLNRSTLEMLRNLSKEITESENKQLRRAENRQAKLNGEKPKYPRKKNAKKAGEETDQDTDPQPDAE

SEQ ID NO: 6337 - protein, 285 aa, Enterobacter cloacae
ISLSGIDTLTRHLRHMPIIKWAGGKTKLMPFISHHYPHDHSCRWVEPFIGGGAVFLNMFAQNALLADSNPDLINLYRTIQRQKTNFINQVQNLADKTFVEKDYYEMRDRFNKTCISGQPLQRAALFYSLNRLGYNGMCRYNSERIYSVPWGKHTELKLDFNKIDYLSFRLSGIELITAGFEETLAATGEGDQIYCDPPYDKTSKTSFVSYDGKPFSQSDHVLLANMLVDAHRKGAAVAISNSLTPFTLGLYEERGFVIHRLSAYRSVGSKPNTRKTETEILAVLK

SEQ ID NO: 6338 - protein, 198 aa, Enterobacter cloacae
DCITVDCKCDFQRIVLIMLKTLNVITNNNFYFYSLIGIFSANDVLANMYHIKKIGSRDIASWLKETQDDHAIVMAGPDTESLTKLICTQRGYNYISSRSKVKDMMQFFLKEYKPRKNSAYLKATNSHISTQDIKVLIWVSSGLKPCDISKRYGISIKTISHHKRNLMKKLQIKSTMQLVDVASQYSLLCKHLNTSCAL

SEQ ID NO: 6339 - protein, 2653 aa, Enterobacter cloacae
MRMNKVYKVIWNHSAQRWDVVSELTGAKKKSKSSRVGAAISPLVLLTALTLNPGFAYADIMLPNNWLSSNQNNGVGAAVVNGTEENIIGPGVISGPSSGTSYMSITDAQKAGYIISGDDLSGLVYTDIGKRTRTVQYYDSITGANQTVMVYDSGTFSESEAASNVTVPVFSPGANFFYKTRLVTAKNGGTANIDVKASSIGSYFKDSQLVVADGTNSHANWNSQNNFYFQAAARVTDSAVYNKTINFSNYTGSFTDWEGKEHVVNSVADLQSYNDYLAEALKDGRLPPGQYEAEFNKAIQYESKDYIIDKTAGGTIDSSPYNSPVGTLAVLSATNGGTVTLSSSGRLTGVLPAYGYGAGVVASSGGTGINEGVIDATGAAMRAYQDGTVINNGTIYVWDNNTKYTLHGEGMLAHNANAKAVNNGVINVRPWKNSFTPYGINTAMLLSDGGEGTNNGVINITADASTLDNNGATRGISVSDGGTFINAGNGKITVGVNAGGTKSHSAVDSIAIDIGKGATKVVNEGDIILGQGAQGDYGVSAVDAGTVNFINTGTISVEGQDSATPALNAGIRSSNSSGLVNSGIINVNGTNNSGILAENGGSVLSDGLINVGSVSAGSGYRNYGAWVDGAASSVDVSGQINLIGSGAIGAFADNAGSLILSGTGSIAFNDAEQIGFYVNGKGSSVNNTGSGTFDVSSRDSSMFRIAGGASFLGNSDASSTITVSGENSLALVVTGSSDQGDVSTINTGGMAIQLSGNDSTGLRVEGGALGTIDANTTINLNAVSSIAAVADGNGYDISGNLINKEDNATSLTASAQLTSSLDSVTGYIARNGASLDNAGDIIFTGSKTTGMRVEEGATGTNSGNITVEDGGAGLIAASGGKNTVINNTGNLILKGGDNANRTTGIKASGPGTVINMNAGNIELQGQGAVGVEVSDEGTVNLIGSAVPQFADESTGITDQIAFRIKGSGAQINTSIAPGTLLDATGKDSILFRIEDGAQQAGTLQMKTSGTGSSGIWVTGTGSKVVAGSGSDFQILGDNAKGLYVTGGAEATLEQGVSVNLVGDGAIVAEVDGNAYGLDGSVTGQNTGSVLTNEADITTALSNATGFITRNQGLLVNNGNIDFTAGTDNIGILVDDGRFENSGNSIAVNGVALYIKGANSQVNNTTGGDIIAVDGEAAIKLGAGASLDLAGDGFDGSATIEGRGSAHGILLDTGATGLKLNGAVIKVSGLETTGHGIENRAEIEGIQLSNGARINVSGGGIGIRTAAPLAKKNQGVITVRGATGIAFQKADGSATDGLFDISDSSELYFDVEYGTGILVNTTADAVVKTNANIWVYGEDGGSAIVVKDSASEVVQSGEIFSASLINDAIIASRTSSFINEGTIFAYLGTAISFSDDVDSTLKNHGNIDGKVKLNGGNNTLINNGSVGALTAGDGNNTLNLNDGSYLQDATLGNGNNTIIFSGFSMAGEIVAGTGENTFIIKDSDGLRFDLLDGGMGDSDKLIFDHAQYFTLDSAGKIKNIESVRLDNDSDVTIREALLLTDNGAGPGSVDIHDDKSELSVRPSAPGGFTFDPRLTGEGLLSVELDAAESEFSFSQNVGNAFSGTLALGKSNFVLDGINTESITNAMLISETDNTTIVGDGTQHIGGLGIDGGKLIFGTVTPGDTVASNSIVTSEDGLLDISGKGTVQVTLPGEVVNVRPVPDTQKNILEQDDAETLVTLVEARGAVKGTGAELLLTDENGGVISDSQSFDITQDGTPVARGTYDYKLMSSKDGISGDGLYIGYGLKSIELQGIAGNALILTPKDGARGQESDLNAQLTGTGDLAIDAGSNTVTLSNGSNGYTGSTRVLSGTLKMANDNVLGQTADLAINNGAAFITDGFSQHVGAIQTEAGAGIQLDAGSELTIDSTLRASGEAAGGVIEDSALYGEGRLVVSDSSLEVKGQNSKFTGDVTLESGSVAELENAQGLGSLGTVLLSGNDDTLKMDIVKGSNSSTSLTKSLAGKGTVDILNNTDLTLSGDNSNFSGTFDIGSEAALHASDAKHLGQSVLGNEGSLYLTANNDWELTNEINGAGSLTKQGSGNLIINRELSYTGATRVESGTMVIGDNSKDAAGVLSGTSVVTVNAGAMLAGTGTIAGNVENKGTIAALNSLSGYSDAGTGNFTVGALNNTGTLLLAGSETGNTLTVNGDYHGEGKLVLNTVLGGDDSLTDKLIVKGNASGKTDVYVTNVGGSGAQTQNGIEVVQVDGQSADDSFRLAKRAVGGAYEYYLHKGDINGAGGDWYLRSELSPAPEPDTTPGPDTTPEPEPNPTPEPAPAPTPAPEPDQHGDKVYRPEAGSYIAGIAASNTLFNTRLHDRAGETYYTDVLTGEQAVTSMWMRHVGGHNVWKDGSSQLNTQSNRYVLQLGGDIAQWTDGKDRLHLGVMGGYGNEKSSTTSSLSHYKSRGTVNGYSLGMYATWQQNEGEESGAYVDTWAQYSWFDNTVKGEQLAQETWKSSGITASAEAGYTFNAGKFKGSHGSEYNWYIQPQAQITWMNVRSEDHREHNGTKISAQGEGNVQSRVGLRTYLKGKSHLDSEKERTFEPFIEANWIHNTRSWGVRMDDALVTQDGARDVGEIKTGVEGQISKNLNVWGNVGVQIGDKGYNDTQAMLGIKYSFK

SEQ ID NO: 6340 - protein, 415 aa, Enterobacter cloacae
RKPDRDRGEKSRRHRGADGGGTRMSVIIVGGGMTGATLALAISQLTKGQLPVHLVEAVAPQAADHPGFDARAIALAQGTCQQLARIGIWQAIADCATAIGTVHVSDRGHAGFVTLDAHDYLIEALGQVVELHDVGLRLFRLLQDAPGVTLHCPARVASFSRRDEAVSVTLDNGTTLEGQLLVAADGSRSAIATQCGVEWRSEPYGQAAVIANVSTAGAHNGRAFERFTEHGPLAMLPMSNGRCSLVWCHAQDRADEVLSWSDERFCSELQKAFGWRLGRITHAGKRVAYPLALTTASQTVSHRVALVGNAAQTLHPIAGQGFNLGLRDVMSLAELLARTWSEQQDCGAYSVLSHYQKRRQADKAATIGVTDGLVHLFANRWAPLVAGRNLGLMAMELFIPARDVLAQRTLGWVAR

SEQ ID NO: 6341 - protein, 404 aa, Enterobacter cloacae
GVLTVQNVDVAIVGGGMVGLALACGLQGSGLRVAVLEQKAPQPVAQDAPPELRVSAINAASEKLLTHLGVWSEIVALRASCYHGMEVWDKDSFGRIAFDDESMGYSHLGHIVENAVIHHVLWQKAQQCSDVTLIAPAKLQQVAWGENDAFITLESGDMLTARLVVGADGANSWLRNKADIPLTFWDYRHHALVATIRTEEPHGGVARQIFHNDGILAFLPLADPHLCSIVWSLEPEKAQQMQETTPDAFSQALCVAFDNRLGLCGLESERQTFPLTGRYARQFAAHRLALVGDAAHTIHPLAGQGVNLGFMDAAELVEELRRLHREGKDIGQHLYLRRYERSRKHSAAMMLAGMQGFRELFAGANPAKKLLRDIGLKLADTLPGVKPQLLRQAMGLNDLPDWLR

SEQ ID NO: 6342 - protein, 141 aa, Enterobacter cloacae
AGRLTIFIRRTSMSNVPAELKYSKEHEWLRKEADGTYTVGITEHAQELLGDMVFVDLPEVGATVSAGDDCAVAESVKAASDIYAPVSGEIVAVNDALSDSPELVNSEPYEGGWIFKIKASDEAQVAALLDATAYEALLEDE

SEQ ID NO: 6343 - protein, 401 aa, Enterobacter cloacae
RPTLFSAAGEHWYFTGFNEPEAVLVLIKSNDTHNHSVIFNRVRDLTAEIWFGRRLGQEAAPEKLGVDRALAYSEINQQLYQLLNGLDVLYHAQGEYAYADDIVFTALDKLRKGSRQNLSAPATLTDWRPMVHEMRLFKSEEELNVMRRAGEISALAHTRAMEKCRPGMFEYQLEGEIHHEFNRHGARFPSYNTIVGGGENGCILHYTENESELRDGDLVLIDAGCEYQGYAGDITRTFPVNGKFTTAQREIYDIVLESLETALTLFRPGTSIQEVTGEVVRIMITGLVKLGILKGDVDTLITENAHRPYFMHGLSHWLGLDVHDVGAYGPERSRVLEPGMVLTVEPGLYIAPDADVPERYRGIGIRIEDDIVITETGNENLTATVVKKADDIEALMAAARV

SEQ ID NO: 6344 - protein, 389 aa, Enterobacter cloacae
KRTFASAPDREADTGFHGEFFNEEKMAQQTPLYEQHVLCGARMVDFHGWMMPLHYGSQIDEHHAVRTDAGMFDVSHMTIVDLRGSRTREFLRYLLANDVAKLKTPGKALYTGMLNASGGVIDDLIVYYFTEDFFRLVVNSATREKDLSWISQHAEPYAIDITVRDDLSLIAVQGPNAQAKAASLFSDEQRKATEGMKPFFGVQAGDLFIATTGYTGEAGYEIAMPNEKAADFWRALVEAGVKPAGLGARDTLRLEAGMNLYGQEMDEGVSPLAANMGWTIAWEPADRDFIGREALEMQREKGTEQLVGLVMKEKGVLRGELPVRFTDADGNHREGVITSGTFSPTLGYSIALARVPAGIGETAVVQIRNREMPVNVTKPIFVRAGKPVA

SEQ ID NO: 6345 - protein, 344 aa, Enterobacter cloacae
RVVNMITIRDVARQAGVSVATVSRVLNNSALVSPETRETVMKAVTQLGYRPNANAQALATQVSDTIGVVVMDVSDAFFGALVKAVDVVAQQHQKYVLIGNSYHEAEKERYAIEVLIRQRCNALIVHSKALSDEELAGFMEQIPGMVLINRIVPGYAHRCVGLDNISGAMMATRMLISNGHQRIGYLASSHGIEDDMMRREGWQNALKEQGIAPLESWVGTGSPDMQGGEAAMVELLGRNLQLTAVFAYNDSMAAGALTALKDNGIAVPQHLSLIGFDDIPIARYTDPQLTTVRYPIASMAKLATELALQGAAGLLDPDATHCFMPTLVRRHSVAIRQTVAPITN

SEQ ID NO: 6346 - protein, 392 aa, Enterobacter cloacae
IYFSLTIGAIMALRIALSGFVVLVVAMGIGRFAFTPQVPLMIAAGQLTLTSAGLVAAMNYLGYLVGAWDAMRAHRFVETRLWLGITGAVALTLLSAAAENAVVHGLLRFVIGCMSGWSMVLIAAWTNERLGQLGKPGLSAAVFAGPGAGIALSGLLAVYIQAKSLSAGAAWQIYGVLALVLIVLVARYLPRAGQLHRPDTAPEPLLLTADLRRLVWSYSLAGFGYILPATFLSQMAAVRFPGSLFAQFVWPIFGAASVVGIALSIALRHTSSANRRLAIVLWLQGIGVLAAWLLPGIGGLLTGGLLVGGGFLCAVQLSLLYGRELAPDHTRYMAGLLTTGYAIGQLVGPVTSALSTWLTHRLEPALGLAGIALFVGGALVWNRQAERQQQLQ

SEQ ID NO: 6347 - protein, 252 aa, Enterobacter cloacae
ILDYVRRLTHNERTLLPQRGQKTPHLQEKRMSSLSKEAALVHEALVARGLETPLRPPVQELDNVTRKRLIAGHMTEIMQLLNLDLSDDSLMETPHRIAKMYVDEIFSGLDYANFPKITVIENKMKVDEMVTVRDITLTSTCEHHFVTIDGKATVAYIPKDTVIGLSKINRIVQFFAQRPQVQERLTQQILTALQTLLGTNNVAVSIDAVHYCVKARGVRDATSATTTTSLGGLFKSSQNTRQEFLRAVRHHN

SEQ ID NO: 6348 - protein, 391 aa, Enterobacter cloacae
SDRAGTMERNVTLDFVRGVAILGILLLNISAFGLPKAAYLNPAWYGDITRSDAWTWAILDLFAQVKFLTLFALLFGAGLQLLLKRGTRWIQSRLTLLVILGFIHGLLFWDGDILLAYGLVGLICWRLIRDAPGVKSLFNTGVMLYVMGLAVLLLLGMIADDSTSRSWIPDAANLQYEQFWKLKGGMEAIGNRADMLGDNLLALGAQYGWQLAGMMLMGAALMRTGWLKGEFSLRHYRRTGAGLVLLGVIINLPAVMMQWHLQWDYRWCAFLLQVPRELSAPFQTIGYAALIYGFWPQLSRLWIVSAVACVGRMALSNYILQTLICTTLFYRFGLFMKFDRLTLLAFVIPVWIVNVVFSVVWLRFFRQGPLEWAWRQLTARASGVSLRNTSR

SEQ ID NO: 6349 - protein, 321 aa, Enterobacter cloacae
TLSAVMASMLFGAAAHAADTRIGVTIYKYDDNFMSVVRKAIEKDAKSAPDVQLLMNDSQNDQSKQNDQIDVLLAKGVKALAINLVDPAAAGTVIEKARGQNVPIVFFNKEPSRKALDSYDKAYYVGTDSKESGIIQGDLIAKHWAANPNWDLNKDGQIQFVLLKGEPGHPDAEARTTYVIKELNDKGLKTQQLALDTAMWDTAQAKDKMDAWLSGPNANKIEVVIANNDAMAMGAVEALKAHNKSAIPVFGVDALPEALALVKSGAMAGTVLNDANNQAKATFDLAKNLADGKGAADGTNWKVDNKIVRVPYVGVYQSNLG

SEQ ID NO: 6350 - protein, 292 aa, Enterobacter cloacae
KLCIMRFMNSLSYKEPCMELLEEHRCFEGRQQRWRHDSTTLNCAMTFSIFLPPADNPPVLYWLSGLTCNDENFTTKAGAQRIAAELGIALVMPDTSPRGEDVADDAGYDLGKGAGFYLNATEQPWARHYRMYDYIRDELPALVHSQFAVSERCAISGHSMGGHGALIMALKNPGKYTSVSAFAPIVNPTQVPWGQKAFRHYLGEDLEKWQEWDSCALMLASQSEDAIPMLVDQGDADQFLAGQLQPAVLAEAARQKDWPLTLRIQPGYDHSYYFMASFIEDHLRFHAEHLFR

SEQ ID NO: 6351 - protein, 220 aa, Enterobacter cloacae
LVVVTHGAQELLAGVLARFEQAAQRSGGGCAGSITHAARFHAVVHRVDRHRHIVSPQQGLQCGQDLLRQTFLHLRTLGKELHDAVDLGQADDRIFWNIGHRRFTIDGHKVMLAGAGQRDIAYRHHLIDLHLIFNDGDFREVRVIQAGENFVDVHLRDAVRRLHQAVVAQIEIQQLHDLRHMAGDQTLAGNIVQLLHGRAQWRFKTARNQRFMDKGCFFTE

SEQ ID NO: 6352 - protein, 222 aa, Enterobacter cloacae
IQPVFRRHHSNTNDFNYHLCLQFYILLYNSRLFSISKSSYKTKTYSSQGYPDGVFFIFIRNVQMTIPRIKLLAVAIGAATCSPFVHAADQDTVVVTATGFEQKIQNAPASISVISKQQIEDKAYRDVTDALRDVPGVVVTGGGSSSDISIRGMASQYTLFLVNGKRVSTRSTRPNSDNSGIEQGWLPPLESIERIEVIRGPMSSLYGSDAMGGVMDVITQNS

SEQ ID NO: 6353 - protein, 203 aa, Enterobacter cloacae
  UNSURE (6)
  UNSURE (7)
  UNSURE (8)
  UNSURE (9)
  UNSURE (10)
  UNSURE (14)
  UNSURE (21)
  UNSURE (22)
  UNSURE (23)
  UNSURE (26)
  UNSURE (27)
  UNSURE (33)
  UNSURE (40)
RGGEGXXXXXLFPXPGAWASXXXHPXXPNSFPXGLSPKPXARPLTSGCNPRTNISVELMPQSRIKLDANLKDFEAQLAATDKQVGNELAPLKGKGYFVFHDAYGYYEKHYGLTPLGHFTVNPEIQPGAQRLHEIRTQLVEQKATCVFAEPQFRPAVVEAVARGTSVRMGTLDPLGTNIQLSKASYSQFLSQLANQYASCLKGD

SEQ ID NO: 6354 - protein, 444 aa, Enterobacter cloacae
RGSEYVQQIARSVALAFNNLPRPHRVMLGSLTVLTLAVAVWRPYVYHPSSAPIIKTIELEKSEIRSLLPEASEPIDQAAQEDEAIPQDELDDKIQNEAGIHEYVVSTGDTLSSVLNQYGIDMGNISQLAASDKELRNLKIGQQLSWTLTPDGDLQRLTWEMSRRETRTYDRTANGFKMTSELQQGDWVNSVMKGTVGGSFVSSARDAGLTSAEISSVIKAMQWQMDFRKLKKGDQFSVLMSREMLDGKREQSQLVGVRLRSDGKDYYAIRAEDGKFYDRSGTGLAKGFLRFPTAKQFRVSSNFNPRRLNPVTGRVAPHRGVDFAMPQGTPVLAVGDGEVVMAKRSGAAGYYVAIRHGRTYTTRYMHLRKLLVKPGQKVKRGDRIALSGNTGRSTGPHLHYEVWINQQAVNPLTAKLPRTEGLTGKDRKDYLAQVKEVMPQLRFD

SEQ ID NO: 6355 - protein, 71 aa, Enterobacter cloacae
KAGVSMRRLFLLCAGGSLATLSAYIFASPDPGTRMETKKNNIEYIHEFEKSFRHPRNWGAWIGVYAFAGMA

SEQ ID NO: 6356 - protein, 285 aa, Enterobacter cloacae
LPATLRDPVLGKVGRLAGRLGKSARRRAQINLLYCFPDKSDAEREAIIDDMYTTAPQAMAMMAELALKGPEKIVERVDWKGLEIIDEMRRNDEKVIFLVPHGWGVDIPAMLMASQGQKMAAMFHNQGNKIYDFVWNTVRRRFGGRLHARNDGIKPFIQSVRQGYWGYYLPDQDHGPEHSEFVDFFATYKATLPAIGRLMKVCRARVIPLFPAYDGKTHRLSIEVRPPMDDLLTADDHTIARRMNEEVEVLVGPHKEQYTWILKLLKTRKPGETEPYKRKELFPKK

SEQ ID NO: 6357 - protein, 256 aa, Enterobacter cloacae
WFQETRKSSTVHCNKITTIPGRVPGDLTEENDMAVTQTAQACDLVIFGAKGDLARRKLLPSLYQLEKAGQIHPDTRILGVGRADWDKEAYTKVVREALETFMKEKIDESLWDKLSGRLDFCNLDVNDVGAFTRLGEMLDQENRVTINYFAMPPSTFGAICKGLGEAKLNAKPARVVMEKPLGTSLATSREINDQVGEFFEECQVYRIDHYLGKETVTELAGVAFCQLPVCEQMGQPHYRPRGNYRGGRGGHRSPLG

SEQ ID NO: 6358 - protein, 252 aa, Enterobacter cloacae
ASSLRSVRFTVLTTIWAKRRLLNLLAWRFANSLFVNKWDNRTIDHVEITVAEEVGIEARWGNFDQAGQMRDMIQNHLLQILCMIAMSPPSDLTADSIRDAKVKVLKSLRRIDRSNVREKTVRGQYTAGFAQGKKVPGYLEEEGANKSSNTETFVAIRVDIDDWRWAGVPFYLRTGKRLPAKCSEVVVYFKNPELNLFKESWQELPQNKLTIRLQPDEGVDIQILNKVPGLDHKHNLQTTKLDLSYSDTVHHY

SEQ ID NO: 6359 - protein, 313 aa, Enterobacter cloacae
YRLNRIKVSSLYEIVYALMSVLLTMNMLEKIQFQLEHLSKSERKVAEVILAAPAQAIHSSIAALAQESGVSEPTVNRFCRSLDTRGFPDFKLHLAQSLANGTPYVNRNVDEDDSVDAYTAKIFESAMATLDHVRQSLDMSSVNRAVDLLTQAKRIAFFGLGSSAAVAHDAMNKFFRFNVPVIYSDDIVLQRMSCMNCSEDDVVVLISHTGRTKSQVELAQLARDNDAMVIALTTAGTPLAREATLAITLDVPEDTDMYMPMVSRLAQLTVIDVLATGFTLRRGAKFRDNLKRVKEALKESRFDKELLIKSDVP

SEQ ID NO: 6360 - protein, 517 aa, Enterobacter cloacae
RRSTIYGIRSPRYCLAIDEGRFYVHATPKLFQSTEYYMSRRLRRTKIVTTLGPATDRDNNLEKIIAAGANVVRMNFSHGTPEDHKLRADKVREIAAKLGRHVAILGDLQGPKIRVSTFKEGKVFLNIGDKFLLDANLSKGEGDKEKVGIDYKGLPADVVPGDILLLDDGRVQLKVLEVQGMKVFTEVTVGGPLSNNKGINKLGGGLSAEALTDKDKADIVTAAQIGVDYLAVSFPRCGEDLNYARRLARDAGCDAKIVAKVERAEAVCDQDAMDDVILASDVVMVARGDLGVEIGDPELVGIQKALIRRARQLNRAVITATQMMESMITNPMPTRAEVMDVANAVLDGTDAVMLSAETAAGQYPAETVAAMARVCLGAEKIPSINVSKHRLDIQFDNVEEAIAMSAMYAANHLKGVTAIITMTESGRTALMTSRISSGLPIFAMSRHERTLNLTALYRGVTPVYFDSTNDGVAAAHDAVNLLRDKGYLVSGDIVIVTQGDVMSTIGSTNTTRVLTVE

SEQ ID NO: 6361 - protein, 79 aa, Enterobacter cloacae
KELALKKIFVSVFAAAVALSALTGCTRTSYAIHTNDGRTIVSDGKPTESDSGLLGYKDANGVKQQINKADVKEVSEIPH

SEQ ID NO: 6362 - protein, 165 aa, Enterobacter cloacae
REPSMNSLLTLAKDLEQKSKVQQQTTGEMLKAAFSEHDKSVRTELNESEKRISAAIHDHDRMLSSAMSQRTKGMLRMVSQTWLTIVLVSVLLIASSAGILWWQGQQILDNYTTIREQKSTQAMLSERNSGVQLTTCGEERRRCVRVNPDAGRFGEDSSWMILAGK

SEQ ID NO: 6363 - protein, 70 aa, Enterobacter cloacae
HMTELEKQLLSALEQLQQDYSKRLDEWESAFAEWRTMCGLMQRENAALSERVTDLSTQVLSLSEQLRRLS

SEQ ID NO: 6364 - protein, 111 aa, Enterobacter cloacae
ISVIWQRLLKMPETKQEAAQAITRGLLALASSGELKTRHDVTEALESAGFEVVRTTKSSISIADPDGGRNIRLKGAIYEQSFNAGEGLRAEIESAATDYRRDAESRIQRAR

SEQ ID NO: 6365 - protein, 235 aa, Enterobacter cloacae
VCQNGTERKREENQRRHPRPRPDAVLSHEPAYERDAAHGQPDVADHRPGLRAADSLKCGHSMVAGAADTRQLHDHPGAEEHAGHAVREEQRRAAHDLRRGTTPLREGEPGRGTVRRGFELDDTGGEIAHDGTGKTVAERIRAATAGLLEKAGRVGERLRGMADDVWSYATGERSAERARHGLEHAGAEFKRAAAPVVVRLNDIEAHREQERAAQHQKALELERSQRQQEYDGPSL

SEQ ID NO: 6366 - protein, 1090 aa, Enterobacter cloacae
KPRKAARTSGAPDQSYTGKLLKKPKFTQWALSLARGSYIQKRGSHMEFFYVVKATQKSGKEDAVIWFTAKSEARANLQLDVELEDAGIETGRGKNYSKPARTDFPVYNDLPEESTVDYTWCKRYELQDDGRTWLPKAGAVSTGAVDNTAAPEPTVKVEATVECVPLENRTPAVRFAVHLTSDKYQSHITKEQQLAASEMSLDEGNTYLQNLLQAKNDIPEVDELSLNAEWKLVQAIKQVFAPDEEHEVKLLAAFMADWLRVDAGDRNELVREWRSGKLTLLKSESTSETGVTTDQDPEPDNGIQIDENDDETTRYPVVRMPFRKQLLAQFTANELRHHLTREEYEGISALEMDTDNGYVQNLLLAAENCEEVKGYDTKDLWRYTEAIRKVFSQEKRHELALVLRFTRIWAATDYIDRGILVREWAAGNRISNIQRTDSGTNADGAYVTDRGEGAHHTLDTLDLEIACALLPMDFHHFEIPSSVLRRAKEIVAKKEEPWKSWSAILRNQPGVLAVNRAAIFNLIRIAPENIHHTPAAHLEFVNKAMTAEFNSAVEVLPLPTAAVETEAPVEQPQVENLGSGVFSIDGLMGGNTEPVADTSSNEVEKTENAAETTSDVQMETAKPEKDEDVGSVPPSESTDAANSQTDSVALEEQQAEPVIEYPAYFEPGRYEGLPNDVYHAANGISSTQVKDARVSLMYFNARHVAKTIQRTASKVLDMGNLVHALALQPENLETEFSVEPQIPEGAFTTTATLREFIDAYNASLPALLSADEIKALLEEHNASLPAQVPLGASQEETAQSYMALPAEYQRIEEGQKQTAAAMKACIKEYNATLPVPVKTSGSRDALLEQLAIINPDLVAQEAQKSTPLKVSGSKADMIQAVKSVKPDAIFADELLDVWRDNPDEKILVTRQQLATARAIQSALLAHPTAGMLLTHPSRAVEVSYFGFDDETGLEVRVRPDLEIELDGVRIGADLKTISMWNVKQESLRARLHREIIDRDYHLSAAMYCETAALDQFFWIFVNKDENYHWIAIIEASTELLELGMLEYRKTIRAIATGFDTGEWPAPITTDYTDELNDFDLRRLEALRAQA

SEQ ID NO: 6367 - protein, 364 aa, Enterobacter cloacae
GGFMHNTNVTVTDQNTVINSNVALFDSQYLNAISTFAQIMAQGTATVPKHLQGNQADCMAVAMQAAQWQMNPFAVAQKTHLINGVLGYEAQLVNAVISRSGVLASRFEYEWYGPWEKVVGKFHIRKGDKGEYRVPGWTLADEAGIGIIIRATLKGEDQPRELDLLLAQARTRNSTLWADDPRQQLAYLAVKRWARLFCPDVILGVYTPDELDDRREEREVNPAPAQHVSLADISGDNVTTTQTAQESAQNIYALADDFRDRIEAAQDVDSAKALRADIETVKATLGSALFTELKNKAVKRYYLVDARNKVEAAINSLPSSDEPDAAARFAEVERVLAASKRHLGDELHGQFSITLADMKPEYVD

SEQ ID NO: 6368 - protein, 71 aa, Enterobacter cloacae
TMSQVIFNEEWVVGARLTEKTGLTERQIEKYRQGCWVEGVHFKRVSPSGEKTLRGTTWYNYPRINQLIRDA

SEQ ID NO: 6369 - protein, 69 aa, Enterobacter cloacae
FFAACATYWRKRGIQMCNSTKCGYCGKTVKPGEVVKSTLLYRNGAQLARKEKEYCSERCASYDQMAHEA

SEQ ID NO: 6370 - protein, 416 aa, Enterobacter cloacae
GMRKMAALPTGVEIRNNKICIWFMYRGKRCREILKGWINSPANIKKAGNLRAVIVSEINLGEFDYNQRFPSSSRAKKTVTTVSVQTFSELCELWTSIKETEISANTMRKTRLQLGTLMHIINGDTPVSAIRHSDILKYRKELLNGETLYLANPRSNKQGRTVRTVNNYISLLCSLLRFAHKSGFISGKPFEGIKKLHKGKVKPDPLTKQEFSLLAESERGQSLNMWTFAVYTGVRHGELAALAWEDIDWEKGTAHIKRNLNALGMFGPPKTEAGNRVITLLEPALEALKAQRKLTALQPKTEIVFNHREYGAVENQSLRFVFIPRMRKGEQKAYYSLSSIGARFNAAVKRAGIRRRNPYHTRHTFACWLLSAGANPSFIASQMGHENAQMVYEVYGAWIEEMNGEQVLMLNNKLAR

SEQ ID NO: 6371 - protein, 83 aa, Enterobacter cloacae
SHGALAGTQVSALITLTPLFTLLFSDLLSMAWPDVFVKPMLNLLGYLGAFVMVAGAMYSAIGHRLWGRWRKNEAVVIVPRSGE

SEQ ID NO: 6372 - protein, 396 aa, Enterobacter cloacae
VTESKMKFVDEATILVVAGDGGNGCVSFRREKYIPRGGPDGGDGGDGGDVWLEADENLNTLIDYRFEKSFRAERGQNGQSRDCTGKRGKDVTIKVPVGTRVIDQGTGETMGDMTKHGQRLMVAKGGWHGLGNSRFKSSVNRTPRQKTMGTPGDKRDLQLELMLLADVGMLGMPNAGKSTFIRAVSAAKPKVADYPFTTLVPSLGVVRMDNEKSFVVADIPGLIEGAAEGAGLGIRFLKHLERCRVLLHLIDIDPIDGSDPVENARIIIGELEKYSEKLAQKPRWLVFNKIDLMDKAEAEAKAKAIAEAMGWEDKYYLISAASQVGVKDLCWDVMTFIIENPVVQAEEAKQPEKVEFMWDDYHRQQLEELEAEEDDEDWDDDWDEDDEEGVEFIYKH

SEQ ID NO: 6373 - protein, 121 aa, Enterobacter cloacae
IFIAHSESYEDVRGSGVYMYAVFQSGGKQHRVSEGQTVRLEKLDIATGESVEFAEVLMIANGEEVKIGVPFVDGGVIKAEVVAHGRGEKVKIVKFRRRKHYRKQQGHRQWFTDVKITGISA

SEQ ID NO: 6374 - protein, 280 aa, Enterobacter cloacae
VRFSRSGNGLKPRNVLRGFLHWKPGKFSVGKTGMKQQAGIGILLALTTAMCWGALPIAMKQVLEVMEPPTVVFYRFLMASIGLGAILAVKGKLPPLRIFRKPRWLVLLAIATGGLFGNFILFSSSLQYLSPTASQVIGQLSPVGMMVASVFILKEKMRGTQIIGASMLLCGLVMFFNTSLIEIFTRLTDYTWGVIFGVGAATVWVSYGVAQKVLLRRLASQQILFLLYTLCTLALLPLAKPGVITQLSDWQLACLIFCGLNTLVGYGALAEAMARWQAHR

SEQ ID NO: 6375 - protein, 159 aa, Enterobacter cloacae
QMQAIPMTLRGAEKLREELDFLKSVRRPEIIAAIAEAREHGDLKENAEYHAAREQQGFCEGRIKDIEAKLSNAQVIDITKMPNNGRVIFGSTVTVLNLDNDEEQTYRIVGDDEADFKQNLISVNSPIARGLIGKEQDDVVTIRTPGGEVEYEIIKVEYL

SEQ ID NO: 6376 - protein, 85 aa, Enterobacter cloacae
MAHKKAGGSTRNGRDSEAKRLGVKRFGGESVLAGSIIVRQRGTKFHAGTNVGCGRDHTLFAKADGKVKFEVKGPNNRKYISIVAE

SEQ ID NO: 6377 - protein, 364 aa, Enterobacter cloacae
RSHQNRTRRGLPSGEPEMNSMRRRLMVLLAVILLFFQLISVVWLWHESREQIGFLVNETLSAKARNNHVEKEIREAIASLLVPSLVMVGFTLLFSFWAVTWITRPLNKLRASLANRSADNLTPLPMYSDMEEIGAVTTSLNQLLARLDHTIQQERLFTADAAHELRTPLAGIRLHLELMAQSGSPQATPLINRIDQLMHTVEQLLMLARAGQAMASGHYDTVNWTESIIAPLSLEHEAKEHTVLWPAHSTLTVQGDAVLLRLMLRNLLENAARYSPAGTIIEVALTATEGGTRVSVTDQGPGIDEAHRQSITEPFRRLDQRYGGSGLGLSIVQRIVQLHHGHLTLENGAEGGLIASCWLPTKIG

SEQ ID NO: 6378 - protein, 124 aa, Enterobacter cloacae
YINRGSCQPQVVKTMNRFQSQRKQKYTMNLSTKQKQHLKGLAHPLKPVVMLGNNGLTEGVLAEIEQALEHHELIKVKIASEDRDTKNLIVEAIVRETGACNVQVIGKTLVLYRPSKERKISLPR

SEQ ID NO: 6379 - protein, 222 aa, Enterobacter cloacae
LAMKLLIVEDDLLLQEGLALALGNEGYALDCAATAAEADALIQSGEYSLVILDLGLPDKDGATLLCQWRRRGVENPVLILTARDAIEDRINGLDSGADDYLVKPFALAELQARVRALIRRYQGHSDNLLTDGDITLNLQTQQVLRQSQPVEVTPKEFALLTRLIMRSGQTVHRETLQQDIYSWQDDPGSNTLEVHIHNLRRKLGKDRIKTVRGVGYRLESQK

SEQ ID NO: 6380 - protein, 480 aa, Enterobacter cloacae
REIMRFSSFIIGLTTSITYTVQAANVDEYINQLPAGANLALMVQKVGAQAPEIDYHSQQMALPASTQKVITALAALLQLGPDFRFTTTLETRGNVEGGELKGDLIARFGGDPTFKRQDDRNMVAVLKKSGVTKIDGNVLIDTSIFASHDKAPGWPWNDMTQCFSAPPAAAIVDRNCFSVSLYSAPKPNDLAFIRVASYYPVTMFSQVRTLAKGSPEAQYCELDVVPGDLNRYTLTGCLTQRADPLPLAFAIQDGAGYAGAIFKDELKQAGITYTGTLLRQTQVNEPGTVIASKQSAPLHDLLKIMLKKSDNMIADTVFRMIGHARFGVPGTWRAGSDAVRQILRQQAGIDLGNTIAVDGSGLSRHNLISPATMMQVLQYIAQHDAELNFITMLPLAGHDGSLQYRAGLHAAGVDGKVSAKTGSLQGVYNLAGFITTASGQRMAFVQYLSGYAVEPADQRNRRIPLVRFESRLYKDIYQNN

SEQ ID NO: 6381 - protein, 231 aa, Enterobacter cloacae
CMVSGWPSEECLMKYSLIYADPAWLYDNKASNGAAEDHYDTMKLIDMKRLPVWDLAADDAVLAMWFTGTHTREAIELAEAWGFKVRTMKGFTWVKFNPLAEKHINKALQAGRVEDFYDFLDLLNAQTRMNGGNYTRANTEDLLIATRGNGLERKCASIKQVIYSPLGEHSRKPAEARFRLEKLYGDVPRIELFSRCGAPGWDHWGNQSELPAVELIPAVAVPMKKQQERAA

SEQ ID NO: 6382 - protein, 255 aa, Enterobacter cloacae
SEWRKGRDIDNQASTSNGGNGVRAILTPEIAPMSGVVLFRPGNELLWLFRQGRVVIEQPSEAIQHLPSGLIPEAHQPLTDDANMKAIFVNERVIQRAGGLSSLDAWLERKFECQWPHTDWHATDFTVMRHAPGSIRLCWSCDNHLREQTTERLAGIAMQNLVKWLLERVNIDLGFSPEHTLSLPEFCWWMVRNDLADLVPESVASKALRIKPEQHSSVMRESDIVPSLPATQIFQEKAKKIVAVKVDPETPDLSC

SEQ ID NO: 6383 - protein, 176 aa, Enterobacter cloacae
RCSNTVTQQSAFRNYQRKNNMVEPSLKEVVKAMCKAYPGGREAMAGALGMSVTQFNNNLYEKNGCRFFEVNELEAMEDISNTSLLADYFARRRGALLVDVPQLEDLDRVDLFDRAMRTSAARGRVDTVIQRALEDGVIERHEAEEINEYHRRHLAAREEEIRAIVALFSRKKSQKK

SEQ ID NO: 6384 - protein, 189 aa, Enterobacter cloacae
GWNLQIQLQEHRVQQSPGGLQRSELMSLLKDIQIFIAANPGLTNKEIAASMPQYDVHAVQRGVCHLVKLNRATRQHNGKCYQYFAKAPGGEVGEGRSALKINRADKPAVPEQEEGLNPAVTTMMDKAQGLFEKGLYQRAATILMDAFNRSKNEEQRMKILIERQRCLSMAPKVKAPSDAWCLAGRARNV

SEQ ID NO: 6385 - protein, 138 aa, Enterobacter cloacae
MAEKTGSDVMKLVLPFPPSVNTYWRAPNKGPLKGRHLISAKGRAYQSAACVAIVEQLRFLPKPSTAPAAVEIMLYPPDERRRDIDNYNKALFDALTHAGIWEDDSQVQRMLVEWGPKVNGGRVEISITKHQPAMGVMV

SEQ ID NO: 6386 - protein, 151 aa, Enterobacter cloacae
SEIRRPVNAAVSVFRSCAGNRRISMKSGDNMRDIQMVLVRWGNWSKYKIEADVGYSPIAAGFKGLLPESGAMPKCTEDDALIIDSCLARLKLKRPDEYELIFDHYVKGVSKRGIGRKLKLSEGMVRIKFQMAEGFVEGCLAMLDIRLQMDE

SEQ ID NO: 6387 - protein, 311 aa, Enterobacter cloacae
RTTMSLLMPSRPIVINPDLAYSIGLNEAIALQQVNYWLKETTSGLERDGVRWIYNTTEQWLEQFPFWSESTLKRTFTRLKNLGVLKVDQLNKSQRDMTNYYTINYESELLDEVKVTKSKSSKCTLPSGQNEPMEEVKVERSIGSKRTALIRSNCTDVLTENTTENTTDIKKPICPVAPQPDSDVLITDQAKQVLTHLNHVTSSRYQVSTTSLQNIRARIGEGFTVEELSLVVDYCNAKWSDDLTMASYLRPQTLFQPTKFPAYLKSATNWANAGRPARVNGKWEREDGIFKSSFKNTEYSKVPAGFRGANS

SEQ ID NO: 6388 - protein, 124 aa, Enterobacter cloacae
AYTGSCRSHEKTAGARRMKPELTPRQNEVFEAIKVHIEKAGFPPTMLELAGLIGCASPNAAVAHVKSLKKKGYITVAPGAARGITVVKTEWDADPVTIIKGLLSGGDKARDNAVEWLKKQGVTL

SEQ ID NO: 6389 - protein, 71 aa, Enterobacter cloacae
CNNPADDPHHLIGHGQGGMGTKAHDLFVIPLCRAHHDELHADPVAFEAKYGDQLTLLFRFLDRALAIGVLA

SEQ ID NO: 6390 - protein, 481 aa, Enterobacter cloacae
ITPQTQNFDFFLLLNISIAAIVAANATHLTPVISTFTRFFFASWGVLNLGIIWRLDELMFIVLMLNLLYGFAIYRHALTSHAFFIQQALLEEKSSRLAEQFRQAKEDAEQALLDKNQFLTTASHDLRQPVHAMGFLIEAILHRNRDGSLTPQLLDLQQSVRSVHLMLNSLLDLSKIESGNVLSAPTKVDIGALLDSVITLFREEANSRALRLCIRRPKRHIYVMGDPLLVRQSLINLIQNALRYTLQGGVLVAIRPRGDECMVEVWDTGVGIADEEKGKIFSPYYRPELAWKIDSAGHGLGLAVVARCAKLMKVKYGMQSIEGKGSRFWMRFTQYAGEDSVLDTPPAADNTATPVRYAPLHGSCLVVDDDPLVTSAWESLMSVWGIDVRCAASAEEAFAIIDDGFTPFAVLCDQRLRSGESGFDILKALFERLPDMSGAIVSGEFNSPVLLEAEQEGYLVLRKPLEPAKLHALLTQWLGCR

SEQ ID NO: 6391 - protein, 461 aa, Enterobacter cloacae
PGRCVMSEMMMPCSYEAEQAVLGGLMLDNDRWDEVILQISPEDLFSRPHRMVFRVMAELAGEGLPLDLITITERLENRGDLEQCGGFAYLAEMSKNTPSAANILAYAGVVAEKSRLRQLMTVGNSLLSDVQAPKASSAGILESAEGKLFNIAEQGAMQLNSETGVNEALDKLLTQLESMSASDGLTGTPTGFSELDAMTCGLEPGDLALLAARPSMGKTSLAMAACTAAVSAKPDDHVFVFSLEMPSEQLMMRLLAMEGRVELSRLRSGNMDDEDWARVSEATGRIIEWKNRLIIDDTSYQTPATLRARARRYVRKYGRPSLIMLDYLQLVRSPEQENRTQEIAEISRSLKALGKELGCPVLALSQLNRLVEQRADKRPNNGDLRDSGALEQDADLIMFIYRDEVYNPGTPDAGVAEIIVGKQRQGPTGTVKVKFDGRYTLFSEFQEGSYDFGYRSGRKQA

SEQ ID NO: 6392 - protein, 295 aa, Enterobacter cloacae
RVCKMKILPVISPKGGEGKSTFAAYLAGFLADAGLNTLLVDADYSQPTASSIFALEDESPFGLYELLMQMVSDHTQCISQTAIKNLDVIYSNDPDELLPTAMLHAADGRLRLRNILQHPFFNRYDAIIVDSKGATGVMTELSLLSSTGNVMGIVKPILPDVREFIRGSLHMLTRLKTYENYGIRLPDISILVNCIENTLLDREAMDGLAAIINEKHYDASALGNRDVYRLLDTRIEALDIFKLGHVKQQPVHRLEYKTRRKGPAAAVTMHDLACELFPEWQSHFSDVLTREVRHV

SEQ ID NO: 6393 - protein, 574 aa, Enterobacter cloacae
LRLPQREETGMSRKSSNVGAAMLQPGRQSQAAGNISVMPAAEMPMVLTLDQLSPNPDNPRTSRNPRYDDIKASIRSRGLDTVPKVTRDPDGEPDMYIFSDGGNTRYQILSELWQETGEDRFFRVHVLFKPWPGRLQCVIGHLAENEVRGELSFIEKAQGIHKARSIYEEQMGKTVSLRQLSELLTHEGLPVHYSTVSRMEDALKYLYPWIPDLLESGLGRPQITALLALRHDAERVWDEFCLISDTGDKSFSDVFGQCCGRFNSPELWSLEMFRDELIGDLLHALPHPELDYDRWMMELDPKERNRRHHFGDPEPVSIPPANSLVTADSAGQATPAQKSVEVVQPFSSPRREISGEPVTPAPDNTPPEKLDKQHPRHEVQPDMYGAAPVISGESADVSGLVTLSDGYGEENGGEEGNGEDGLLSLLTPEPEVVLQDDAPVTNDSIWHVPAHQDDIEHLQNTAFRLAWELGEVLGCEDEILPQRDNDMSAGYVGAGEMCSEAAAFLLGLTGEAPALHPAAGVCGLPELFTGGPGEGEAPALTDEDALKLLRLLRVMRRLRELQRGLTYGEDNSDE

SEQ ID NO: 6394 - protein, 268 aa, Enterobacter cloacae
QHDSLFTLPPYAGAVLSILTVQNGRDGGRKGKIMSLPAESLIAYTLDKMNARLAASPRRDDGRIRNGLLFTGNVHDSIPRRLLLDTRLSPLDKMGWMMIRLYAQNNEGAVFPSYDELQLQLASPGKGKASRETVSRVLLMLRITGWLSLCKRVRDDKGRVRGNIYAQHDEPLTFSDAEMLDPRFLDVVADACLSKNRTISQNAREVLDDIKNDPTMRHYRSHLALIESRLDSPQSPSQMAKHHHRIPCPAPGSETARLHYEMRIRTDC

SEQ ID NO: 6395 - protein, 284 aa, Enterobacter cloacae
TGSRGLPGEKWVWLYLWRRLPRVRQQIQPVQQPPHRRDGCDQQNGAAPMIELVIVSRLLEYPDAALVQHQQELFDALASSENLDKEDAQKLGVFLRDLLARDLLDAQADYSQLFDRGRATSLLLFEHVHGESRDRGQAMVDLMAQYEQHGLQLDSRELPDHLPLYLEYLAQLPKEEALGGLQDIAPILALLGARLQQRESSYAVLFDLLVKLANASVDSQKVAEKIADEARDDTPQALDAVWEEEQVKFFADQSCGESEISAHQRRFAGAVAPQYLNISNGGQH

SEQ ID NO: 6396 - protein, 518 aa, Enterobacter cloacae
PGTGERKMKIRSQVGMVLNLDKCIGCHTCSVTCKNVWTSREGMEYAWFNNVESKPGTGFPTDWENQEKWKGGWIRKINGKLQPRMGNRAMLLGKIFANPHLPGIDDYYEPFDYDYQNLHNAPESKHQPIARPRSLITGQRMDKITSGPNWEEILGGEFEKRAKDQNFENMQKAMYGQFENTFMMYLPRLCEHCLNPACVATCPSGAIYKREEDGIVLIDQDKCRGWRMCITGCPYKKIYFNWKSGKSEKCIFCYPRIEAGMPTVCSESCVGRIRYLGVLLYDADAIENAASTENEKDLYQRQLDVFLDPNDPKVIEQALKDGIPQSVIDAAQQSPVYKMAMDWKLALPLHPEYRTLPMVWYVPPLSPIQSAADAGELGSNGILPDVESLRIPVQYLANLLTAGDTQPVLLALKRMLAMRHFKRAETVDGVNDTRALEEVGLTEAQAQEMYRYLAIANYEDRFVVPSSHRELAREAFPEKSGCGFTFGDGCHGSDSKFNLFNSRRIDAMDVTSKTEPHQ

SEQ ID NO: 6397 - protein, 1279 aa, Enterobacter cloacae
  UNSURE (516)
SLSILTIFHSVTFAANQQCRFREPQAPHRRYPMSKFLDRFRYFKQKGETFADGHGQVLDTNRDWEDGYRQRWQHDKVVRSTHGVNCTGSCSWKIFVKNGLVTWEMQQTDYPRTRPDMPNHEPRGCPRGASYSWYLYSANRLKYPLMRKRLMKMWREAKVQHSDPVDAWASIIEDADKAKSFKQARGRGGFVRSSWKEVNELIAASNVYTVKTYGPDRVAGFSPIPAMSMVSYASGARYLSLIGGTCLSFYDWYCDLPPASPQTWGEQTDVPESADWYNSSYIIAWGSNVPQTRTPDAHFFTEVRYKGTKTVAVTPDYAEIAKLCDLWLAPKQGTDAAMALAMGHVMLREFHLDKPSQYFTDYVRRYTDMPMLVMLEERDGYYAAGRMLRAADLVDALGQENNPEWKTVACNSNGELVAPNGSIGFRWGEKGKWNLEQRNGTTGEETELRLSMLGSQDEIADVGFPYFGNEGSEHFNKVELQNVLMHKLPVKRLQLADGSTALVTTAYDLTMANYGXERGLNDENCATSYDDVKAYTPAWAEQITGVPRAQITRIAREFAENADKTHGRSMIIVGAGLNHWYHLDMNYRGLINMLIFCGCVGQSGGGWAHYVGQEKLRPQTGWQPLAFALDWQRPARHMNSTSYFYNHSSQWRYETVTAQELLSPMADKSRYSGHLIDFNVRAERMGWLPSAPQLGTNPLRIAEAAKKAGMSPVDYTVKSLKDGSIRFAAEQPENGKNHPRNLFIWRSNLLGSSGKGHEYMLKYLLGTENGIQGKDLGKQGGVKPEEVEWKDNGLDGKLDLVVTLDFRLSSTCLYSDIVLPTATWYEKDDMNTSDMHPFIHPLSAAVDPAWESKSDWEIYKDIAKKFSEVCVGHLGKETDVVTLPIQHDSAAELAQPLDVKDWKKGECDLIPGVTAPHIIPVERDYPATYERFTSIGPLMEKIGNGGKGIAWNTQSEMDLLRKLNYTKADGPAKGQPMLNTAIDAAEMILTLAPETNGHVAVKAWAALSEFTGRDHTHLAKNKEEEKIRFRDIQAQPRKIISSPTWSGLEDEHVSYNAGYTNVHELIPWRTLSGRQSLYQDHQWMRDFGESLLVYRPPIDTRSVKAVMGAKSNGNPEKALNFLTPHQKWGIHSTYSDNLLMLTLSRGGPIVWMSEADAKDLGIEDNDWIEVFNSNGALTARAVVSQRVPAGMTMMYHAQERIVNLPGSEITEQRGGIHNSVTRITPKPTHMIGGYAQLAYGFNYYGTVGSNRDEFVVVRKMKNINWLDGEGNDQVQESVK

SEQ ID NO: 6398 - protein, 91 aa, Enterobacter cloacae
  UNSURE (69)
  UNSURE (86)
  UNSURE (87)
RRTALMHFLNMFFFDIYPYIAGTVFLVGSWLRYDYGQYTWRAASSQMLDRKGMNLASNLFHIGILGIFXRSLPGALTPHWYSHPAXXELQS

SEQ ID NO: 6399 - protein, 298 aa, Enterobacter cloacae
YAALENRAGEGGMIWHLFFQPFIEYGFMRRALVVCLALSVSTTALGVFLQLRRMSLMGDALSHAILPGVAVGYLLSGMSLLAMTVGGFIAGIAVALVAGLVSRRTPLKEDASFAGFYLGSLALGVTLVSLRGSNVDLLHLLFGSILAVDSASALFVTGVCMFTLLTLAIFYRGLVSEAFDTAWLQVNARWLPGMLHGLFLALLVLNLVAGFQVLGTLMAVGLMMLPAVAARCWVRTLPGLLLMAGISGIFCAWLGLSLSWAVSLPAGPSIVLTASALFFISVLFGTRSRLADSLRALF

SEQ ID NO: 6400 - protein, 210 aa, Enterobacter cloacae
NKRLSGRCARIGFFLKPPRKTRRASPYLMRKCYLVLHVFLRPGARMTDHELMQLSEVVGLALKQRGATLTTAESCTGGWVAKAITDIAGSSAWFERGFVTYSNEAKAQMIGVREATLEQHGAVSEPVVIEMAIGALKEARADYAISISGIAGPDGGSDVKPVGTVWFGFATSKGEGITRRECFSGDRESVRRQATEYALKTLWQQFLQNT

SEQ ID NO: 6401 - protein, 195 aa, Enterobacter cloacae
LDFRIIMSKSTAEIRQAFLDFFHSKGHQVVASSSLVPNNDPTLLFTNAGMNQFKDVFLGLDKRNYSRATTSQRCVRAGGKHNDLENVGYTARHHTFFEMLGNFSFGDYFKHDAIQYAWELLTGENWFNLPKERLWVTVYETDDEAFDIWEKEVGIPRERIIRIGDNKGAPYASDNFWQMGDTGPVFYHGAGRIRA

SEQ ID NO: 6402 - protein, 252 aa, Enterobacter cloacae
DIHVPVFSLILASAAAGAGAHSVSRPGRALGGGVAMIVMNDLVAGYDRQPVTRALSGVIERGSMTAIVGANGCGKSTLLKTLAGFLPPVSGTFRWQGRRPVVGWLAQRHALEAQFPLTVQDVVSMGCWPAISLFAGFRRDARMRIAGALERVGLESMAFSTIDELSGGQFQRMLFARVLVQQAPLVMLDEPFTGVDEATCNVLMDLMLEMYMQGQTLLAVLHDSERVSRHFPQTLRLDADTPHWKTERVRVA

SEQ ID NO: 6403 - protein, 171 aa, Enterobacter cloacae
IDRFFMSEPTSRRPAYSRLLDRAVRILAVRDHSEQELRRKLSAPVMSKNGPEDIDATAEDYDRVVAWCYEHHYLDDGRFAARFLASRGRKGYGPARIRQELNQKGVARESIEKAMRESEIDWCELAREQAVRKYGEPLPREFSEKVKIQRFLLYRGFLMEDIQDIWRNFTD

SEQ ID NO: 6404 - protein, 303 aa, Enterobacter cloacae
PAGAFLTQGETMKRTGLAVALALGMMTHGVMAKTLNVVTSFSILGDITQQVGGDRVKVTTLVGPDGDPHTFEPSPKDSAALSKADVVVVNGLGLEGWLDRLVKASGFKGQLVVASDGVKTHTLEEDGKTVTDPHAWNSAANGALYAQNILSGLVKADPEDTAALEATGKPYIAQLSQLDGWAKKRFSDIPQAKRKVLTSHDAFGYFSRAYGVTFMAPQGLSSESEASAAQVAEIINQIKADGVKTWFMENQLDPRLVKQIATATGAQPGGELYPEALSAKGGVADTYVKAFRHNVDTLANSMK

SEQ ID NO: 6405 - protein, 364 aa, Enterobacter cloacae
SAVASPGMTGVIMAIDENKQKALAAALGQIEKQFGKGSIMRLGEDRSMDVETISTGSLSLDIALGAGGLPMGRIVEIYGPESSGKTTLTLQVVAAAQREGKTCAFIDAEHALDPVYARKLGVDIDNLLCSQPDTGEQALEICDALARSGAVDVIIVDSVAALTPKAEIEGEIGDSHMGLAARMMSQAMRKLAGNLKQSNTLLIFINQIRMKIGVMFGNPETTTGGNALKFYASVRLDIRRIGAVKEGDNVVGSETRVKVVKNKIAAPFKQAEFQILYGEGINFLGELVDLGVKEKLIEKAGAWYSYNGDKIGQGKANAISWLKENPAAAKEIEKKVRELLLNNQDSKPDFVVDGADAEETNEDF

SEQ ID NO: 6406 - protein, 80 aa, Enterobacter cloacae
PFLGFVARLVRSAMLVLLCVDFFRSARACGLPGWFFVLRFAFPFALIPSFSVLGLALGDLLFGAVLSETVFAWPGMGAWV

SEQ ID NO: 6407 - protein, 109 aa, Enterobacter cloacae
FNFKVNYYGGTMIHSFKDRRLEKFFRNGKTTAGIPSEIINAILCRLETLDNVQSERELLSNSLRYERLRMTSNRYSSIRVNSKYRLFFEWNDGAHNVHLSAHDYKSLIH

SEQ ID NO: 6408 - protein, 419 aa, Enterobacter cloacae
GWLMSTISTDLIARIYAASELPLSNDELYREVQRETGMSDAELHELKEFGSDKTRTSGVKHKVRWFQQTLRQAGVIERVPEKRGVWRYSSKTKTNLHESWEKLCVVGFSTSLGASVFGNAYAFFSNITEQIHLCLTSPPYLLRNSRDYGHGGGRGEQVYIDWLLRILEPIVKQLVPGASVALNITQDSFNRGRPSRSLYLERLTLALCDKLGLELMDRLQWVNRSKPPSPTHWACKQRVQLCSSYEPVLWFTNDASKVRSNNLRVLQPHSEQHLKLQAAGGENRTTFYGDGAYQLKSGSFGNKTEGTIPKNTLFYGNSCADTRFCHSIARELGFPLHGATSPTRLAAFLIEFLTEPGDLVVDPFAGLHKVPIAAERLGRRWLATDKIMEWLAISRNLFTAAPGYKSNPMLDELAELYRA

SEQ ID NO: 6409 - protein, 271 aa, Enterobacter cloacae
CGTIKNGGWPVSYSIKIGKHSIELAGYAGKVVAPNTQMAALFRGMAGELTNLRTTAQQAEAEADLLDVIRNDPDLNEQAKNRRAGEARNPDTLKDFTRGVAAVSEQAANILDYLKNRLAPVNPLAPDDVQGFMRDSEMRQAFARLDRRSQEKMLLSMHSGKHQELADALLRAHAVCSGLDTEQLKRLGFSRIASENGQVISAVADLVDAVRKDVTQITAVRTWYNNLVYGKNDDPSEVLPRMTGLDQLSEHVSAMLKGSQRQTHSEEKQAA

SEQ ID NO: 6410 - protein, 194 aa, Enterobacter cloacae
PGKTNMTIKNARAGQGFAHPENSSDDISVIKFEDAKVRIVKILGEPWFVAADVCAALEIADHKVALRRLDDDEKGECLIPTPGGKQTMRTVCESGFYKLISRSRKAITPGTFAHHFSNWVFREVIPSIRKTGFYGVPFVFLNDFSRRMAAYQQEASKRGYKLQQCKGVKEALEREEIQLWLKYQPELLKENGDE

SEQ ID NO: 6411 - protein, 626 aa, Enterobacter cloacae
ICFFRAGRRRKRYRSDYAGTGHRTNSGYAGNHQGAREQKMKNAPNLKKQPADLMEESIIFAGADAWTFAKAWQEMNPIGDTVPPVVLDKKQLAELENIRIVDDGRLYARVCRGGHLTERQITILATKLAVAGVERAQFYSEGYQLLEDWTPQLPRLKADAQAGKSMVIGKPLTDVNLRDLADNEKALILAARYTGIAINENNEGVYVYRAGIWEKTSLLELSREMVAIYNENKTNFSKRAINNVIDALKIVIPVMGEPRRSLIPFANGVYDMETGVFSEHSQDNWLTNHNGVSYTPAVPGENLRDHAPNFHKWLSYASDRDAIKMQRIAAALFMVLANRYDWQLFLEITGEGGSGKSVFTHIATMLAGAHNTASGNMAALDSARGRAQFVGKSMITLPDQPKYSGEGTGIKAITGGDAVEIDPKHEHQYTAVLRAVVVATNNTPMIFTERAGGVSRRRVIFQFNRRVSEEDKDPDLAEKISAEIPVVVRRLLANFANPEKARALLLEQRNSEEALEVKQKTDPLYAFCAHLERLADCAGMMVGNRNPPHYPRIYLYHAYLAFLEANGFDKPLTLNKFAEGMESAMREFNHEYRKERRARGMVTNVELSESAEDWLPQTHPVAGHKE

SEQ ID NO: 6412 - protein, 130 aa, Enterobacter cloacae
KTQYLFFEDYALIDLWLKSKRFFFEEKLLFYYLSRLKNRLFTLSSSTRVYLSAFRNKGVNMSKALIRLPEVQRRTGYSKAWIYRLLKERKFPQSVKIGSRSIAFVESEIDAWITQRIEERDALLVRRPQL

SEQ ID NO: 6413 - protein, 324 aa, Enterobacter cloacae
PLYKVYFGDFHCFEPVMKLIRGIHNLSQAPHGCVLTIGNFDGVHRGHQALLQGLRKEGEARGLPVVVMIFEPQPLELFAGEKSPARLTRLREKLRYLAESGVDYVLCVRFDRRFAALTAQNFVSDLLVRQLGVQFLAVGDDFRFGAGRQGDFLLLQKAGLEYGFDVTSTMTFCEGGVRVSSTAVRQALANDELDTAETLLGHPFTISGRVVHGDALGRTIGFPTANIPLRRQVSPVKGVYAVEVAGLGEKPFYGVANIGTRPTVAGVRQQLEVHLLDVVMDLYGRHIDVILHKKIRNEQRFASLDELKAQIARDELTAREFFGL

SEQ ID NO: 6414 - protein, 953 aa, Enterobacter cloacae
NRLNCLRDKYGTENLMSDYKSTLNLPETGFPMRGDLAKREPGMLARWTDDDLYGIIRAAKKGKKTFILHDGPPYANGSIHIGHSVNKILKDIIVKSKGLAGYDSPYVPGWDCHGLPIELKVEQEYGKPGEKFTAAEFRAKCREYAATQVDGQRADFIRLGVLGDWSHPYLTMDFKTEANIIRALGKIIGNGHLHKGAKPVHWCVDCRSALAEAEVEYYDKTSPSIDVAFEAVDQDSIKAKFGLPGVSGPVSLVIWTTTPWTLPANRAISLSGEFEYALVQIDGRAVILAKDLVESVLKRANITDYTVLGTVKGDALELMRFKHPFLDFDVPAILGDHVTLDAGTGAVHTAGGHGPDDYNISLKYGLEIANPVGPDGSYLPGTYPALDGINVFKANDIIVDMLRTSGALLHVEKMQHSYPCCWRHKTPIIFRATPQWFVSMDQKGLREQSLKEIKGVQWIPDWGQARIESMVANRPDWCISRQRTWGVPMSLFVHKETQELHPNTLELMEEVAKRVEVDGIQAWWDLDARDILGADADNYEKVPDTLDVWFDSGSTHASVVDVRPEFAGHAADMYLEGSDQHRGWFMSSLMISTAMKGKAPYRQVLTHGFTVDGQGRKMSKSIGNTVSPQDVMNKLGADILRLWVASTDYTGEMAVSDEILKRAADSYRRIRNTARFLLANLNGFDPVKDMVKPEEMVVLDRWAVGCAKAAQEDILKAYESYDFHEVVQRLMRFCSIEMGSFYLDIIKDRQYTAKADSVARRSCQSALYHIAEALVRWMAPIMSFTADEIWGYLPGDREKYVFTGEWYEGLFDLSSTEAMNDAYWDELLKVRGEVNKVIEQARADKKVGGSLEATVTLYAEPELAAKLTALGDELRFVLLTSGAKVADYAEASADAQQSELLKGLKVALSKADGEKCPRCWHYTTDVGQVAEHADICGRCVSNVAGDGEKRKFA

SEQ ID NO: 6415 - protein, 182 aa, Enterobacter cloacae
RVAIPAYRICGPRRPGKRSATGQQVTQNKRAICMSKSVQSNSAVLVHFTLKLDDGSTAESTRNNGKPALFRLGDTSLSEGLEQQLLGLKEGEKKAFSLEPDAAFGVPSPDLIQYFSRREFMDAGEPEIGAIMLFTAMDGSEMPGVIREINGDSITVDFNHPLAGRTVHFDVEVLEIDPALEA

SEQ ID NO: 6416 - protein, 169 aa, Enterobacter cloacae
VCLMSKTLCSTGLRWLWLVVVVLIIDLGSKFLILQNFALGDTVPLFPSLNLHYARNYGAAFSFLADSGGWQRWFFAGIAIGICVVLAVLMYRSKATQKLNNIAYALIIGGALGNLFDRLWHGFVVDMIDFYVGDWHFATFNLADSAICVGAALIVLEGFLPKPAAKEQA

SEQ ID NO: 6417 - protein, 328 aa, Enterobacter cloacae
KCWRSIRHWRPEMQILLANPRGFCAGVDRAISIVENALEIYGAPIYVRHEVVHNRYVVDSLRERGAIFIEQISEVPDGAILIFSAHGVSQAVRNEAKNRDLTVFDATCPLVTKVHMEVARASRRGEESILIGHAGHPEVEGTMGQYSNPEGGMYLVESPEDVFTLNVKNEARLSFMTQTTLSVDDTSDVIDALRQRFPKIVGPRKDDICYATTNRQEAVRALAEQADVVLVVGSKNSSNSNRLAELAQRMGKAAFLIDDATDIQEAWVKNAVCVGVTAGASAPDILVQNVIARLQELGGGEAVPLEGREENIVFEVPKELRIDAREVE

SEQ ID NO: 6418 - protein, 127 aa, Enterobacter cloacae
KMTNRAIPLPDEQATLDLGKRVAQACQGATVIYLYGDLGAGETTFSRGFLQALGHNGNVKSPTYTLVETYTLENIMVVHFDLYRLAGPGRAGNLWGSAITLPTTPSAWWSGRNKVRVCCLTRMSKFT

SEQ ID NO: 6419 - protein, 455 aa, Enterobacter cloacae
PVERRDNGMINRVKGWVLAATVLLCAQVGAASLSDIQVSNGDSQARITFSFMGDPEYAFSQIDSRSVALDIKQTGVIQGLPLQFSGNNLVKSIRSGTPKDTQSLRLVVDLTEKGKTKAVKQQNGANYTVVFTINADVPPPPPPPAPVVAKRVEAPVYTPRPSEPARNPFKSQNDRLTAVTSSNTVTRPAVSARRTPVSGDKVIIAIDAGHGGQDPGAIGPGGTREKNVTIAIARKLRALLNDDPMFKGVMTRDGDYFISVMGRSDVARKQNANFLVSIHADAAPNRNATGASVWVLSNRRANSEMANWLEEHEKQSELLGGAGDVLANSQADPYLSQAVLDLQFGHSQRVGYDVATNVLSQLQSIGSLHKRRPEHASLGVLRSPDIPSILVETGFISNHGEERLLGSDSYQQQIAEAIYNGLRKYFDAHPLQSAPQGGAAQTASAALPGEMTATN

SEQ ID NO: 6420 - protein, 605 aa, Enterobacter cloacae
GEFMPIQVLPPQLANQIAAGEVVERPASVVKELVENSLDAGATRIDIDIERGGAKLIRIRDNGCGIKKDELALALARHATSKIASLDDLEAIISLGFRGEALASISSVSRLTLTSRTADQQEAWQAYAEGRDMDVTVKPAAHPVGTTLEVLDLFYNTPARRKFMRTEKTEFGHIDEIIRRIALARFDVTLNLSHNGKVMRQYRAVAEGGQKERRLGAICGTPFLEKALAIEWQHGDLALRGWVADPNASSAAFAEIQYCYVNGRMMRDRLINHAIRQACEDKLGADQQPAFVLYLEIDPHQVDVNVHPAKHEVRFHQSRLVHDFIYQGVAAVLQQQAEPELPLAKEEPAPRPLPENRVAAGRNHFAEPAVAREPAAPRLSPAGNAPRPTGANYPNAQPGYHKQQGALYRKLLDTPAVEHKEHITVSTPSLDGHSQSFGRVLTIIAPDMALLEREGKLLLLALSVAERWLKQAQLTPGVNAACAQPLLIPVRLKISPEETGVLRRVQTQLAEMGIEIVLDAQHVTIRAVPLPLRQQNLQNLIPELIGYLAQQTTFDAADTAQWIARHLASEHAPWSMAQAITVLAEVERLCPQLVKAPARWFVTTC

SEQ ID NO: 6421 - protein, 107 aa, Enterobacter cloacae
GKDRMAKGQSLQDPFLNALRRERVPVSIYLVNGIKLQGQIESFDQFVILLKNTVSQMVYKHAISTVVPSRPVSHHSNNAGGGTGSNYHHGSNAQGSSTPAQDSEETE

SEQ ID NO: 6422 - protein, 563 aa, Enterobacter cloacae
RAIHSISPWYCLSSHAWSLGSLAERSVSVIPTFWKPSSAPHCFIFCANSLRSRGCDMTDHTVKKNLASIPHSIWHADDLRRAEKEAADSLGITLYELMQRAGEAAFNVARTAYPDASHYLILCGHGNNGGDGYVVARLAVAAGLRVTLMALESDKPLPEEAGMAREAWLNAGGIIHAPDIIWPEDVDVIVDGLLGTGLMRAPRDDVAALITRANAHPAPVVALDIPSGLMAQTGATPGVSIEAAHTVTFIALKPGLLTGKARDVVGTLHHNALGLENWLIGQDTHITRFDASQLAQWLPPRRPTSHKGDHGRLLIIGGDHGTAGAIRMTGEAALRSGGGLIRVLTRSENIPPIITARPELMVHELTPQAIEKGLEWADVVVIGPGLGQQEWGKQALQKAENFRKPMLWDADALNLLAINPDKRHNRILTPHPGEAARLLNCSVAEIESDRLLSAQRLVKRYGGVAVLKGAGTVIASDDAMGIVDAGNAGMASGGMGDVLSGIIGALLGQKLPLYDAACAGCVAHGTAADRLAARYGTRGMLATDLFCTLRRVVNPDVIDVEND

SEQ ID NO: 6423 - protein, 74 aa, Enterobacter cloacae
  UNSURE (12)
FISSCRTRKSRXFMGIRDYFANDAICLVEWPQQGAGVLPDPDVEIHLDYQAQGREARISAVSSSGCSLLARLAG

SEQ ID NO: 6424 - protein, 317 aa, Enterobacter cloacae
NMTDVSKASLPKAIFLMGPTASGKTALAIELRKVLPVELISVDSALIYRGMDIGTAKPNADELRAAPHRLLDILDPAQAYSAADFRRDALAEMAEITAAGRIPLLVGGTMLYFKALLEGLSHLPSADPEVRAKIERQAAEQGWDVLHRQLEEIDPVAAARIHPNDPQRLSRALEVFFISGKTLTELTQTSGDALPYQVHQFAIAPASRELLHQRIEQRFHQMLASDFEAEVRALFARGDLHTDMPSIRCVGYRQMWSYLEGEISYDEMVYRGVCATRQLAKRQITWLRGWKGVHWLDSEKPQQALNEVIEVIGDIAD

SEQ ID NO: 6425 - protein, 124 aa, Enterobacter cloacae
RGLRLFDRYDAGEQAVLVHIYFSQDKDMEDLQEFESLVSSAGVEAMQVITGSRKAPHPKYFVGEGKAVKIADAVKATGASVVLFDHALSPAQERNLEALCECRVIDRTGLILDIFAQRARTHEG

SEQ ID NO: 6426 - protein, 416 aa, Enterobacter cloacae
RVMPRLSAASFSARRRSSACQMECGILARFFFTVWSVMSQPLDLNELAQKIKQWGAELGFQKVGITDTDLSASEPKLQAWLDKQYHGEMEWIARHGMMRARPHELLPGTLRVISVRMNYLPANAAFARTLKNPSLGYVSRYALGRDYHKLLRNRLKKLGETIQQHCVSLNFRPFVDSAPILERPIAEKAGLGWTGKHSLILSRDAGSFFFLGELLIDLPLPVDSPVEEGCGRCVACMTICPTGAIVEPYTVDARRCISYLTIELEGAIPEEFRPLIGNRIYGCDDCQLICPWNRYSQLTDEEDFSPRKALHAPQLIELFAWSEAWFLKVTEGSAIRRIGHLRWLRNVAVALGNAPWDEANLQALESRRGEHPLLDEHIEWAIAQQIEKRNAGVVEVQLPKKQRLVRVIEKGLPRDV

SEQ ID NO: 6427 - protein, 90 aa, Enterobacter cloacae
RLDGLWQLVGFYLGWLGGEGKGRALGVGEVKFTGQVLPTAKKVTYRIHFKRIVNRRLIMGLADGEVLVDGRLIYTANDLKVGLFQDTSAF

SEQ ID NO: 6428 - protein, 149 aa, Enterobacter cloacae
IGIVIARVSHQLAAVEVDNARGHIADERTVVGDEDNGAVKGFQEPFQPVNRFDIQVVRRFVQQQHLRPAHQGTAQRRFTQPAAGERRQLHIRFQAKLGQHFINAVFQLPQTVVIEHLLHFCQLVEILVARVRHDQMRNLVVTLEVFRLL

SEQ ID NO: 6429 - protein, 104 aa, Enterobacter cloacae
VTSLPRSRSTMRVAILRMNERSWEMKIMVPLKVFRNPSSQSIASISRWFVGSSSSSTLGPLTRARPSAALRSQPPESADSSISASRPSWASTSLMRFSSCHRPW

SEQ ID NO: 6430 - protein, 418 aa, Enterobacter cloacae
SMCDQHHADRHILCSQCDMLVALPELGHGHKAACPRCGATLTTEWDAPRQRPTAYALAALFMLLLSNLFPFIYMKVGGMTSQVDLLEIPGVMFSEDYASLGTFFLLFVQIVPAFCLVVILLLVNRVRMPTVLKIKLARILFQLKSWGMAEIFLAGILVSFVKLMAYGDVGIGSSFIPWCLYCVLQLRAFQCVDRRWAWDDIAPAPTLSQTVKVGVPGIRQGLRSCSCCTAVLPADVEVCPRCETKGHVRRKNSLQWTMALLVTSVMLYLPANILPIMITDLLGDRMPSTILAGVILLWSEGSYPVAGVIFLASIMVPTLKMIAIAWLCWDAKGHGKRDSERMHLIYEVVEFVGRWSMIDVFVIAVLSALVRMGGLMSIYPAMGALMFALVVIMTMFAAMTFDPRLSWDREPDSSHEEE

SEQ ID NO: 6431 - protein, 76 aa, Enterobacter cloacae
PSTLVYRGIVSPIQAMRKSKSMENKSGEAKVQKVRNWSPVWIFPHRDRADRCMDPVLSLQPSGTGSHANYHQCRGD

SEQ ID NO: 6432 - protein, 192 aa, Enterobacter cloacae
EGETMKKWLIIAGALVLTACSFGSDNKSYYQLPLSAQSGAQSSTSQGSRLLWVEQVAVPDYLAGNGVVYQTSDVQYVIANNNLWASPLDQQLRNTLVANLSSQLPGWVVASQPLGSDQDTLNVNVTGFHGRYDGAVVISGEWLLNHQGQLIKRPFHLELKQQKDGYDEMVKVLAQGWAQESAAIAREISRLP

SEQ ID NO: 6433 - protein, 674 aa, Enterobacter cloacae
RVVQGGVHFEGDTRLIYQSLMWSRLASRIMLPMKECKVYSDLDLYTGVQMIDWTEIFTPDATFAVHFNGVNDEIRNSQYGALRVKDAIVDCFTRRNKERPNVDRENPDLRINVWLNGDTASISLDLSGAGLHLRGYRDRTGMAPIKETLAAAIVMRSGWQPGTPLLDPMCGSGTLLIEAAMLATDRAPGLHRGHWGFKGWAQHDEAIWKEVKDDAQTRARKGLAEYTSHFYGSDSDARVIERARSNARRAGIGELVTFEVKDVANLTNPLPKGPYGTVISNPPYGERLDSEPALIALHSLLGRNMKAHFGGWNLSLFSASPELLSCLQLRADRQFKAKNGPLDCVQKNYHLAEIAADSKPSGVAEDYANRLRKNLKKFEKWAKQEGIECYRLYDADLPEYNVAVDRYADWVVVQEYAPPKTIDAQKARQRMLDVIAATFAVLGISPNKLVLKTRERQKGKNQYQKMGEKGDFIEVGEYNARLWVNLTDYLDTGLFLDHRIARRMLGQMSKGKDFLNLFSYTGSASVHAGLGGARSTTTVDMSRTYLEWAERNLRLNGLTGRQHRLLQADVLGWLRDTDEQFDLIFIDPPTFSNSKRMEDSFDVQRDHLRLMTDLKRLLRKGGTIMFSNNKRGFRMDHDGLAELGLKAQEISQKTLSQDFARNRQIHNCWLISAV

SEQ ID NO: 6434 - protein, 635 aa, Enterobacter cloacae
MSLISMHGAWLSFSDSPLLDNAELHIEDNERVCLVGRNGAGKSTLMKILNREQGLDDGRIVYEQDLIVSRLQQDPPRNVTGSVYDFVAEGISEQAEYLKRYHEISHLVMTDPSDKNLNELAKVQEMLDHHGLWQLENRINEVLAQLGLEADMELSALSGGWLRKAALGRALVSGPKVLLLDEPTNHLDIEAIDWLEGFLKTFNGTIIFISHDRSFIRNMATRIVDLDRGKLVTYPGDYDTYLLEKEENLRVEELQNAEFDRKLAQEEVWIRQGIKARRTRNEGRVRALKAMRRERSERREVMGSAKMQVEEASRSGKIVFEMENVNYSVDGKVLVNDFSAQVQRGDKIALIGPNGCGKTTLLKLMLGQLQADSGRIHCGTKLEVAYFDQHRAELDPDRTVMDNLAEGKQEVMVNGKPRHVLGYLQDFLFHPKRAMTPVRALSGGERNRLLLARLFLKPSNLLILDEPTNDLDVETLELLEELIDGYQGTVMLVSHDRQFVDNTVTECWIFEGEGRIGQYVGGYHDARGQQSQSLAQKQAKTKNVAEPVVAKAETVKKSPAKMSYNLQRELEGLPQRLEELEAALEALQIQVADASFFTQPHDYTQKVLAELSQAEQALEEAFERWEYLESLKNGA

SEQ ID NO: 6435 - protein, 551 aa, Enterobacter cloacae
GRVRAWKIRVERLKCRRSETGRRCGFSPIVTALIGAWILFYHYSHQGPEVTLITTNAEGIEGGKTTIKSRSVDVGVVESATLTDDLTHVEIKARLNAGMEKLLHEDSVFWVVKPQVGREGISGLGTLLSGAYIELQPGNKGAQPANYQLLDSPPLAPPDAKGIRVILDSKKAGQLSPGDPVLFRGYRVGSVETSTFDPQKRTISYQLFINAPNDRLVTSNVRFWKDSGIAVDLTSAGMRVEMGSLTTLFGGGVSFDVPEGIDLGQPVAEKTAFRLFDDQKSIQDALYTDHIDYLMFFKDSVRGLQPGAPVEFRGIRLGTVGQVPYFVPGLKQMLDDDYRIPVLIRIEPERLINQIGEDQDIGEHISDLLNRGLRGSLKTGNLVTGALYVDMDFYPKAPPMTGVREFGGYKIIPTVSSGLAQIQQRLMETLDKINNLPLNPMLEAATGSLHQSQATMLRLQTTLDNINKITANQSMQQLPQDMQKTLRELNRSMQGFQPGSAAYNKMVADMQRLDQVLRELQPVLKTLNEKSNALVFEAKDKKDPEPKRAKQ

SEQ ID NO: 6436 - protein, 132 aa, Enterobacter cloacae
VFYFSNTTRCFYCDENNISRPEDAIEVSEQDVHKYSGQNPQWMLPNVSEGGKMEWIDDISIDKRTARYEINKQEKERLLNRTIKERYTLEVIGQTSVLSVEQSTMMQSLSAYINELNQVDLYADNPVWPIHP

SEQ ID NO: 6437 - protein, 357 aa, Enterobacter cloacae
EVNMTTDFLHGVRTIEYDDGTEEISTVTVSVIGIVGTAPDSTAATCASLVTGSELTNNKITWQAEDAGIKGNSFSVEIVPGDVYPANTKWGGDVNYSTIYHYSIKPDGSLKLSVRMPVDSDGKKLMNAELITSIWDMVPPLDNYCRIKAIIYSTSNDNGKVMYMSETNLAGGADEAFPLNVPTVIAGSTTKAAKLGATGTLPADINDIFNQTRALIVVVRVADDADASKLQQNVIAGLNTLPSSGQLNEVMPRIIIAPDFSATDPVAVQIEVIANKVRGVGYIDSPSFATAKDVALRRQSYGKRVEILRPRVFTTSSAGSTSRAYSASAAGLRCPIDNKKGFWWSKSNQQIMGRDST

SEQ ID NO: 6438 - protein, 193 aa, Enterobacter cloacae
TRHRSLLLKMWPCAGRVTESASKSYARACLLPVQRVARHAHIQRARRAYVVQLITRKAFGGVSPINKSWGVTALEQVDEYIIGDDTCVVNLLNKNQVSTIVRRSGFKHWGNYLCSTDPPWAFECVRRTADVIEDSIADTVENEFIDRPIDLHLGDDIIESINGFIRYLFDIGAINGGKAWLDPELNTKESLAG

SEQ ID NO: 6439 - protein, 174 aa, Enterobacter cloacae
KGIKMAEANVYRAHALWVQGRLVCGCESYTPVDMKIIEDEFKTGSMDMAMTLDGGMERMGASFKVKGSDVDVMSMFGFIPGVRTRFEIRSAFVTNSGETIIRKDFYEGPITGITDDEEGTDSKSGVGQTVTIAPNYFKRIQGDKEIYEIHPAKMIRRVNGVNVLGEIASGLKIY

SEQ ID NO: 6440 - protein, 512 aa, Enterobacter cloacae
GSYVKKMAISQNFRSTVTFGGRVDPSFRRGSDELKGAIKEAGQSVSQLTKRQEKLKQQMASLKLAGKDVSALIKQYEKLSRQIVNATEDQEKLNQQLKRQERLDKWKGRAAAVPKWAGKAAWGAAKGLAFSSLAPAAMFAGAIQMNSETSEKLGLAKSYGVGIDKYGAWENIAKKAGLNGENVGDLAEELTNKIGEKDNEKTFNPMLAQINLSKRRMAGWSREKQFDEVMSRISRMKDEKQAASLADQLMGGEANKIMTYMRMTGKTWEQTMAKAKKSNLLTQEGAEGAARAHFAVTNLWGAITSGLSDTLGKIGGELEPDINRFKESTISWFKENQGAFVEGIRNWIKPDESGRTGPQRLFDTVKKFGEGLLELGKIVWAVAKKLAWILPDDEKNQAKIDEFVKNGNSYEGAKSLADEYGLEDWFKENYTPEKVAAAQQKAAGEGETPAALAKRQASQPVGYGNYSPRVEINVQALPGQSAEEVGQSTYAAFKAGLPTAPGGSGAMYDIPG

SEQ ID NO: 6441 - protein, 72 aa, Enterobacter cloacae
FMAITYTTRDGDRLDTICLKIYGKTGKTTEEVLYQVANYGVVDMCAVFPAGKEIVLPEISSEPIVEATQLWE

SEQ ID NO: 6442 - protein, 102 aa, Enterobacter cloacae
RSVRAAFQYDYSWNKSMARISGIYANGFGEPVAGVCILLTARATSSGVVMATTANQVTGEDGSYGFDLRPGVYVVTANGLYLGVITVSDDSQDGTLNDYLVI

SEQ ID NO: 6443 - protein, 301 aa, Enterobacter cloacae
KLVMVIVCHNTRQTRRRFIMIAITGATGQLGQHVIEELLKTVPASQIVAIVRNLAKAEALRQQGVVVRQADYTDEAAFTTALNGVDKLLLISSSEVGQRAVQHQNVINAAKAAGVKFIAYTSLLHADKSPLGLHVEHVETENALAASGVPYALLRNGWYTENYLASAPPALEHGVFMGAAGEGKIASATRADYAAAAAKVISEEGHAGKVYELAGDNAWTLSELAAELSKQSGKPVTYQNLSEADFAAALKGVGLPAGLAEMLADSDTGASKGGLFDDSHTLSKLIGRPTTPLAESVKAIL

SEQ ID NO: 6444 - protein, 280 aa, Enterobacter cloacae
PTRRLTVQGVPEQFTDERDSARFRHLAQLPGLELYHAHISDYAFEPHTHEAFGIGTIETGAERFRYRGTQHLAAEKSVVTMNPDEIHTGESATEGGWRYRMVYIEPDLLEEVTGLRHWWFSDVTRHDPLRSQQIGQLIYGLWHTDDPLAQKGLLLDLIQTFQPLAHHAPVVQEATHRFERVRDYLHDNYMRSLTLDELANVVSLSPYHFQRQFKAHFHVTPHQMLMAIRLWRAKAFLTHGMPAAEVAAATGLTDQSHLTRAFTRRYGITPVRYQKQVMPR

SEQ ID NO: 6445 - protein, 327 aa, Enterobacter cloacae
IKMDGKMISGVLYALLAGLMWGLIFVGPLIVPEYPAILQSTGRYLALGLIAVPLAWLGRTRLRQLGRQDWLTALALTMMGNLIYYVCLASAIQRTGAPVSTMIIGTLPVVIPVFANLLYSQRDGKLAWSKMAPALVCIAVGLVCVNIAELRHGLENFSVWRYGSGIFLAFISVVCWAWYALRNARWLRENPDKHPMMWATAQALVTLPVSLLGYVGACVWLGSQQPAFTLPFGPRPWVFVGLMVAIAVLCSWVGALCWNIASQKLPTVILGPLIVFETLAGLLYTFLMRQSVPPLLTACGIALLVVGVVIAVRAKPEKPMVVPASEG

SEQ ID NO: 6446 - protein, 232 aa, Enterobacter cloacae
NASYISDDEVTAMAFRDQPLGELALSIPRASALFRKYDMDYCCGGKQTLARAASRKELDVEAIEAELAQLAEQPVDKDWRTAPLAEIIDHIIVRYHDRHREQLPELILQATKVERVHADKPSVPRGLAKYLTMLHEELSSHMMKEEQILFPMIKQGMGSQAMGPISVMESEHDDAGELLEVIKHTTDNVTPPPEACTTWKAMYNGINEMIDDLMEHISLENNVLFPRALAGE

SEQ ID NO: 6447 - protein, 138 aa, Enterobacter cloacae
LLVSTYKKVSMKTTIPTLSEQMRDGNLFAEQCPSREVLKHVTSRWGVLILVALRQGTHRFSDLRRKMGGVSEKMLAQSLQALEHDGFVDRVSYPVVPPHVEYSLTPLGREVSEKVAALADWIEVNTPQVMANRDERAA

SEQ ID NO: 6448 - protein, 553 aa, Enterobacter cloacae
KRQRMFKRIKVITLLISVLLVLGIMQLISAGIFINALNNDKENFTVSQLSSQNVAEFTDAWISLNQARVTLNRGMLRLQSSMASQINGGQLNELVNTAKNLLADAQTHYDKYYALPETPGMDEHLADRLEEQYRVYSATLTQMNVLLGQGNLEDMFKQNAEQKQTAMQKVYREWREAQAALTAKGIQDNESDYKRILWILSAVMLLVIAVIISSWIAMRRVLLLPLEEVINHIRAIAAGDLTQPIQAEGKNEMAILARNVQEMQTALANTVGVVREGADTIYTGAGEISAGSNDLSSRTEQQAASLEETAASMEQLTATVKQNADNARQASRLALDASSTAKKGGNVVEGVVRTMDEIATSSSKIAQITNVIDGIAFQTNILALNAAVEAARAGEQGRGFAVVAGEVRTLAQRSAQAAKEIKALIDDSGERVNAGSQLVNEAGATMAEIVNAVTRVTDIMGEIASASDEQSRGIDQVGQAVAEMDRVTQQNASLVEESAAAAAALEDQAARLNDAVAVFKITRNQAVKAAPVKTYAPKAQPVAAASEANWETF

SEQ ID NO: 6449 - protein, 239 aa, Enterobacter cloacae
DDEHMDGWQRAFVLHSRPWSETSLMLDVFTEESGRVRLVAKGARSRRSNLKGALQPFTPLLVRFGGRGEVKTLRSAEAVSLALPLSGITLYSGLYVNELISRVLEHETRFSELFFDYLHCIQSLAGATGTPEPVLRRFELALLGHLGYGVDFLHCAGSGDEVEDTMTYRYREEKGFIASVVVDNSTFTGRQLRALYEREFPDADTLRAAKRFTRIALKPYLGGKPLKSRELFRQFMPKR

SEQ ID NO: 6450 - protein, 250 aa, Enterobacter cloacae
TKIPRIVMAELLLGVNIDHIATLRNARGTAYPDPVQAAFIAEQAGADGITVHLREDRRHITDRDVRILRQTLDNRMNLEMAVTEEMLTIACDTKPHFCCLVPEKRQEVTTEGGLDVAGQLDKMRDACKRLADAGILVSLFIDADFTQIKAAADVGAPYIEIHTGCYADAENDAAQAKELERIAKAATYAASLGLKVNAGHGLTYHNVKAIAALPEMHELNIGHAIIGRAVMSGLKDAVSEMKRLMLEARQ

SEQ ID NO: 6451 - protein, 144 aa, Enterobacter cloacae
RRLNVDTIAGIVRKHLPEATHHFPEDYITDRSQRFMASEIIREKLMRFLGAELPYSVTVEIERFQSNERGGYDINGLILVEREGQKKMVIGNKGAKIKTIGIEARKDMQDMFEAPVHLELWVKVKSGWADDERALRSLGYGEDQ

SEQ ID NO: 6452 - protein, 311 aa, Enterobacter cloacae
CVYYELKIPEVNNMNLGSLVSETRNPQTMDLDALSTLELVNRFNQQDTLVALAVKETLPEVAKAVDAAADALKAGGRIIYMGAGTSGRLGVLDASECPPTFGVPHGLVVGLIAGGPGALLKAVEGAEDNKQLGEDDLRALNLTAQDLVVGLAASGRTPYVIGGLEYARQTGCTTVAISCNPGSPIAQVAAIAISPVVGPEALTGSTRLKSGTAQKLVLNMISTGAMVKFGKVYQNLMVDMQATNVKLVDRACRMVMEATGASREEAEKVLQQTDHDVKPAILMILTGLDAAAARARLEAHHGFLRAALEHQ

SEQ ID NO: 6453 - protein, 457 aa, Enterobacter cloacae
EAFMDKTAALASDILLGIGGEKNIQRLENCMTRVRVEVYNDEKLDLTRLKQLPGVSGYVKQGQQHQLIVGPGKAAQVVDAMRALMTGGETAPAFDDAERTKAQAKAKYKAPMSDALRQLANVFIPLIPAFIASGLITGIINILKRPDIVGNFATQYPNLLGILAIFGSAVFAIMNILVGVNTAKVFGGSLAMGGVMAGILSSPQLAQITLFGEALQPGRGGVIAVLLVVILMCWIEKKLRELLPGSIELILNPLLTTLITGSVAIVALQPLGGAISEAIAHGASLAIDRGGLLVGAVLSGTFLPLVLTGLHQGLVPIHVELVQAHGYNALLPILSMAGVGQVGAAIAVLMKTRNARLKKVIKGALPVGLLGIGEPLIFGVTLPLGKPFLAACLGGAVGGALISYWKVATVITFGISGLPLALTIVTGKVMLYLLGYLVAVIAGFLFTWLLGFNDPEE

SEQ ID NO: 6454 - protein, 212 aa, Enterobacter cloacae
GLASHERRVVFFDLDGTLHQQDMFGTFMRYLLRRQPLNALLVLPLLPVIGIALLVKGRAARWPMSLLLWGCTFGHSEARLKQLEQDFAHWFRGHVAAFPVVQARLTSYLDANDADIWLITGSPQTLVEQVYFDTPWLPRVNLIATQIARGYGGWVLTLRCLGHEKVVQLEKRIGTPLRLYSGYSDSKQDNPLLYFCQHRWRVTPLGELQQLE

SEQ ID NO: 6455 - protein, 187 aa, Enterobacter cloacae
SYLYRLCIMPPAFRLEYQPLSNPEHNHEYWMRHALALAQRAWEEGEVPVGAVLVHNNQVIGEGWNRPIGRHDPTAHAEIMALRQGGLVLQNYRLLDTTLYVTLEPCVMCSGAMVHSRIGTLVFGARDEKTGAAGSLMDVLGHPGMNHQVKTIGGVLAPECSGLLSDFFRMRRQQKKQQKAELKPQGD

SEQ ID NO: 6456 - protein, 180 aa, Enterobacter cloacae
RRSRPDLSQRKSHRCPAGNARAEHRPRYHWPCGDERSERRGFRDEASDAGSASVMAILGLGTDIVETARIEAVIARSGDRLARRVLSDNEWAIWEAHQQPVRFLAKRFAVKEAAAKAFGTGIRNGLAFNQFEVFNDELGKPRLRLWGEALKLAEKLGVAHMHVTLADERHYACATVIIEG

SEQ ID NO: 6457 - protein, 95 aa, Enterobacter cloacae
CRPVSTNGRKVPDSTAPTSSPPRSIARDAPWAMASEIAPPNGCSATIATLPVINVVSSGLRISSIEPGSNSRSFFSIQHIRMTTSSTAITPPRPG

SEQ ID NO: 6458 - protein, 296 aa, Enterobacter cloacae
FVFARVITFSPGDRMNCLIRIRQRYAGFAQSDKKLADYLLSQPDRARHLSSQQLAGEAGVSQSSVVKFAQKIGYKGFPALKLAISEALVSNPNPQSMPVHNQIRGDDPMRLVGEKLIKENVAAMHATLDVNTEEKLLESVAMLRDARRIVLTGIGASGLVARNFGWKLTKIGYNAIVEQDMHALLATVQAMDPDDLLLAISYSGERREINMATDEALRVGGKILAITGFSPNALQQRATRCLYTIAEEQATRSAAISSTSAQMMLTDLLFMALVQQDLERAPERIRHSEELVKKLV

SEQ ID NO: 6459 - protein, 272 aa, Enterobacter cloacae
ATVREKIESLKKDPVRLEEKYLGHGDDFDYVDTRTFLRAVDSVLPDLQPLFEKYAQEIDWKLLAAISYQESHWDAQATSPTGVRGLMMLTKNTAQSLGISDRTDAEQSISGGAQYLQDMMAKVPETVPEGERIWFALAAYNMGYAHMLDARALTAKTKGNPDSWSDVKQRLPLLSQKQWYQKLTYGYARGHEAYAYVENIRKYQISLVGYLLEKEKEAAEAQQLAESYPVVAPEELNHPAVSILPFVAFSAADAFEKSHLTDPNILVQVPRR

SEQ ID NO: 6460 - protein, 101 aa, Enterobacter cloacae
AYNARPVCDVSENFLMALLITKKCINCDMCEPECPNEAISMGDSIYEINSDRCTECIGHYETPTCQKVCPIPNTILKDPAHVENEEQLWDKFVLMHHADKI

SEQ ID NO: 6461 - protein, 515 aa, Enterobacter cloacae
QNADFFGTNLANFLPDGAFCSDCSPQSFTIETSTFNRMRLLVSDSAARPTFLFHDYETFGTHPALDRPAQFAAIRTDDEFNVIGEPEVFYCKPADDYLPQPGAVMVTGITPQEARDKGVSEAEFARRIHDLFTVPNTCVVGYNNIRFDDEVTRNIFYRNFYDPYAWSWQNRNSRWDLLDIMRACYALRPEGINWRENDDGLPSFRLEHLTRANGIEHSNAHDAMADVYATIAMAKLVKTAQPRLFEYLLSHRSKQKLMTLIDVPQMKPLVHISGMFGAWRGNTSWVAPLAWHPDNRNAVIMVDLAGDISPLLELDSDTLRERLYTPKEALGDLPAVPVKLVHINKCPVLAQANTLRPEDADRLGINRQHCLDNLKVLRDNPQVREKVVAIFAEAEPFVPSENVDAQLYNGFFSDADRAAMNIVLQTDPRNLPALDITFADKRIEKLMFNYRARNYPGTLDEAEQERWLQHRRSVFTPEFLNSYAQELEMLYGQYEGNAEKQALLKALFQYAQEIV

SEQ ID NO: 6462 - protein, 388 aa, Enterobacter cloacae
STKWDNPAKRRVFQPGAIHPAENTVQLWFAVELETGVRPDKSLTPFEIRLYKHYRVVHGCRIALAFVLTFVLVRLLDIPEGTWPLITLVVVMGPISFWGNVVPRAFERIGGTVLGSALGLIALKLELISFPFMLLWCAVAMFLCGWLTLGKKPYQALLIGITLAVVVGAPAGDMTTALWRSGDVILGSLLAMLFTGIWPQRAFLHWRIQMANYVTAFNRVYQAGFSPNLIERPRLEKHLQKILNDVVKMRGLITPASKETHIQKAIFEAIQTVSRNLVCMLELQINAHWASRPSHLLMLNAHTLKETQQMTQQTLLTIAHALYEGNPQPIRANSERLNEIVAELKQLMNERQGDNVAETPIHGYVWLSMELARQLELLSQLICRALRK

SEQ ID NO: 6463 - protein, 127 aa, Enterobacter cloacae
NGCFNESESHIIRGVKMETTKPSFQDVLEFVRLFRRKNKLQREIQDVEKKIRDNQKRVLLLDNLSDYIKPGMSVEAIQGIIASMKSDYEDRVDDYIIKNAELSKERRDISKKLKVMGEIKNVDAKGE

SEQ ID NO: 6464 - protein, 309 aa, Enterobacter cloacae
NRLLDVLIIPGGAGKRRGACPPHRAKLYKTRSVMSYTVQKLESDVNIQIVDRTGHRARFTRTGQMLLEKGRDVLHTVRELDKQAVKFHQVWENELVIGVDDTFPLSVLTPLIEAFYQRHSVTRLVFINGVLGGFWEALTQGRADIIVGAVHEPPQLSEFGFARLGVLEQVFAVAPHHPLANEPEPVTRRVIKNYRAIVVGDSSRPECGISSQMLDEQEAITVFDFKTKLELQISGLGCGYLPRYLAQRFIDSGALVEKQVLAQSSNESVWVGWNEQTAGLASAWWRDEILANSAIATVYTQADDGKSTS

SEQ ID NO: 6465 - protein, 393 aa, Enterobacter cloacae
PEDIPLKRRLFIAVSLLASSISSALAAEPLDFSPQPPAIQAGSWVLMDYTTGQILTAGNEHQQRNPASLTKLMTGYVVDRAIDSHRISPDDIVTVGRDAWAKGNSVFDGSSLMFLKEGDRVSVRDLSRGLIVDSGNDACVALADHVAGGQPQFVRMMNDYVEKLNLRDTHFETVHGLDAPGQHSSAYDLAVLSRAIIHGEPEFYHMYSEKSLTWNGITQQNRNGLLWDKTMNVDGLKTGHTSGAGFNLIASAVDGQRRLIAVVMGADTPKGREDQARKLLHWGQQNFDTVQILHNGKKVGTERIWYGDKEQIALGTDQDFWLALPKSEVPNIKAKYVMDKKELEAPIAAHQRVGEIQLYDRDKVVAHWPLVTLESVEKGGLFSRLGDYLHHKL

SEQ ID NO: 6466 - protein, 456 aa, Enterobacter cloacae
RRITMSHNATPNTSRVELRKTLTLIPVVMMGLAYMQPMTLFDTFGIVSGLTDGHVPTAYGFALIAILFTALSYGKLVRRYPSAGSAYTYAQKSISPTVGFMVGWSSLLDYLFAPMINILLAKIYFEALVPSIPSWMFVVALVAFMTAFNLRSIKSVANFNSVIVVLQVVLIAVILGMVIYGVFHGEGAGTLASSKPFWSGDAHVIPMITGATILCFSFTGFDGISNLSEETKDAERVIPRAIFLTALIGGLIFIFSTYFLQLYFPDISRFKDPDASQPEIMLYVAGKAFQVGALIFSTITVLASGMAAHAGVARLMYVMGRDGVFPKSFFGYVHPTWRTPAMNIILVGAIALLAINFDLVMATALINFGALVAFTFVNLSVISQFWIREKRNKTLKDHFQYLFLPMCGAMTVGALWVNLEESSMVLGLIWAGIGLVYLACVTKSFRNPVPQYEDVA

SEQ ID NO: 6467 - protein, 174 aa, Enterobacter cloacae
SRFCFTVYIYTVINGGSMDYSIRQQQKRTIAGFHLVGPWEKTVKQGFEQLVMWVDGRHIQPQEWVAVYYDNPDDVPAEKLRCVTAVTVVDVFTIPENSEGVMMTEIAAGEYAIAAARVENHDFATPWYQFFNSLLEDSKFQIAAKPCFERYLNDGNADGYWDIEMFVPVEHKVG

SEQ ID NO: 6468 - protein, 64 aa, Enterobacter cloacae
SKNHLMMKLNSGMSCDFCQSSLLENPVKVSRKNRIAATMSTPRNAPKQMPSTLSVPDRPVFSTS

SEQ ID NO: 6469 - protein, 272 aa, Enterobacter cloacae
AKRFAWRAEANLRPERCGDELQRQLIEIIPSPWPSPQRGEGSVYSLSLEGEGRGEGEADVHRNVNGAVALSIFSAPFLFTRGKEIPTQTFSFSVRIRPELDDRAFNRGTHMVWIDYAIIAVIGFSCLVSLIRGFVREALSLVTWGCAFFVASHYYTYLSVWFTGFEDELVRNGIAIAVLFIATLIVGAIVNYVIGQLVEKTGLSGTDRVLGICFGALRGVLIVAAILFFLDTFTGFSKSEDWQKSQLIPEFSFIIRWFFDYLQSSSSFLPRA

SEQ ID NO: 6470 - protein, 516 aa, Enterobacter cloacae
TLRCGLTRKRRMCGIVGIAGFMPVNQSIYDALTVLQHRGQDAAGIITIDANNCFRLRKANGLVNDVFEARHMQRLQGNMGIGHVRYPTAGSSSASEAQPFYVNSPYGITLAHNGNLTNAHELRKKLFEEKRRHINTTSDSEILLNIFASELDNFRHYPLEADNIFAAVAATNRQIRGAYACVAMIIGHGMVAFRDPNGIRPLVLGKRDLGDGRSEYMVASESVALDTLGFEFLRDVAPGEAVYITEKGQLFTRQCADNPVSNPCLFEYVYFARPDSFIDKISVYSARVNMGTKLGEKIAREWDDLDIDVVIPIPETSCDIALEIARILDKPYRQGFVKNRYVGRTFIMPGQQLRRKSVRRKLNANRAEFRDKNVLLVDDSIVRGTTSEQIIEMAREAGAKKVYLASAAPEIRFPNVYGIDMPTANELIAHGREVDEIRQIIGADGLIFQDLNDLIDAVRAENPDIQQFECSVFNGIYVTKDVDQQYLDYLDSLRNDDAKAVQLQNDLESLEMHNEG

SEQ ID NO: 6471 - protein, 252 aa, Enterobacter cloacae
RAAPPVPGGEKTRFHHSRDDRARGMLYGFSGVILQGALVTLELAISSVVLAVLIGLAGAGAKLSANRPLALIFEGYTTLIRGVPDLVLMLLIFYGLQIALNGVTDAIGMEQIDIDPMVAGIITLGFIYGAYFTETFRGAYMAVPKGHIEAATAYGFTSSQTFRRIMFPAMMRYALPGIGNNWQVILKATALVSLLGLEDVVKATQLAGKSTWEPFYFAVVCGLIYLVFTTVSNGVLLLLERRYSVGVKRADL

SEQ ID NO: 6472 - protein, 154 aa, Enterobacter cloacae
SRPGKTAARSLDPSGLGTNNNIEIDPVPEEQHKPVEKPKPVEKPQPKPQRDKAAEQLAAASETPPQAKQDAAPTGKAYVVQLGALKNADKVNEIVSKLRGAGYRVYTSPTTPVQGKITRILVGPDASKDKLKGSLGELKQISGLSGVVMNYSAN

SEQ ID NO: 6473 - protein, 328 aa, Enterobacter cloacae
FAFSFFLFPVRSADLLSFTIKAVSQRFINIFNVVVLSRRQCGIRPARAACNTTHNINHNKITVLEGKCMKKTVLALSLLVGLSAAASSYAALPQTVRIGTDATYAPFSSKDAKGDFVGFDIDLGNEMCKRLEVKCTWVGSDFDALIPSLKAKKIDAIISSLSITEKRQQEIAFSEKLYAADSRLIAAKGSPIQPTIDSLKGKHVGVLQGSTQEGFANANWREKGVDVVAYQNQDLIYSDLAAGRLDAAFQDEVAASEGFLKQPAGKEYAFAGPSVKDKKYFGDGTGIGLRKDDTELKAAFDKAFNELRKDGTYDKLAKKYFNFNVYGD

SEQ ID NO: 6474 - protein, 71 aa, Enterobacter cloacae
TGPKRNRHRGAVYRDVDCRRYRQLRDRSAGRENRSVRNGQGARHLFRRVARRAHCGRDPVLPGYLYRVLQK

SEQ ID NO: 6475 - protein, 203 aa, Enterobacter cloacae
NPAQSALKSARAKIMKRLIVGISGASGAIYGVRLLQVLRDVAGVETHLVMSQAARQTLSLETDLSLRDVQALSDVVHDARDIAASISSGSFKTAGMVILPCSIKTLSGIVNSYTDTLVTRAADVVLKERRPLVLCVRETPLHLGHLRLMTQAAELGAVIMPPVPAFYHRPQTLDDVINQTVNRVLDQFDIDLPEDLFTRWQGA

SEQ ID NO: 6476 - protein, 267 aa, Enterobacter cloacae
DSLLRTDMKKLVLSLSLVLAFSSATAAFAAIPQKIRIGTDPTYAPFESKNAKGELVGFDIDLANELCKRIKVQCTYVENPLDALIPSLKAKKIDVIMSSLSITEKRQQEIAFTDKLYAADSRLVVAKSSDIQPTLESLKGKRVGVLQGTTQETYGNEHWAPKGIEIVSYQGQENIYADLTAGRIDAAFQDEVAASEGFLKQPVGKDYKFGGPSIKDEKLFGVGTGMGLRKEDNELREALNKAFAEMRADGTYDKLAKKYFDFNVYGG

SEQ ID NO: 6477 - protein, 238 aa, Enterobacter cloacae
PVIEIIQEYWKSLLWTDGYRFTGVAITLWLLISSVVMGGILAVFLAIGRVSNNKFIQFPIWLFTYVFRGTPLYVQLLVFYSGMYTLEIVKGTEMLNAFFRSGLNCTVLALTLNTCAYTTEIFAGAIRSVPHGEIEAARAYGFSSVKLYRCIILPSALRIALPAYSNEVILMLHSTALAFTATVPDLLKIARDINSATYQPFTAFGIAAVLYLIISYVLISLFRKAEKRWLQHIKPSTH

SEQ ID NO: 6478 - protein, 308 aa, Enterobacter cloacae
LYLSAAPASLRGEDLQKRLRRNVGEAIADFNMIEEGDRIMVCLSGGKDSYTMLEILRNLQQSAPVNFSLVAVNLDQKQPGFPEHILPEYLDNLGVEYKIVEENTYGIVKEKIPEGKTTCSLCSRLRRGILYRTATELGATKIALGHHRDDILQTLFLNMFYGGKMKGMPPKLMSDDGKHIVIRPLAYCREKDIERFSQAKAFPIIPCNLCGSQPNLQRQVIGDMLRDWDKRYPGRIETMFSAMQNVVPSHLADVELFDFKGINHGSEVVNGGDLAFDREEIPMQPAGWQPEEEDAQFDELRLNVVEVK

SEQ ID NO: 6479 - protein, 387 aa, Enterobacter cloacae
CQPKYNAPGKRMLRNISVRTFIVYFLLCVFLVSDGVIALFSRNSSLFIAVIIVQFIALFLLWAYMTKYLVTPINTVKKSIEEVTSGKLGVSIPEFGNNCAGRLIPGINSLSSNIATLVREIRASSQTAMTLSDQLSSRSAQLSVKTEQQSASLVQTAASMEEMAASTKNNADNTRLASEQANLATLQARKGGELMGQVANNMQSITDCAQQMTEIISLIDGIAFQTNILALNAAVEAARAGDHGKGFSVVAGEVRSLAHRSAEAAKNIKSLIEVTSHNVTQGVNVVSEAEKNMHDIVTGSGNVSRLMDEISASTSEQEKGISQITQALSELERVTQSNVSMVEELNGSSDVLRNQVIELQTRTRNFRLENELQADNALRSREWAVNS

SEQ ID NO: 6480 - protein, 332 aa, Enterobacter cloacae
NGGGAVESIKGSEVNVPDAVFAWVFDGRGGARPLEDQDHIDNEHPCWLHLNYTHPDSAEWLASTPLLPNNVRDALAGESLRPRVSRMGEGTLITLRCINGSTDERPDQLVAMRVYMDERLIVSTRQRKVLALDDVINDLKEGTGPTDCGSWLVDVCDALTDHASEFIEELHDKIIDLEDNLLDQQIPPRGFLALLRKQLIVMRRYMTPQRDVYARLASERMSWMNDDQRRRMQDIADRLGRGLDEIDSCIARTAVMADEIAQVMQESLARRTYTMSLMAMVFLPSTFLTGLFGVNLGGIPGGEYHYGFTTFCVMLVVLIGGVAWWLHRSKWL

SEQ ID NO: 6481 - protein, 466 aa, Enterobacter cloacae
LQSLLREYIVTAFSTLNVLPEAQLANLNELGYLTMTPVQAAALPAILEGRDVRVQAKTGSGKTAAFGLGLLQHIDATLFQTQSLILCPTRELADQVAGELRRLARFLPNTKILTLCGGQPFGAQRDSLQHAPHIIVATPGRLLDHLQKGTVSLDALQTLVMDEADRMLDMGFSDAIDEVIRFAPATRQTLLFSATWPEAIAAISGRVQKNPLTIEIDTVDALPAIEQQFFETSQQGKIPLLQKLLSQHQPASCVVFCNTKKDCQAVCDALNDAGQSALSLHGDLEQRDRDQTLVRFANGSARVLVATDVAARGLDIKSLELVVNFELAWDPEVHVHRIGRTARAGNSGLAISFCAPEEAQRANILSEMLQLKLNWVNTPDNISIAPLAAEMATLCIDGGKKAKMRPGDVLGALTGDMGLDGADIGKITVHPAHVYVAVRQSVAHKAWKQLQGGKIKGKTCRVRLLK

SEQ ID NO: 6482 - protein, 173 aa, Enterobacter cloacae; identical to SEQ ID NO: 6316

SEQ ID NO: 6483 - protein, 218 aa, Enterobacter cloacae
TGAVSMFTGIVQGTAKVVSIDEKPNFRTHVVELPEYMLDGIETGASIAHNGCCLTVTEINGNQISFDLMKETLRITNLGELVVGDIINVERAAKFSDEIGGHLMSGHIMTTAEVAKIVTSENNRQIWFKVQDPSLMKYILYKGFIGIDGISLTVGEVTPTRFCVHLIPETLQRTTLGAKKLGQRVNIEIDPQTQAVVDTVERVLAAKEAAIIKTVEEE

SEQ ID NO: 6484 - protein, 443 aa, Enterobacter cloacae
IKRSASSQAASRTHSMPRQPAAKIASPNNRTGLRPKRSESGPHSNCAKAKPARNKLKLALMAAAGVCKSSCIAANAGRYISVAKKPSTLKPPSQTKNPFLGCTFFLLRRQVYVGAECRECKAACETLIFGGCIQKICRLKMWSDYSLEVVDAVARNGSFTGAAQELHRVPSAISYTVRQLEAWLAVPLFERRHRDVELTPAGAWFLKEGRSVIKKMQITREQCQQIANGWRGHLAIAVDNIVKPERTRQMIVDFYRHFSDVELRVSQEVFNGVWDALADGRAEMAIGATQAIPVGGRYAFRDMGMLSWTCVVARDHPLAALEGPLSDDTLRNWPSLVLEDTSRSLPKRITWLLDNQRRVVAPDWESSATCLSAGLCVGMVPVHFARPRIDAGEWVALTLENPFPDAACCLTWQQNDVSPAMAWLLDYLGDSETLNREWLREPA

SEQ ID NO: 6485 - protein, 279 aa, Enterobacter cloacae
FCAGLWHGIRSLFMKINFPLLALAIGAFGIGTTEFSPMGLLPVIARGVDVSIPAAGMLISAYAIGVMVGAPLMTLLLSHRARRNALIFLMAIFTLGNVFSAISPDYTTLMLSRILTSLNHGAFFGLGSVVAASVVPKHKQASAVATMFMGLTIANIGGVPAATWLGEAIGWRMSFLATAGLGVVAMVALFFSLPKGSAGERPEVRKELAVLMRPQVLSALLTTVLGAGAMFTLYTYISPVLHDITHATPLFVTAMLVLIGVGFSTGPISVFTTRTGPRT

SEQ ID NO: 6486 - protein, 108 aa, Enterobacter cloacae
GRISTASSLRTSGRSPALPFGSEKNSATIATTPSPAVARKDIRQPMASPSQVAAGTPPILAMVRPINIVATALACLCFGTTLAATTEPSPKKAPWLRLVRMRESIRVV

SEQ ID NO: 6487 - protein, 464 aa, Enterobacter cloacae
LQYKGVHVQKYMIEARQLLALAIPVIVAQVAQTAMGFVDTVMAGGYSATDMAAVAIGTSIWLPAILFGHGLLLALTPVIAQLNGSGRRDRVAHQVRQGFWLAGFVSVLIMIVLWNAGYIIRAMHNIDPALADKAVGYLRALLWGAPGYLFFQVARNQCEGLAKTKPGMVMGFIGLLVNIPVNYIFIYGHFGMPELGGVGCGVATAAVYWVMFGSMLTYIKHARSMRDIRNDTTFSTPDWSMLTRLTQLGLPIALALFFEVTLFAVVALLVSPLGIIDVAGHQIALNFSSLMFVLPMSLAAAVTIRVGFRLGQGSTLDAQTAARTGLGVGVCMAVCTALFTVLLREQIALLYNDNPEVVTLASHLMLLAAIYQISDSIQVIGSGVLRGYKDTRSIFFITFIAYWVLGLPSGYILALTDLVVDRMGPAGFWMGFIIGLTSAAIMMMLRMRFLQRQPSTVILQRAAR

SEQ ID NO: 6488 - protein, 343 aa, Enterobacter cloacae
HLMATIKDVAKRANVSTTTVSHVINKTRFVAEETRNAVWAAIKELHYSPSAVARSLKVNHTKSIGLLATSSEAAYFAEIIEAVEKNCFQKGYTLILGNAWNNIEKQRAYLSMMAQKRVDGLLVMCSEYPESVLSMLEEYRHIPMVVMDWGEARADFTDSVIDNAFEGGYMAGRYLVERGHREIGVIPGPLERNTGAGRLAGFMKAMEEALITVPENWIVQGDFEPESGYRAMQQIVSQPHRPTAVFCGGDIMAMGALCAADELGLRVPQDISVIGYDNVRNARFFTPALTTIHQPKDSLGETAFNMLLDRIVNKREQSQSIEVHPRLIERRSVADGPFRDYRR

SEQ ID NO: 6489 - protein, 429 aa, Enterobacter cloacae
MHPPNISVSQAALHSLHSAPTYTCLLRRKKVQPRKGFLVWLGGLSVLGFLATDMYLPAFAAMQEDLQTPAAAISASLSLFLAGFAFAQLLWGPLSDRFGRKPVLLLGLAIFAAGCLGMLWVRDAAWLLALRFIQAVGVCAAAVTWQALVTDYYPASRTNRIFATIMPLVGLSPALAPLMGSWILAHFDWQAIFATLFAITLVLMLPAFGLKPAHKKETHPDAKPITFTSLLRSKAYRGNVLIYAACSASFFAWLTGSPFILHDMGYSPAAIGLSYVPQTIAFLVGGYGCRAALQKWEGQQMLPWLLVLYALSVIATWAVGFIPGAGLAEILIPFCVMAIANGAIYPIVVAQALRPFPQATGRAAALQNTLQLGLCFLASLVVSALIATPLLTTTSVMLITVALAGLGYRMQSSALREQNDNAQTETSHA

SEQ ID NO: 6490 - protein, 390 aa, Enterobacter cloacae
SQQGDGEAMSSSCIEEVSVPDDNWSRIVSELLGRAGITINGSSPSDPQIKHPDFFKRVLQEGSLGLGESYMDGWWECERLDMFFSSVLRAGLEKQLPRHFKDTLRIASARLFNLQSKKRAWIVGKEHYDLGNDLFSRMLDPLMQYSCGYWKKATTLEEAQQDKLQLICDKLQLQPGMRVLDIGCGWGGLAWFMAKNYGVSVVGVTISAEQQKMAQERCLGLDVDIRLQDYRDLNEQFDRIVSVGMFEHVGPKNYKTYFEVADRNLKPDGIFLLHTIGSKRTDNNVDPWINKYIFPNGCLPSVRQIANASEPHFIVEDWHNFGADYDTTLMAWHERFQAAWPEIADNYSERFKRMFSYYLNACAGAFRARDIQLWQVVFSRGIEHGLRVAR

SEQ ID NO: 6491 - protein, 364 aa, Enterobacter cloacae
ARWAAPSAAYSAWWAASSAVSSAPKREARCTHGPHCRAIFLFQPRIIMFSLFQYKKQGKTPVIRQHEFTECGLACLAMVLGHYDHHVSVSQLRREISVSADAGTSMAELMTLASDKNMSGRVLKGEITEIETSELPLIAFWRGNHFVVIVKIDSRSVTVHDPASGVRRYRLKEAEKLFSGYVLELKPTPCFEKKSPDETLTLGRLANKSPSLFQRQLLLFVLCIFTLITMLASPTYVQLIMDEAISRSDSDLVILLTAIFAIVFIFEVIGKFLKQLLEILMRNIAYDDLSQSVRHYMLRTQTSWFRSRPPGIVLAIEKSLHACAEFISNGYVQILFSSLIAVTSLLFMLLYNVQIALADNAADG

SEQ ID NO: 6492 - protein, 207 aa, Enterobacter cloacae
MNKLNAIVLGSLLSVSALSAVNAAETTASATWQATATKDSESDLVVTPTRALNFVYSANTKSFNTDTGLFDVAIRGDHSTATSFKLEAILDDSNNTLFSVGGEATKLKVGARWGGNDLGSIGGTVGAKSTAWTTLVDSSSNTGVSSGLWNLTTSAGAAADTEITGQDKFVFYVDSAQDNAGTAKEFKDLTNSLWEGTVSVAFRATWG

SEQ ID NO: 6493 - protein, 228 aa, Enterobacter cloacae
GNSMFNLKSAFLFLLFISSSALAINVGKVTTIISADADSTAKEIKNEADSVRIVSVRAQRISSPMDEGIVINPEKVDELLLTPTRMVMPAGTSNIVKFYYHGNADNKERYYRITFTDEGVSEEVDSGSPKNGTGMTRAVVSTILVVQPRDKKIDFVYVAGKITNKGNTSFRVNATGTCLKPNPESPGTPCSKNFYLMPETSRAIEDINVTDNHFHLGIWDLKQFIPVK

SEQ ID NO: 6494 - protein, 866 aa, Enterobacter cloacae
GCMVKNKLVLPVMMACASGTLPALAHAASSSVVIANYRFPDSLYALLEQGIKIPVYLVNTRPHSAQQGNHEGTASEYVRIGDVTLFAKDLKLGLRDVQVQESDNGIRLSKEMRALLQSINDKQFDDQMRIPVSAGSAFELDQKKMRLLLNLSQSDYGVNIRLREVDIDAPESDDLSGTFSYNLGAYHTESGYGDSWSSGYLNARNWISMGVDHVLIDGSGYVNESSSDTQMNAVMWERDYQGMRYAAGMLNGWAMQSLASVSGISGGEVYGVSMGNQANSRKRDNTLSLTPVVVYFPTAGEARIRRDGQLIGIQRFDVGNHEIDTSSLPYGIYSIEVEVVSGSRTVSRNMYTVNKPFSSNVSETLRWQMWGGMYSRDKSVVNYKKYAKRKNEQDNTYNYDYDTKHKDTMSLVGASFSKRSGMVDWNASTYMMREHIVSELWASLNLTGYFSVNTQTMAASDGTYRANYGANLSLPWQIGSVWYSHEQLSSGKFLDIYESKGNTWGASFSLPSFGLPSAGNLSLMRQEDDLYRYKRYQLDYSQGLYAGRYGTARLRVGMSRNKYDGYYEEKDRYVMLDFAIPLGNTVSVGVSHNRDTGTALNVSASRQFEGDYLKSATANVSKAFNSRQDRSVSGGGSVNFDTPWNSNILSVQSGMSKGWNSTLTSDGSVGWSKEAIAAGKGTESAGVIVSTGLKSDEALTLKLNGRAERIKGDKTWLSLPAYQAYDLEVMNSETGTESYEIGANARRHITVYPGNTVVMKPQVKKIVTLFGRLVDANGAPIGAMQIKNHVGLTRTENDGRFVIDVDKNNPVLSIATPDDSVCEVRLDIESNRGALWLGDISCDKGDFVWQEAKGTQERDDEKDIRS

SEQ ID NO: 6495 - protein, 275 aa, Enterobacter cloacae
AMRGSFALVVKITMLYEVDTGMIMINGEEESSIKLSNQAGRLLYELIINNGKTLDRDDLIKKVWEDHGFSGSSVSLNVAISEIRKAFRTLGCDPLLIKTIRGKGFSLAAHIEHHTVRPPVVSTLSEQSASESFDTLAHKKDADPPKQLISLHRLFISLCTLLLITVIGTAVLLLHQRDSYAESLKDSDMHLLGKVDRCTVYLIDKNMYQPRQHYFNHVKEVIASQHIDCQHQVADAYYSRFKKSQIENYFLAICYQQDSIDDYKNCISYRSLTGS

SEQ ID NO: 6496 - protein, 579 aa, Enterobacter cloacae
VSPRRTTASAKCAWTSSLTAVRCGLGTSPATKAISSGRKQKERRNVTMKKIFALNLLLMSAAAQAQELPYFAINNPDNNGTGNSAGLFSLNSTSTAFLHGSREWPTLSAKTNNGIATYIPDNSFNGPAGSALTIDFSVTGSSASPFFKGTACSSSCGNTGYTPTTSYTDTSMVVKPPVMEPGTSYGRWVLGDPFFNYLLNAAPGDEVTITSTPQISSINKVTTTNTLHKVGTLTMTNSRALNLGIDPISGEVTIVDGSTGATCTKYTRNTVSGVLCDLLEYTFVGEDISGYNGGLALTSSRVNSVLQSHMSGGTGLAAELTFDENTWYSISGGILSDTRVLANTFLAAPQKNGGKAYLKIFLPKALILSVAQAGDGSNIGNIVSLCLTPGNSSLAADFCFQPGGGLVINPIEPGLEIVPDNPDYTLDPDGLGGSGKGIIGEAPIEIPYTITYSGAQKDAAIAVTVKVTGPTQSLNGVDYCAFSGNGFTVPIPGNVLVGKSQTLMAHNCKGEVLSIPAPATHAEEWDKMSSGVTDMWLWKTPLILQFVMDNPVSKTTYDGNSWFGEVTAQGRIDVSASWN

SEQ ID NO: 6497 - protein, 219 aa, Enterobacter cloacae
STMTGKFLAIFAINCFISTGANALIIESLNIDFLPEREVVFQPIKNDTSERQNYTVSLIQVDVPKEKGKETEIKDGEVMYSPKQLTLGSGERAGFKFYYTGPHDNKERYYRVKFTETPLQAKVITRKGQRIQSDVVVSLEAILIVRPWTRHFDYAFSNGVVSNTGNTYFKYVSSVGCSTQYNNSKYIPPGQRLEIDNAGQAARRMIIYGNKIIPLTTCP

SEQ ID NO: 6498 - protein, 356 aa, Enterobacter cloacae
EEPMMKNTTYLTDEDRWQAVLARDPRADNQFVFAVQTTGIYCRPSCRARHALRKNVCFYPDAHQAAQAGFRPCKRCRPDQGDPMAQKKANIALACRLLEQDASLNLEALAQQVAMSPFHFHRLFKSVTGMTPKAWQQAAREQRLRSLLAQGGKITDAVLAAGFPDGSSYYRKANGALGMTAKQYRNGEAAVRYAISDCSLGRCLVAESERGICAILLGDDDAGLTAELLSLFPLAVREPMEGAFAGRVRQVIASVDSRATSLTLPLDIRGTAFQQQVWQALRAIPCGETASYQQVAKAIGKPNAVRAVAGACGANKLAIVIPCHRVVRNDGALSGYRWGAARKVLLLKREANNPEE

SEQ ID NO: 6499 - protein, 555 aa, Enterobacter cloacae
FFLSGLLCMQLLLLVWRQYRWPFIAVMALSLASAALGIGLIAFINVRLIEMVDTSLSVLPEFLGLLLLLMAVTLGSQLALTALGHHFVFRLRSEFIKRILDTQVERIEQLGSASLLAGLTSDVRAITIAFVRLPELVQGIILTFGSAAYLAWLSSKMLAVTALWIVITIWGGFLLVSRVYKHMAVLRETEDKLYNDYQTVLEGRKELTLNRERAEHIFNHLYIPDAHEYRHHIIRADTFHLSAVNWSNIMMLGAIGLVFWMANSLGWADTNVAATYSLTLLFLRTPLLSAVGALPTLLSAQVAFNKLKKFDLAPFKAEFPRPQAFPNWQTLELRNVTFRYQDNAFSVGPINLTIHRGELLFLIGGNGSGKSTLAMLLTGLYQPQSGEILLDGKALSAEKPEDYRKLFSAVFTDVWLFDRLLGPEGQQADPALVEKWLAHLQMSHKLELQDGKILNLKLSKGQKKRVALLLALAEERDIILLDEWAADQDPHFRREFYQVLLPLMQAMGKTIFAISHDDHYFIHADRLLEMRDGKLSELTGDERDAASRDAVARTA

SEQ ID NO: 6500 - protein, 344 aa, Enterobacter cloacae
LCPVPGSLVGEDDLYGKVDGLHYFSDDDSADGDQTYMRLGFKGETQVNDQLTGYGQWEYQIQGNSGENENNSWTRVAFAGLKFADAGSFDYGRNYGVVYDVTSWTDVLPEFGGDTYGSDNFMQQRGNGFATYRNQDFFGLVDGLNFALQYQGKNGSASGEGQTNNGREALRQNGDGYGGSLTYDLGEGFAIGTAVTSSKRTADQNAAGYYGEGDRAETYTGGLKYDANNIYLAAQYTQTYNATRAGDLGWANKAHNFEVVAQYQFDFGLRPSVAYLQSKGKDLENGYGDQDLLKYVDVGATYYFNKNMSTYVDYKINLVDENDFTRAAGIGTDDIVALGLVYQF

SEQ ID NO: 6501 - protein, 130 aa, Enterobacter cloacae
PMDMTFLRASVLATFLLLTACDSSTQPAKIDAPAATVLEGKTMGTFWRVSVMDIDKSRAEELRGKIQAQLDADDQLLSTYKNDSALMRFNRSSQHLAVAGERSNGRYRHGSHARGKQNQRRNGCDGGARW

SEQ ID NO: 6502 - protein, 205 aa, Enterobacter cloacae
NLWGFGPNKQPVTTPDQAAIDDARARTGLQHLAVISQYGQQYLQKDIPDLFVDLSTVGEGYAADHLAALMAQEGIPRYLVSVGGALVSRGMNASGRPWRVAIQKPTDQQNAVQAIVDINGHGISTSGSYRNYYELDGKRISHVIDPQTGRPITHNLVSVTVIAPTALEADAWDTGLMVLGTEKAKEVVRQEGLAVYMITKEADGF

SEQ ID NO: 6503 - protein, 223 aa, Enterobacter cloacae
GEQPGGIMLDLFADAEPWQESLAPGATILRRFALSRAAALFDGIKAVTARSPFRHMVTPGGYTMSVAMTNCGELGWATNERGYVYAAYDPLTDQPWPPMPEAFQALCHDAAVAAGYPDFRPDACLINRYAVGAKLSLHQDKDEPDLRAPIVSVSLGLPAVFQFGGLRRNDPLKRLMLEHGDVVVWGGESRLFYHGIQPLKPGDHPVAGAFRYNLTFRQAAYRE

SEQ ID NO: 6504 - protein, 479 aa, Enterobacter cloacae
LMSVLKKNSARQRDQERARLIWLLTTDKAVTSTLLGKLTLAEQYDVGTLADDIAEVGALVAHLPPPDLADTLEALPSEERHALWRLVQDHERGQVLLEASENVWDDLIDEMSDRDILDALQTLDIDEQIYLVQHLPRNLTGRLLASLPAEERARVRQVMHYEKNSVGAIMEFGVITVRPDVTLGTVQRYLRRLGSMPDNTDKLFVTSRDKTLLGELELKTILLNSTQQRVSEVMETEPMVFSPEDDAEKAARTFERDDLVSAAVVDSVGKLMGRLTIDEIVDVVYEETDNDLRALGGISAEDDVHASVGKAVKTRWAWLAINLCTAFVASRVIDGFEHTISQLVALASLMPIVAGIGGNTGNQTITMIVRALALENIQPGNFSWLIFREMGVALINGLVWGGIMGGITWWLYDDMALGGVMMLAMVLNLLVAAMMGVIIPLTMTRLGRDPAVGSSVMITAITDTGGFFIFLGLATIFLL

SEQ ID NO: 6505 - protein, 67 aa, Enterobacter cloacae
SASAAPYPARRTGSESCLPSPPRAECTVRRVDGPSGQSPARRNLPPPSPWPDARRAGKGRNRAPRRR

SEQ ID NO: 6506 - protein, 326 aa, Enterobacter cloacae
LPCSFLLAVGLNAVSLAAKADAPKEQETDVLLIGGGIMSATLGTYLQELEPNWSMTMVERLDGVAQESSNGWNNAGTGHSALMELNYTPQKKDGSISIEKAVEINEAFQISRQFWSHQVNSGVLHNPHSFINTVPHMSFVWGDQNVNFLRARYAALQQSTLFRGMKYSEDHAQIKEWAPLVMEGRDPNQKVAATRTEIGTDVNYGEITRQLVASLKKKENFNLQLSSEVRGFKRNADNSWSVTVADLKNNEAEHVIKAKFVFIGAGGAALKLLQESGIPEADDYAGFPVGGQFLVSENPEVVNRHLPKVSGQYSTTRRQDRVRLEA

SEQ ID NO: 6507 - protein, 466 aa, Enterobacter cloacae
ILFKGYEIIVIVKFNDGLFVGFWQTGWHPTIFLAMMLHFVIARTEACPYQRIVMSLPHSSLPQEGHVATVLRSPHRLMRETLAGVITALALIPEVISFSVVAGVDPKVSLIASVVLCFALSLLGGRPAMVTAAAGSVALVIGPMVHQHGVQYILPAVVMAGMIQILFGALGMARLMRFIPQSVMTGFVNALGILIFFAQVPHFWSRSPLIVGLFVLTLLIVLWVPRYIKSVPSPLIAIVLLTLFTVTSGQILPTVGDEGSMSGGLPGFTQLLVPLNLETLSIIWPCALSIAFVGLLESLLTAKLVDELTATPSSKRRESIGLGVGNIMAGFYGGIAGCAMIGQTIVNVEMGKGRSRISTLAAGIVLLVLVTALSEVMAKIPMAVLAGIMAIVAVKTFSWHSVQPGTLKNAPVAETVVMLVTVVATVYTGNLAIGVLGGIVMMFILPARLKQKALAREEKSSPVQEK

SEQ ID NO: 6508 - protein, 201 aa, Enterobacter cloacae
IMGIFSRFADIVNANINSLLEKAEDPQKLVRLMIQEMEDTLVEVRSTSARALAEKKQLTRRIEQATAQLNEWQEKAELALRKDKEDLARAALIEKQKLTDMVATLEHEVTLVDDTLTRMKKEIGELENKLSETRARQQGAGAAPPGLQARPATCVANWTAANWMKQWRVSNRLNVVSTTWKRKPKATASVSRKPWISSLLT

SEQ ID NO: 6509 - protein, 84 aa, Enterobacter cloacae
ACRIVRQGVHMSALFLAIPLTIFVLFVLPIWLWLHYSNRSSRGELSQSEQQRLAQLSAEANKMRERIQALEAILDAEHPNWRER

SEQ ID NO: 6510 - protein, 204 aa, Enterobacter cloacae
LPLNEGSPMATKRRAETAQENREKMIQAARKAFAEKGYAAASMDELTASVGLTRGALYHNFNDKKGLLAAVVAQIDSEMAANAKAIAAAADDDWERLLAEGIAYIKMALVPEVQRIVLLDGPAVLGDPAQWPSQNNCLESTRQTIEKMMECNVIKKMDARVAAHLLNGAALNAALLIAASDEPQKTLPHAIEVFTLLASGLRNG

SEQ ID NO: 6511 - protein, 97 aa, Enterobacter cloacae
KQTQRNPCTSTGRWRCPTRAASSSRDVRRQLDSGKLDEAMARFESFERRIDHMEAEAESHSIGKQKTLDQQFADLKADDEISEQLAALKAKMKQDNQ

SEQ ID NO: 6512 - protein, 142 aa, Enterobacter cloacae
NARTYSGAGSHPGRGTPKLEGTVMAGLNLNKKLWRIPQQGMVRGVCAGLAHYLDVPVKLVRVVTVLSIFFGLAFITLVAYIILSFVLDPMPEGELNAENTPTSRDLLNAVDEQLSAGEKRLREMERYVTSDTFTLRSRFRQL

SEQ ID NO: 6513 - protein, 78 aa, Enterobacter cloacae
ERTYMKQNWQQAGQKVKPGLKIAGKLVLMTALRYGPAGVAGWAIKSVARKPVRMMLAVALEPLLQKLAKRVSRRYLSR

SEQ ID NO: 6514 - protein, 331 aa, Enterobacter cloacae
GVVNFIMAEYKDNLLGEANSFLEVLEQVSRLAPLNKPVLIIGERGTGKELIANRLHFLSGRWDGPFISLNCAALNENLLDTELFGHEAGAFTGAQKRHPGRFERADGGTLFLDELATAPMLVQEKLLRVIEYGELERVGGSQPLQVNVRLVCATNADLPAMVAEDKFRADLLDRLAFDVVQLPPLRERRSDIMLLADQFAIQMCRELGLPLFPGFSERATGTLLGYHWPGNIRELKNVVERSVYRHGSSETELDNIILDPFRREDKQPPAPATRQQDPALPLDLRQFQHQQEKNLLEQSLKEAKYNQKRAAELLGLTYHQLRALLKKHQMR

SEQ ID NO: 6515 - protein, 329 aa, Enterobacter cloacae
ERTRGEETMIIFTLRRLLLLLVTLFFLTFVGFSLSYFTPHAPLQGSSLWDAWLFWFNGLLHWDFGVSSINGQLISEQLKVVFPATMELCVLAFGFALMVGIPVGMLAGIYRNKWQDKFISALALIGFSIPVFWLALLLTLFFSLTLGWLPVSGRFDLLYNVQTVSGFAIVDAWLSDSVWRDEMIVSALRHMVLPVLTLAVAPTTEVIRLMRISTIDVFDQNYVKAAATRGLSRLTILRRHVLHNALPPVIPRLGLQFSTMLTLAMITEMVFSWPGLGRWMINAIRQQDYAAISAGVMVIGSLVIIVNVVSDILGAMANPLKHKEWYALR

SEQ ID NO: 6516 - protein, 346 aa, Enterobacter cloacae
PAGRRDPPRNQCGGAIMPLLDIRNLTIEIKTGEGWVKAVDRISITLAEGEIRGLVGESGSGKSLIAKAICGVAKDNWRVTADRMRFDDIDLLRLSPRERRKLVGHNVSMIFQEPQSCLDPSERVGKQLMQNIPGWTYKGRWWQRFGWRKRRAIELLHRVGIKDHKDAMRSFPYELTDGECQKVMIAIALANQPRLLIADEPTNAMEPTTQAQIFRLLTRLNQNNNTTILLISHDLQMLSKWADKIDVMYCGQTVETAPSEDLVTTPHHPYTQALIRAIPDFGSAMPHKSRLNTLPGAIPLLESLPIGCRLGPRCPYAQRKCIETPRLTGPKNHLFACHFPLNMERE

SEQ ID NO: 6517 - protein, 586 aa, Enterobacter cloacae
GHCSKNIKCADIISTYPQTFLRSRRKCDTLCRSNLKTLKTMRLVLSSLFALGLFSNLAFAAPDRAVPPDIRESGFVYCVSGQVDTFNPQKAGSGLIVDTLAAQLYDRLLDVDPYTYRLVPELAESWEVLDNGATYRFRLRDDVAFQHTPWFTPTRKLNADDVVFTFQRIFNRNHPWHNVNGGNFPYFDSLQFADSVKSVRKLDNRTVEFRLTRPDASFLWHLATHYASVMSAEYADQLTKKDRQERLDREPVGTGPFQLAEYRAGQYIRLQRHDRFWRGKPLMPQVIVDLGSGGTGRLSKLLTGECDVLAWPAASQLTILRDDPRLRLTLRPGMNIAYLAFNTDKPPLNNPAVRHALALAINNQRLMQSIYYGTAETAASILPRASWAYDGEAKITEYNPAKAREQLKALGAENLTLQLWVPTSSQAWNPSPLKTAELLQADMAQVGVKVIIVPVEGRFQEARLMDMNHDLTLAGWSTDSNDPDSFFRPLLSCAAINSQTNYAHWCNREFDAVLQKALASQQLASRIEAYDEAQNILARELPVLPLASSLRLQAYRYDIKGLVLSPFGNASFAGVTREKEQEVKKP

SEQ ID NO: 6518 - protein, 301 aa, Enterobacter cloacae
SIRNGMPYDNVYSEKRTPGALRTVWRNFYGDTTAMIGFYGCIGLVLLCVLGSWFAPYGIDQQFLGYQLLPPSWSRYGEVSFFLGTDDLGRDVLSRLLSGAAPTVGGAFVVTLAAAICGLALGIFAGSTHGLRSAVLNHILDTLLSIPSLLLAIIVVAFAGPHLTHAMFAVWLAILPRMVRSVYSLVHDELEKEYVVAARLDGATTFNILWFAVLPNIAAGLVTEITRALSMAILDIAALGFLDLGAQLPSPEWGAMLGDALELIYVAPWTVMLPGAAIMVSVLLVNLLGDGIRRAINAGVQ

SEQ ID NO: 6519 - protein, 274 aa, Enterobacter cloacae
TWRESEMVETLLEVRNLSKTFRYRTGLFHRQTVEAVKPLSFTLREKQTLAIIGENGSGKSTLAKMLAGMVEPSGGEILIDDHPLEFGDYSFRSQRIRMIFQDPSTSLNPRQRISQILDFPLRLNTDLEPEARRKRIVETLRLVGLLPDHVSYYPHMLAPGQKQRLGLARALILRPKVIIADEALASLDMSMRSQLINLMLELQEKQGISYIYVTQHLGMMKHISDQVLVMHQGEVVERGSTADVLASPLHDLTKRLIAGHFGEALTADAWRKDR

SEQ ID NO: 6520 - protein, 144 aa, Enterobacter cloacae
ARLSSPFNPARLNPVSGKVSPHNGIDYSMPMNTKIVSVIDGKITRAEYNSTMGYFVEVTGKAGVKTRYLHLNKILVTKGARVTRGGAIALSGNSGRSSGPHLHYELVINNNPVNSLAFRAAAPADNKLEQHAFAHARDYERYLD

SEQ ID NO: 6521 - protein, 446 aa, Enterobacter cloacae
PSGAYARCFDFLAENCMASLKIKYAAIIISSLIAGGLISVTAWQYVNSAQKTEKTEQKAPERKVLFWYDPMKPDTKFDKPGKSPFMDMDLVPKYADDSGDKSSGEIRIDPTQVQNLGLKTQKVTRGMLNYSQTIPANVSYNEYQFVIVQARSDGFVEKVYPMTIGDHVKKGTPLIDITIPDWVEAQSEFLLLSSTGGTSTQIKGVLERLRLAGMPEEDIQRLRSTRSIQTRFTIKAPIDGVITAFDLRTGMNISKDKVVAQIQGMDPVWISAAVPESIAYLLKDTSQFEISVPAYPDKTFHVEKWNILPSVDQTTRTLQVRLQVSNKDEFLKPGMNAYLKLNTRSQEMLLIPSQAVIDTGKEQRVITVDDEGKFVPKQIHVLHESQQQSGIGSGLNEGDTVVVSGLFLIDSEANITGALERMRHPEKTESSMPAMSDQPVNMHSGH

SEQ ID NO: 6522 - protein, 831 aa, Enterobacter cloacae
HTLKTEDASVCIRRVTVKNDNAVQHNNQTASEQTLSPDEGHVLHKVRDPVCGMAILPDRAHSSIRYQDHQLYFCSASCESKFKAHPDRNLTEDASEHSHHHHHDHHEVSPDQIKQPHHQAEKENSEGVWTCPMHPEIRRSGPGSCPVCGMALEPLVATASTGPSDELHDMTRRFWLGLLLAFPVLVLEMGSHLFPELRNTVPPQYNTWLQLLLASPVVLWCGWPFFARAGMSLRNRSLNMFTLVAMGTGVAWVYSVIATVFPSWFPASFRNMDGLVAVYFEAAAVITVLVLLGQVLELRAREQTSGAITALLNLAPKTARRLDHDGHETDINAEDVLPGDKLRIRPGESIPVDGIVIEGKTTVDESMVTGESMPVTKTEGDPVIGGTINQTGSLIIRAEKVGDETMLSRIVQMVADAQRSRAPIQRMADSVSGWFVPLVILIAVVAFVIWSVWGPEPRMAHGLIAAVSVLIIACPCALGLATPMSIMVGVGKGAQAGVLIRNAEALERLEKVDTLVVDKTGTLTEGSPTVTGIISLNPGGETSLLRVTAAVEKGSQHPLGMAVVKAAQEKGIAIPAVTHFDAPSGKGVSGDVEGQRVVIGNELAMQENSIVIDNQKAVADTLRMEGATVIYVATDGDLAGLIAISDPVKTTTPDALKALRQAGIRIVMLTGDNQLTAEAVARKLGIDEVEAGILPDGKKAVITRLKESGHVVAMAGDGVNDAPALAAADVGIAMGTGTDVAIESAGVTLLKGDLMILNRARHLSEITMKNIRQNLFFAFIYNALGVPVAAGLLYPVYGILLSPVIAAAAMALSSVSVIVNALRLKSVRLGK

SEQ ID NO: 6523 - protein, 190 aa, Enterobacter cloacae
GSVFGSGPFHPVVKRRGSQLKAADANIGAPRAAFFPSITLTSGLSASSTELSSLFTSGSGMWNFIPKIEIPIFNAGRNKANLKLAEIRQQQSVVNYEQKIQSAFKDVSDTLALRDSLSQQLESQQRYLDSLQITLQRARGLYASGAVSYIEVLDAERSLFATQQTILDLTYSRQVNEINLFTALGGGWVE

SEQ ID NO: 6524 - protein, 126 aa, Enterobacter cloacae
IYLINQEIKMRNSLKAVLFGAFSVMFSAGLHAETHQHGDMNTASDASVQQVIKGTGVVKDIDMNTKKITISHEAIPAVGWPAMTMRFTFVNADDAINALKTGNHVDFSFIQQGNISLLKSINVTQS

SEQ ID NO: 6525 - protein, 1058 aa, Enterobacter cloacae
ICIQGTEETTMIEWIIRRSVANRFLVMMGALFLSIWGTWTIINTPVDALPDLSDVQVIIKTSYPGQAPQIVENQVTYPLTTTMLSVPGAKTVRGFSQFGDSYVYVIFEDGTDLYWARSRVLEYLNQVQGKLPAGVSSEIGPDATGVGWIFEYALVDRSGKHDLSELRSLQDWFLKFELKTIPNVAEVASVGGVVKQYQIQVNPVKLSQYGISLPEVKQALESSNQEAGGSSVEMAEAEYMVRASGYLQSIDDFNNIVLKTGENGVPVYLRDVARVQTGPEMRRGIAELNGQGEVAGGVVILRSGKNARDVITAVRDKLETLKASLPEGVEIVTTYDRSQLIDRAIDNLSSKLLEEFIVVAIVCALFLWHVRSALVAIISLPLGLCIAFIVMHFQGLNANIMSLGGIAIAVGAMVDAAIVMIENAHKRLEEWDHQHPGEQIDNATRWKVITDASVEVGPALFISLLIITLSFIPIFTLEGQEGRLFGPLAFTKTYSMAGAAALAIIVIPILMGFWIRGKIPAETSNPLNRVLIKAYHPLLLRVLHWPKTTLLVAALSIFTVIWPLSQVGGEFLPKINEGDLLYMPSTLPGVSPAEAAALLQTTDKLIKSVPEVASVFGKTGKAETATDSAPLEMVETTIQLKPEDQWRPGMTIDKIIEELDRTVRLPGLANLWVPPIRNRIDMLSTGIKSPIGIKVSGTVLSDIDATAQSIEAVAKTVPGVVSALAERLEGGRYIDVDINREKASRYGMTVGDVQLFISSAIGGATVGETVEGVARYPINIRYPQDYRNSPQALKQMPILTPMKQQITLGDVADIKVVSGPTMLKTENARPASWIYIDARGRDMVSVVNDIKTAISQKVKLRPGTSVSFSGQFELLEHANKKLKLMVPMTVMIIFILLYLAFRRVDEALLILMSLPFALVGGIWFLYWQGFHMSVATGTGFIALAGVAAEFGVVMLMYLRHAIEAHPELSRKETFTPEGLDEALYHGAVLRVRPKAMTVAVIIAGLLPILWGTGAGSEVMSRIAAPMIGGMITAPLLSLFIIPAAYKLIWLRRHKKSVS

SEQ ID NO: 6526 - protein, 133 aa, Enterobacter cloacae
LPPLRGLATRGEDDDGAKCGRCGHELFDGDVINATGATLDKLLKDDLPVVVDFWAPWCGPCRNFAPIFEDVAEERSGKMRFVKVNTEAERELSARFRIRSIPTIMIFKNGEVIDMLNGAVPKAPFDSWLNESL

SEQ ID NO: 6527 - protein, 904 aa, Enterobacter cloacae
GRKRLKSSGRLHSQEACMSQRGLEALLRPKSIAVIGASMKPDRAGYLMMRNLLAGGFNGPVMPVTPAYKAVQGVLAWPDVQSLPFVPDLAVLCTHAKRNLELLESLGQKGCKTCIILSSPPEQQPELLACASRYQMRILGPNSLGLLAPWQGLNASFSPVPIRKGKLAFISQSAAVSNTILDWAQQREMGFSYFIALGDSLDIDVDELLDFLARDSKTSAILLYLEHLSDARRFVSASRSASRNKPILVIKSGRSPAAQRLLHSRSGMDPAWDAAIQRAGLLRVQDTHELFSAVETLSHMRPLRGEKLMIVSNGAAPAALALDELWLRNGKLATLGEETLQRLRDALPGSVVPDNPLDLRDDASSDRYIKAITILLDSQDFDALMIIHSPSAVAPGSESARALIEAVRNHPRGKYVTLLTNWCGEFSSQEARRLFSEAGLPTYRTPEGTITAFMHMVEYRRNQKQLRETPALPGNLTANSVDVHRLLQQAIEEGATSLDTHEVQPILGSYGMQTLPTWIAGDSAEAVHIAEQIGYPVALKLRSPDIPHKSDVQGVMLYLRTATEVQQAADAIIDRVKMTWPQARIHGLLVQSMANRAGAQELRVVVEHDPVFGPLIMLGEGGVEWRPEEQAVVALPPLNMNLARYLIIQAIKSKKIRGRSALRPLDIAGLSQFLVKVSNLIVDCAEIQRLDIHPLLASGNEFTALDVTLDIAPYIGDPESRLAIRPYPLHLEEWVEMKNGERALFRPILPEDEPLLRAFISQVTKEDLYYRYFSEINEFTHDDLANMTQIDYDREMAIVAVRRSGAGEEILGVTRAISDPDNVDAEFAVLVRSDLKGLGLGRRLLEKLIGYTRDHGLSRLNGITMPNNRGMVTLARKLGFDVDIQLDEGIVSLSLSLTSTDKQE

SEQ ID NO: 6528 - protein, 260 aa, Enterobacter cloacae
TNPCNIRGAYLVPRSLLCENGVFPAFSPMTDNAVLQLRAERLARATRPFLARGNRIRRCQRCLLPLKVCLCETLAPSEAKSRFCLVMFDTEPMKPSNTGRLIADILPNTAAFQWSRTEPPQALLDLVASPDYQPMVVFPASYAGEQRQVLTAPPSGKPPLFIMLDGTWTEARKMFRKSPYLDALPVISVDLSRVSAYRLREAHADGQYCTAEVAIALLDLAGDTQAAGALGSHFSCFRERYLAGKTVHKGSVTATEAESV

SEQ ID NO: 6529 - protein, 458 aa, Enterobacter cloacae
TEKKRTVMLSKFKRNKHQQHLAQLPKISQSVDDVEFFYAPAHFRETLLEKIASATRRICIVALYLEQDEGGRAILNALYEAKRQRPELDVRVLVDWHRAQRGRIGAAASNTNADWYCRTAQENPGIDIPVYGVPVNTREALGVLHFKGFIIDDSVLYSGASLNDVYLHQLDKYRYDRYHLIRNPQMADIMFNWVDKNLVHGRGVHRLDDPHRPKSPEIKNDVRSFRQELRDAVYRFQGDASNEELSVTPLVGLGKSSLLNKTIFHLMPCAEHKLTICTPYFNLPAVLVRNIIQLLRDGKKVEIIVGDKTANDFFIPEDQPFKIIGALPYLYEINLRRFLSRLQYYVNTDQLVVRLWKDEDNSYHLKGIWVDDEWMLLTGNNLNPRAWRLDLENAILIHDPQHALAAKRDRELELIRTHTTVVRHYRDLQSIADYPVKVRKLIRRLRRIRIDRLISRIL

SEQ ID NO: 6530 - protein, 140 aa, Enterobacter cloacae
FAVYVGSVSTASSAAFCNTRALSSTGLFLWSLLMRTPFLIIPLFLTGCSHMANDNWSGQDKAQHFLASAMLSAAGNEYALHQGYSRDRSATMGLMFSISLGASKELWDSRPSGSGWSWKDFAWDVAGATTGYAVWQMAHY

SEQ ID NO: 6531 - protein, 458 aa, Enterobacter cloacae
RFVLNPVLLFVGNGPQCETGDFKMTETVASADTDNTSLAGKDTRRRVWAIVGASSGNLVEWFDFYVYSFCSLYFAHIFFPSGNTTTQLLQTAGVFAAGFLMRPIGGWLFGRIADRKGRKTSMLISVCMMCVGSLVIACLPGYDTIGTWAPALLLLARLFQGLSVGGEYGTSATYMSEVAVEGRKGFYASFQYVTLIGGQLLALLVVVILQQILSDEDLRAWGWRIPFALGAALAVVALWLRRQLDETSQQEVRALKEAGSMKGLWRNRKAFLMVLGFTAAGSLSFYTFTTYMQKYLVNTTGMHANVASVVMTVALLVFMLIQPIVGALSDKIGRRTSMLIFGGMLTLGTVPLLTALQHTTSPYAAFALIMVALIIISFYTAISGILKAEMFPAQVRALGVGLSYAVANALFGGSAEYVALSLKSWGSETTFFWYVTIMGALAFIVSLMLHRKGKGIRL

SEQ ID NO: 6532 - protein, 146 aa, Enterobacter cloacae
GGLVRSCQSRGEDLELHLEQLFLEHGLTQFATQSVTEGNKKPDFLFPSSDAYHDKAFPDEKLHMLAVKTTCKDRWRQVLNEADRIQNIHLFTLQEGVSLAQFKEMQQERVTLVVPSSLHKKYPEAVRPELMTLGHFIARLIGIYAA

SEQ ID NO: 6533 - protein, 518 aa, Enterobacter cloacae
SRVSGFLSQLTPPAASLTSYTQLPESPMTWKNTAEQNAIIEWKGTHLVVNAFAGTGKTTTLVSYAEANPESRMLYLAYNRAVRDEAERRFPYNVECKTSHQLAWARFGKHFRDRLTASLRITDVARKLNTRHWPLARLALSGLNMFLCSADPEPGLIHLPSEDDRHGLDAGKILGAIQILWYEMSRTDSVFPVTHDTYLKMFQLSQPDLSKRWDTILFDEAQDANPVTSAFVLNQPCRVILVGDRYQQIYRFRGADNALNARQLAQADRLWLTASFRFGPEVARVANILLERAGEEKRVAGNGGQDAVVSDLPAGAEHITVLSRTVSGVIGSALTASLMEKKVFWVGGIEGYKTEELEDLYWFSADMPEKMQSPRLSRDYRDFDEYCSIAKATQDVEMNQAIRLLDDFFPLPQKLAIMRRQVVSHEKEAQVTVSTAHRSKGLEWSVVMLSEDFTDITDPLLSQEERQDETNLLYVAVTRARKTLVLNELMRWLSEAGEGDDENDAVMPDDTGEISGTE

SEQ ID NO: 6534 - protein, 547 aa, Enterobacter cloacae
  UNSURE (85)
  UNSURE (88)
AALYQENIMLSRIRTLRSLFSKGEPEAVHHISTVTPVGYHAPRGAGMLCASPLRKTCLQQIWENCSLPADIYQRLYLAPLNGLLXRVXNVPATQKGRWSQSAGFGDLTLQFTTCAVRLAKGYMFPPGAAPEEQAEQNVMWNAVIIWSALFWHLLFLATLEGELLDGKSWLPGMTIPDSPYRFRFREAENASAFAALAAGQLMPTEATGWLAENPEALCNLAGALWNQHPGMPLIRGLMKQAAEKVESPSLGISGANEKVDTLAEPALSVSRTSSDRETELQPSSEAKLKTALPEIADLQGTLLASSIAPVPMADDGNLVSNEKAGEITECDPNETEMADTEMLLSLFSAISVPDMTGTEACDEDSSVNARAENEPEFSPLNEISPEADKHEINQTAAENSFPEPDTEDNIPLHSVNIDMQKTVKKEQAGTEFLRWLSEGIKSKRIDINQPDSRAHAVAGFIFLRVPDIFYLYIRESGSELSRDSLQQEFEKLHIHRVRRGERFIKAKLYHSPGKEGTFRPVSGYLVKTTHLFRGASSPEDSGLLSFL

SEQ ID NO: 6535 - protein, 467 aa, Enterobacter cloacae
LGHLNPMMINEAQAQATAASGSGDGRYPSGLCAGAEIIPAADEQTKAEPLTMEAVITRENLMLAYQRVVENKGAAGVDNLSVAELKPWLKRHWPGIRQALIDGNYQPRAIRRMDIPKPDGGVRTLGIPTVVDRLIQQAIAQRLSAIVDKDFSDSSYGFRPGRSAWQAVQQAQRYVRSGKRWVVDMDLEKFFDRVDHRLLLARLARKIRDRRLLRLIRRYLKAEMVKGGEREKRREGMPQGGPLSPLLSNILLDELDKELERRGHSFCRYADDCNIYVSSRKAGEQILEAVREFVESKLKLKVNEQKSAVARPWERKFLGYSVTWHKQTRLKIAAASVGRLKDKIRSLTTGNRSRSVKATIDELTPLLRGWISYFRLTEVRGILEELDGWINRKLRCQMWRQWKRPRSRARMLQKAGLGRDRAMLSAYNGHGAWWNSGASHMNQAIKRSWFRGLGLISLLEHHRQFQR

SEQ ID NO: 6536 - protein, 67 aa, Enterobacter cloacae
TQTNRPAAEILPELGQLSRRQIAALVEVAPYDRDSGRMKGRRVIWGGKSWPSIHFVYGCAFCCTVQS

SEQ ID NO: 6537 - protein, 531 aa, Enterobacter cloacae
TADPRCCKTDVCLWFDGEPKKRTNLNHWLNIQINLFYLGQMSDMVSPMRPTGGAMSEFELLAQDLLQKSEEEEKLQQEKDKELIAKVLEIYDQKYVAELLRKVGNNDWSRETINRWINGKCGPKSLTSAEEILLRKMLPEPPKHHPDYAFRFIDLFAGIGGIRKGFEEIGRHCVFTSEWNKEAVRTYKANWFNDELEHKFNLDIREVTLSDREDLSETAAYKHIDKEIPDHDVLLAGFPCQPFSLAGVSKKNSLGRAHGFECEAQGTLFFDVARIIKAKKPAIFVLENVKNLKSHDKGKTFKVIMETLDELGYEVADAGVSGSDDPKIIDGKNFLPQHRERIVLVGFRRDLKIHDGFTLRNIHKFYPQNRPTFGELLDPAVDSKYILTPKLWEYLYNYAKKHAAKGNGFGFGLVDPTNVNSVARTLSARYHKDGSEILIDRGWDKAKGELDFRDEENQSRRPRRLTPHECARLMGFEKVGGKPFRIPVSDTQSYRQFGNSVVVPVFEAVARLLEPYIGKAVAVRTNKAKTK

SEQ ID NO: 6538 - protein, 101 aa, Enterobacter cloacae
KAVGLSGVGRAGLRSILFMAVLSVVRFNPKMKHYYQGLLERGKVKKVALTACIRKFITILNAMVRDWKMWSAELQTPGVAKQMFVYGSMGSQKSEQISTTG

SEQ ID NO: 6539 - protein, 460 aa, Enterobacter cloacae
ATIDTHMKAKAILLASVLLVGCQSQNGSNVQQHAQSLSAAGQGEAGKFTSQARWLDDGTSFAQEQDLWASIGDELKMGIPENSRIREQKQKYLRNKSYLHDVTLRAEPYMYWIAGQVKKRNMPMELVLLPIVESAFDPHATSGANAAGIWQIIPSTGRNYGLKQTRNYDARRDVVASTTAALDMMQRLNKMFDGDWLLTVAAYNSGEGRVLKAMKANKARGKSTDFWSLSLPQETKIYVPKMLALSDILKNSKRYGVQLPTPDESRALARVRLSSPVDIQQVADMTGMSVSKLKTFNAGVKGSTLGASGPRYVMVPQKHAEQLRESLASGEIAAVQSTLIADTSPVSSRSYKVRSGDTLSGIASRLGVNAKDLQQWNNLRGSGLKVGQTLNVGAGSSAQRLAKNSDSITYRVRKGDSLSSIAKRHGVNIKDVMRWNNDTDNLQPGDQLTLFVKNSATPDS

SEQ ID NO: 6540 - protein, 101 aa, Enterobacter cloacae
SLRLALARPGILEGTSSRLATIAITPNSDTARKVSRQPKCCPINVPNGTPVTSATVKPPNIIAMADAAFSFGTRLVAIVEPMEKKTPCARPVSKRAMTSVV

SEQ ID NO: 6541 - protein, 308 aa, Enterobacter cloacae
NFADDAIMKATSEELTIFVAVVESGSFSRAAEQLGQANSAISRSVKKLEMKLGVSLLNRTTRQLSLTEEGERYFRRVQSVLQEMAAAETEIMESRSTPRGLLRIDAATPVVLHFLMPLIKPFRERYPEMTLSLVSSETFINLIERKVDVAIRAGTLTDSSLRARPLFTSYRKMIASPQYIAEHGKPETVEELKQHLCLGFTEPVSLNTWPVACHDGQLHEITCGLSSNSGETLKQLCLEGNGIACLSDYMIDKEIAAGQLVELMADKRLPVEMPFSAVYYSDRAVSTRIRAFIDFLSEHIKTAPGGAV

SEQ ID NO: 6542 - protein, 63 aa, Enterobacter cloacae
ILIADPASLVVKTLPVILKNERQINLFLRTDDVDLINKINQETNLLQPEARFAWLRSKKDNFR

SEQ ID NO: 6543 - protein, 272 aa, Enterobacter cloacae
RLRNHMTIPALGLGTFRLKDDVVIASVKTALELGYRAIDTAQIYDNEAAVGQAIEESGVPRDELFVTTKIWIENLSKHKLIPSLKESLKKLRTDYVDLTLIHWPSPDDAVSVEEFMQALLEAKEQGLTREIGISNFTIPLMERAIAAVGKENIATNQIELSPYLQNRKVVDWAKQHSIHITSYMTLAYGKALKDEVIARIAEKHNATAAQVILAWAMGEGYAVIPSSTKRENLASNLLARDLQLDDEDKNAIAALECNDRLVSPEGLAPDWD

SEQ ID NO: 6544 - protein, 290 aa, Enterobacter cloacae
PKIPITLEPVRFPGWFMLQRSFPKVRKNTYAMRYVAGMPAERILPPGSFASLGQALPAGTPLSSDEKIRVLVWNIFKQQRAEWLSVLQNFGKDAHLVLLQEAQTTPELVRFATTNYLAADQVPAFVLPQHPSGVMTLSAAHPVYCCPLREREPILRLAKSALVTVYPLPDTRLLMVVNIHAVNFSLGVDVYSKQLLPIGDQIAHHSGPIIMAGDFNAWSRPRMNALYRFAREMSLREVRFNDDQRKKAFGRPLDFVFYRGLSVHDASVLVTRASDHNPLLVEFSPGKPDK

SEQ ID NO: 6545 - protein, 396 aa, Enterobacter cloacae
RDGVFMPLALLALTISAFAIGTTEFVIVGLVPTIAEQLAISLPSAGLLVSIYALGVAVGAPVLTALTGRFARKKLLVALMVLFTAGNILAWQAPDYTTLVIARLLTGLAHGVFFSIGSTIATSLVPKEKAASAIAIMFGGLTVALVTGVPLGTFIGQHFGWRETFLAVSLLGVIAMVASLLLVPSSIPGRASASLSDQVKVLTHPRLLLIYAVTALGYGGVFTAFTFLAPMMQELAGFSPGAVSWILLGYGISVAIGNIWGGKLADKHGAVPALKFIFAALVVLLMIFQFTASIQYAALVTVLVMGIFAFGNVPGLQVYVVQKAERYTPNAVDVASGLNIAAFNIGIALGSVIGGQTVEHVGLTQTPWIGAVIVLVAFLLIGLSGRLDKPARVALG

SEQ ID NO: 6546 - protein, 261 aa, Enterobacter cloacae
KDSNMTTTHSHHDNVDKQFGSQASAYLSSAVHASGRDLVRLGERLAAFPDAHVLDLGCGAGHASFTAAEQVAQVTAYDLSSQMLDVVAEAAKAKGLNNVTTRQGYAESLPFEDASFEVVISRYSAHHWHDVGQALREVKRVLKPGGIFIIMDVMSPGHPVRNIWLQTVEALRDTSHVQNYSSGEWLTFITEAGLISRSLITDRLPLEFASWIARMRTPEALTQAIRLYQESASADVKAYFELHDDGSFTSDTIMAEAQKAG

SEQ ID NO: 6547 - protein, 336 aa, Enterobacter cloacae
PGCRLSKESMMSSVTTSGAPKSAFSFGRIWDQYGMLVVFAALFVACAIFVPNFATFINMKGLGLAISMSGMVACGMLFCLASGDFDLSVASVIACAGVTTAVVINMTESLWIGVLAGLLLGVLSGLVNGFVIARLKINALITTLATMQIVRGLAYIISDGKAVGIEDERFFTLGYANWLGLPAPIWLTVGCLILFGFLLNRTTFGRNTLAIGGNEEAARLAGVPVVRTKIIIFVLSGLVSAAAGIILASRMTSGQPMTSIGYELIVISACVLGGVSLKGGIGKISYVVAGILILGTVENAMNLLNISPFSQYVVRGLILLAAVIFDRYKQKAKRTV

SEQ ID NO: 6548 - protein, 305 aa, Enterobacter cloacae
  UNSURE (305)
PAQLLTIVDPLTGPPVLLTGRLLNGEHRHTVYTYMAVLFTVRRIRVADLLTAPPVLPGKFAFFFDLDGTLAGIEPHPDDVVVPDTVLENLQQLSRQNEGALALISGRSMAELDVLASPYHFPLAGVHGAERRDIHDQLHIVSLPDTLIQTLHAQLSSALEMLPGTELEAKGMAFALHYRQAPHHEAAIFSIARSVAEAHPELALQPGKCVVEIKPAGINKGAAIAAFMAEAPFKGRTPVFFGDDLTDEAGFRVVNQAQGMSVKVGSGETIAGWRLENVASVWQWISDVANQQQLFTTDCRPAHMX

SEQ ID NO: 6549 - protein, 139 aa, Enterobacter cloacae
KACGQTTAQRLKTSHRVRCSDKKTCFGRFFYVCGRREGDGRASVLLLWRPLNKENPMSQNLSADQELVSDVVACQLVIKQILDVIDVIAPVEVREKMSTQLKNIDFTNHPAAADPVTLRAIQKAIALIELRFTPQGESH

SEQ ID NO: 6550 - protein, 202 aa, Enterobacter cloacae
REKMKRCFTLFHSLRFMMANVAVLLAPGFEEAEAIITIDILRRLQIEVETLACAESRAVVSYHNIPMVADSTLTERINRLYDAVVLPGGPQGSVNLAANQEVIRFVSAHDEHGKLICPICSAAARVLGGNGLLKGRRYVCSGDLWQSVDDGVYVDAPVVEDNNLISGKGLGHAFDFALTLSARLLGVDSPVRDHAEHIYYRW

SEQ ID NO: 6551 - protein, 517 aa, Enterobacter cloacae
GARRTHYRNHGVVMQQSDPYLSFRGIGKTFPGVNALTDISFDCYAGQVHALMGENGAGKSTLLKILSGNYTPTTGTLAIRGEEVAFADTTAALNAGVAIIYQELHLIPEMTVAENIYLGQLPHKSGVVNRSLLNYEAGLQLKHLGLDVDPQTPLKYLSIGQWQMVEIAKALARNAKIIAFDEPTSSLSAREIENLFRVIRELRKEGRIILYVSHRMEEIFALSDAITVFKDGRYVRTFTDMQQVNHDQLVQAMVGRDLGDIYHWKPREYGPERLRLDNVKAPGVRTPISLSVRSGEIVGLFGLVGAGRSELMKGLFGGTRITQGQVFVDGKKVDIQKPAQAINAGIMLCPEDRKAEGIIPVHSVRDNINISARRKFIRAGCLINDGWEASNADHHIRSLNIKTPGAEQLIMNLSGGNQQKAILGRWLSEDMKVILLDEPTRGIDVGAKHEIYNVIYELAKRGVAVLFASSDLPEVLGVADRIVVMREGEIAGELLHEQANEQQALSLAMPKVSQAVA

SEQ ID NO: 6552 - protein, 346 aa, Enterobacter cloacae
VVRHYSLQIRMLKLEFTMHKFTKALAAIGLAAVMSQSAIAENLKLGFLVKQPEEPWFQTEWKFADKAGKDLGFEVIKIAVPDGEKTLNAIDSLAASGAKGFVICTPDPKLGSAIAAKARGYDMKVIAVDDQFVNAKGKPMDTVPLVMMAATKIGERQGQELYKEMQKRGWDVKETAVMAITADELDTARRRTTGSMDALKAAGFPEKQIYKVPTKSNDIPGAFDAANSMLVQHPEVKHWLVVGMNDNTVLGGVRATEGQGFKAPDVIGIGINGVDAVSELSKAQATGFYGSLLPSPDVHGYKSSEMLYNWVTKGAEPPKFTEVTHVVLITRDNFKEELAKKGLGGK

SEQ ID NO: 6553 - protein, 179 aa, Enterobacter cloacae
RTSSPTVNKDMRMTTHTMMQKLNAQMNLEFYASNLHLHLSAWCSRKSLNGTATFFRTQAQSNVTHMMRVFNFLKAVGANPTVKELETIEDNYTSLEELFQKTLEEYEQRCAKLSKLADEAKAQQDIITLTFLRDMDREQQQDGMLLKTLADEIRNAKRAGICLEQTDRHLLDIATVQHH

SEQ ID NO: 6554 - protein, 451 aa, Enterobacter cloacae
RGSIMITIEFIVIILCLLIGTRFGGMGLGLISGIGLFILSFVFGLQPGKPPVDVMLTILAVIGCAATLQTAGGLNVMMQFAERLLRKHPQHITLLAPFTTWMLTFLCGTGHVVYTMFPIIADIALKKGIRPERPMAVASVASQMAITASPVSVAVVSLVSILGAQHGIGHAWGILEILAVSVPASLSGVAIAALWSLRRGKNLADDTEFQEKLKDPKQREFIYGGTETLMDQRFPKQAYWSTWIFFAGIAVVVLLGALPELRPAFEIKGKMTALSMNLVIQMMMLIAGAIMLMTCKVNASAISNGAVFKAGMVAIFSVFGVAWMSDTFFQAHLDELKMALEGVVKSHPWTYAIVLFLVSKLVNSQAAALTAVAPMGLMLGIDPKMLVAFFPASYGYFVLPTYPSDLACIGFDRSGTTRIGKFIINHSFILPGLIGVSCACVVSYLLVQTFF

SEQ ID NO: 6555 - protein, 422 aa, Enterobacter cloacae
AGRKRMSENVSGKESRGLSPAALLVAGAFFMEFLDGTVIATALPDMAKSFGVQAVDLNIGISAYLITLAVLIPASGWIADRFGARKVFALALAIFTLASVFCGLSTTLDQFVAMRVLQGMGGALMVPVGRLAVLRTTPKHQLITAIATLTWPALVAPIIGPPLGGFITSYADWRWIFFINVPLGIIAILLALRIIPDLHEDTRRPFDLPGFVVTTLAMVSLVYAMELMGAEPLRTGLTATLFIVGIVALSLALRHFKRTTWPMIRLDAMQVPTFRVTLYGGSLFRASISAVPFLLPLMFQVGFGMDAFHSGLLVLAVFVGNLTIKPATTPLIRSLGFKRLLLINGALNVLALLACAFLTPQTPAWLVMLILYLGGVFRSIQFTAISTLAFADVPSVQMCYANILFSTATQRLDHGAGASACG

SEQ ID NO: 6556 - protein, 79 aa, Enterobacter cloacae
LTLRCEAEFNQRNRFLDRAERNRVRRSRMVGEIDVFQLGRHLFAYLNRRDNVNHIKDLFDNQLAGDDVRYQFLIGAQVL

SEQ ID NO: 6557 - protein, 211 aa, Enterobacter cloacae
SPSRGEKPLDISSTHYLDINHADIVARIDLTEWETNPESTRYLTFLKGRVGRKVADFFMDFLGASEGLNAKAQNKGLLQAVDDFTAEAQLDKSERQNVRQQVYSYCNEQLQAGEEIELESLSKELAGVSEVSFQEFTAEKGYELEESFPADRSTLRQLTKFAGSGGGLTINFDAMLLGERIFWDPATDTLTIKGTPPNLRDQLQRRTSGGK

SEQ ID NO: 6558 - protein, 238 aa, Enterobacter cloacae
KDFMRLDKFIAQQLGVSRAIAGREIRASRVTVDGDIVKDSAFKLQPEHQVEYDGNPLTQQNGPRYFMLNKPEGYVCSTDDPDHPTVLYFLDEPVAHKLHAAGRLDIDTTGLVLMTDDGQWSHRITSPRHHCEKTYRVTLESPVSDDTAEQFAKGVQLHNEKDLTKPAVLEIITPTDVRLTISEGRYHQVKRMFAAVGNHVVGLHRERIGAIELDPDLAPGEYRPLTEEEIASVGLPSR

SEQ ID NO: 6559 - protein, 404 aa, Enterobacter cloacae
IQENSVTTRPHSSFKIVFILGLLAMLMPLSIDMYLPALPVISAQFGVPAGSAQMTLSTYILGFALGQLFYGPMADSLGRKPVILGGTLIFAAAAVACALAQSIDQLIVMRFFHGLAAAAASVVINALMRDVYPKEEFSRMMSFVMLVTTIAPLVAPMVGGAVLVWFSWHAIFWILAIAALLASVMIFVFIDETLPVERRQKFHVRTTLGNFASLFRHKRVLSYMLASGFSFAGMFSFLSAGPFVYIELNHVSPQHFGYYFALNIVFLFVMTIINSRFVRRVGALNMFRAGLWIQFVMAIWLVLSALLGVGFWALVVGVAAFVGCVSMVSSNAMAVILDEFPHMAGTASSLAGTFRFGIGAIVGALLSTATFNTAWPMLWAIALCATCSILFYLYASRPRKTAHK

SEQ ID NO: 6560 - protein, 123 aa, Enterobacter cloacae
SKFASGDLNVNTLQLSIVHRLPQSYRWSTGFAGSKVEPIPQSVAGEDNCLVALKLLSPSDENAWPVMERLSQALTDIEVDSSVLECEGEPCLFVNSQDEFAATCRLKNFGVAIAEPFSGQYPF

SEQ ID NO: 6561 - protein, 132 aa, Enterobacter cloacae
KRMEQVAQRAIAHSIGQAVLNVAVESSAPTIAPIPKRNVPASDEAVPAICGNSSRITAIALDETIDTQPTNAATPTTSAQKPTPSNALNTSQIAITNWIHSPARNIFSAPTRRTKRLLIMVITNRNTIFSAK

SEQ ID NO: 6562 - protein, 591 aa, Enterobacter cloacae
LNREAMTFTLRPYQQEAVDATLAWFRKHREPAAIVLPTGAGKSLVIAELARLARGRVLVLAHVKELVAQNHAKYCALGLEADIFAAGLKRKESHGKVVFGSVQSVARNLELFRSEFSLLIVDECHRISDDDDSQYQQILTHLKKVNPHLRLLGLTATPFRLGKGWIYQFHYHGMVRGDEKALFRDCIYELPLRYMIKHGYLTPPERLDMPVVQYDFSRLQAQSNGLFSEADLNHELKKQKRITPHIISQIEEFAQTRKGVMIFAATVEHAREITGLLPADDAALITGETPGPERDSLIEDFKAQRFRYLVNVSVLTTGFDAPHVDLIAILRPTESVSLYQQIVGRGLRLAPGKTDCLILDYAGNPHDLYSPEVGTPKGKSDNVPVQVFCPACGFANTFWGKTTADGTLIEHFGRRCQGWFEDDEGHREQCDFRFRFKNCPQCNAENDIAARRCRECDTVLVDPDDMLKAALKLKDALVLRCSGMALQPGADEKGEWLKITYYDEDGADVSERFRVQTSAQRTAFEQLFIRPHTRTPGVPLRWLTVADIVRQQALLRHPDFVVARKKGQFWQVREKVFDYEGRFRRANELRG

SEQ ID NO: 6563 - protein, 344 aa, Enterobacter cloacae
GPLMSRLSPVNQARWARFRHNRRGYWSLWIFAVLFALSMCSELIANDKPLLVHFKDRWYVPVLTTYSESDFGGPFATPAEYQDPWLREQIAQHGWAIWAPIRFGANSINFATSTPFPSPPSAQNWLGTDANGGDVLARILYGTRISLLFGLMLTLFSSVMGVVAGAVQGYYGGKIDLWGQRVIEVWSGMPTLFLIILLSSVVQPGFWWLLGITVLFGWMALVGVVRAEFLRTRNYDYIRAAQALGVSDRAIIFRHMLPNAVVATLTFLPFILCSSITTLTSLDFLGFGLPLGSPSLGELLLQGKNNLQAPWLGITAFLSVAVLLSLLIFIGEAVRDAFDPNKAV

SEQ ID NO: 6564 - protein, 301 aa, Enterobacter cloacae
GPGLATFSENHTRAVRGLNPEVIAEITHRYGLNKPLHERYCRMLWDYVRFDFGDSLFRSASVLTLIKQSLPVSITLGLWGTLIIYLVSIPLGIRKAVYNGSRFDIWSSTFIIIGYAIPAFLFAVLLIVFFAGGSYFDLFPLRGLVSADFSTLPWYQKITDYFWHITLPVLATVIGGFAALTMLTKNAFLDEIRKQYVVTARAKGVGEKQIMWKHVFRNAMLLVIAGFPATFISMFFTGSLLIEVMFSLNGLGLLGYEATVSRDYPVMFGTLYIFTLIGLLLNIISDISYTLVDPRIDFEGR

SEQ ID NO: 6565 - protein, 547 aa, Enterobacter cloacae
FLLAKPCAMPSIPTRRYDMTRPLLSIENLSIAFSKQGESRTVVTDLSLQIQRGETLALVGESGSGKSVSALSVLRLLPSPPVSYPQGDILFHGQSLLNADEQTLRGIRGNNIAMIFQEPMVSLNPLHTLEKQLYEVLSLHRGMRKEAARGEILDCLERTGIRHAAKRLNDFPHQLSGGERQRVMIAMALLTRPELLIADEPTTALDVTVQAQILQLLRELRDELNMSLLFITHNLSIVKKLADAVAVMQNGRCVEQNRASALLSAPQHPYTQRLLDSEPAGDPVPLNADCAPLLSVEGLSVSFPIRKGILRRVVDHNHVLKDMSFALRPGESLGLVGESGSGKSTTGLALLRLIASQGSIVFDGMPLQNLNRRMMLPVRPRMQVVFQDPNSSLNPRLSVLQIIEEGLRVHQPTMTAQQREIDVKRVMEEVGLDPETRHRYPAEFSGGQRQRIAIARALILKPELIVLDEPTSSLDRTVQAQILALLKGLQEKHRLAYIFISHDLQVVRALCHQVVVLRQGEVVEQGECQRVFTAPTQDYTRQLLSAD

SEQ ID NO: 6566 - protein, 159 aa, Enterobacter cloacae
RQPDAGNLFFRQRAIFPWRQVWIEFNRADTFTMQPHNVVAHGGKHPFHLVIAAFTDGQAHVSWSDDFQHRRFGQIFFIMQLNAFCELLCRVIRDRRLKRHPIGFLTVMARGGDAMRPLAVIGHQHQAGGINIQSPCRMQLVRHRFVEEVEHRRVIRIVR

SEQ ID NO: 6567 - protein, 120 aa, Enterobacter cloacae
TDVTFRFVEHEVARAILLGQRVAVILHLVLRLEFKSAVFHNVAVHGYAAGANFTPGNSAAYAELLSDKLIKSHEIFLALMVLEVGLRVRKRSSQKQFSIMVWLRHSREKVSWHTICELTE

SEQ ID NO: 6568 - protein, 102 aa, Enterobacter cloacae
GFKYREKSMFTIEAEVRNVQGKGASRRLRTANKFPAIVYGGEAAPVAIELDHDKVWNMQTKAEFYSEVLTIVVGGKEEKVKVQAVQRHAFKPKLTHIDFVRA

SEQ ID NO: 6569 - protein, 495 aa, Enterobacter cloacae
EITMLLSSTRKDWLGNVRGDVLAGIVVALALIPEAIAFSIIAGVDPQVGLYSAFCIPLVMAFFGGRPAMISSSTGAMALLMVTLVKDHGLQYLLAASILTGVFQLIAGYLKLGGLMRFVSRSVVTGFVNALAILIFMAQLPELTNVTWHVYAMTAAGLGIIYLFPYINKTIPSPLVCIVVLTGIAMWLHLDVRTVGDMGKLPDSLPVFLLPDVPLNLQTLLIILPYSAGLAVVGLLESMMTATIVDDMTDTPSDKNRECKAQGIANICTSFIGGMAGCAMIGQSVINVKSGGRGRLSTLTAGVVLLCLIVFLRNWVSQIPMAALVAVMIMVSIGTFSWRSIANLRTHPLSTSVVMLATVAVVVATHNLAFGVLTGVLIASLNFATKVSRFMRVTSVLEGTSRTYTVTGQVFFASADRFTSHFDFREAIENVVIDVSHAHFWDITSVSALDKVVIKFRREGAGVEIRGMNEATRTIVDRFGVHDKPEEVEKLMGGH

SEQ ID NO: 6570 - protein, 281 aa, Enterobacter cloacae
QTGGKTMNNTVTACVDGSLSTRSVCEYAAWAARTLQSQLALLHVIEKDSTPVVSDLTGTLGIDSQQLLTDELVEIEGQRNRLLMAQGKAILESCAELLQKQGSPDVLLMQKHGTPDEVLAELSDLRLMVLGRRGSQHPVGSHLESVIRLQKKPLLVVPENYSVPSRVMLAYDGSEESRSNLERLTMSPLLRGLECHLVMVNGKKEELLTAQQILRDADIENSTTHLTGQSVGDALIRYAEENAVDLIVMGAYGHSRLRQFFIGSHTSEMLQKTQQPLLILR

SEQ ID NO: 6571 - protein, 241 aa, Enterobacter cloacae
LMKWRFFMTDLPAIEPAYFDDALASKLTGNNETMPRILILYGSVRERSYSRFAAEEAGRLLAKMGAEVKIFNPSGLPLPDDAPESHPKVLELRELVRWCDGMVWSSPERHGAMSSVMKAQIDWIPLSEGAVRPSQGKTLAVMQVCGGSQSFNTVNQMRILGRWMRMFTIPNQSSVPKAWQEFDDEGRMKPSPWYDRIVDVTEELFKMTLLLKGHTAYLSDRYSERKESHQELAARVNQAKI

SEQ ID NO: 6572 - protein, 511 aa, Enterobacter cloacae
FMHSYEDRIRAVELYYRYGKKASVVVMELGYPSTKQLGRWVRIYEEKGDLPRELKPRERYSRTQKIAAVEHYLTHGGCLSYTRRAIGYPSNEILKRWIEEFYPNARPLVIRSGTNKCFSPEERSQAVRELCNRRGTARKVAQSIGVSVPVLYKWKKDLISDEAYQSMRKRKAAPQDKNQDALLGEIQRLRQQVHQLQLERDILTKANELIKKDLGISFLTLKNREKTLIVDALKKKYPVAELLSVLQLARSCYFYHKASKRLCDKYAEIRVIMADIFEENYRCYGYRRLHAMLRGNNRVISEKVVRRLMAEEQLVVKRTRRRRYNSYCGEIGPAPENLLARDFSSCRPNEKWLTDITEFQLPAGKVYLSPVIDCFDGQVVSWSIGTRPDATLVNTMLDEALDTLNEHDKPVIHSDRGGHYRWPGWLDRINTSGLIRSMSRKGCSSDNAACEGFFGRIKNEMFYGRNWTGITLEKFICFLDRYIRWYNEKRIKLSLGAMSPVKYRQHLGITT

SEQ ID NO: 6573 - protein, 480 aa, Enterobacter cloacae
VKMSGVYNQVRITMTALAAEFFTLDEVNRLKIIQDVIDRRLTTQMAAQRLGISDRQCRRLLARYREDGPIGMTSRRRGKSSNNQLPQGLAAYALNIIRERYNDFGPTLACEKLSEVHGVHLSKETVRKLMTQASLWVPRKQRAPKIQQPRYRRACAGELIQIDGCDHHWFENRGPKCTALVYVDDATSRLMQLLFVKSESTFTYFEATRGYIEKHGKPLALYSDKASVFRINNKNATGGDGDTQFGRAMHELNIQTICAETSAAKGRVERAHLTLQDRLVKELRLQGISSMEAANAFAEEFMNDYNRRFAKAPRQEFDVHRELDVDDDLDMVFNWREARKVSKSLTVQYDKVLYLIEDSEFSRRAIGKYIDVWHYPDGHKELRLNGVSLPYSTYDKLSEIDQGAIVDNKRLGRALEMAQLVQAERDNNRSQSVPSGDGPSRRRKAPTTKKSQRSLDQDDMFNALVKLQSRSEEIFGKKPI

SEQ ID NO: 6574 - protein, 154 aa, Enterobacter cloacae
LDTFLVIPAYVPVQEADKFFQRDTSPVSAIEHFVFDTPEEAFTRSIIRRASFARHGPYKSGCVDTIEPARPPVMATTIAVYYRFIMFVERIECFIEHRIHQRRVRACSYRPAYNLAIKAVDNRRQIDFSSRKLELRNIGQPLLIWPAGTKIPGE

SEQ ID NO: 6575 - protein, 124 aa, Enterobacter cloacae
KLSHMKYHMYCYFFTRLSMLQPVQLFKLLADETRSTIVMLLRESGEMCVCDICAATAESQPKISRHMALLREAELVIDRREGKWVHYRLSPHMPAWAAGIIDTAWNCERENIRNKLSSVASVSC

SEQ ID NO: 6576 - protein, 433 aa, Enterobacter cloacae
MEFLMLLAGAIFLFTLVLVIWQPRGLGIGWSASLGAILALLTGVVHLGDIPVVWQIVWNATATFIAVIIISLLLDESGFFEWAALHVARWGNGRGRLLFTWIVLLGAMVAALFANDGAALILTPIVIAMLLALGFSRGATLAFIMAAGFIADTASLPLIVSNLVNIVSADFFKLGFSEYAAVMVPVNLAAIAATLVMLHLFFRKDIPAVYDVSLLKEPKDAIRDVNTFKTGWLVLVLLLVGFFGLEPLGVPVSLVAAAGALLLFAVAKKGHAINTGKVLRGAPWQIVIFSLGMYLVVYGLRNAGLTHYLSSLLNQLAEQGLWAATLGTGFLTAFLSSVMNNMPTVLVGALSIDGSTATGVIKEAMIYANVIGSDLGPKITPIGSLATLLWLHVLSQKNIKITWGYYFRVGIVMTIPVLFVTLAALALRLSFTL

SEQ ID NO: 6577 - protein, 144 aa, Enterobacter cloacae
DTDMSNITIYHNPACGTSRNTLEMIRNSGTEPTVIHYLETPPSRAELVKLIADMGITVRALLRKNVEPFEALGLAEDRFTDEQLIDFMLQHPVLINRPIVVTPLGTRLCRPSEVVLDILPDAQKSAFTKEDGEKVVDEKGNRLN

SEQ ID NO: 6578 - protein, 207 aa, Enterobacter cloacae
PPLCGFFIGDSLVAEEVKFVVVGHHTRTGQAQRLAALLDAHLLIDDGKHGANWNHRRALEWAAEQTCRVVVVEDDALPVHGFTEKVTDWLARFPDDMLSFYLGTGRPPQYQMQIAERLTVADKTRADYITLSRLIHGVCYSVPPEHVHRVLSRWDNSKPADYAVGDAWGGSVIYPCYSLVDHADGEPVERHPDSAPRTERRRAWRLA

SEQ ID NO: 6579 - protein, 161 aa, Enterobacter cloacae
EFSIMSGPPKTPTHLRLVRGNPSKRPINENEPKPPSGVPPTPKHFDKQGKYWFKRMADELDAIGVMSQLDARALELLVEAYTEYRHHCDTLEVEGYTYRTETQSGDVLIKAHPAAIMKADAWKRLRAMLGEFGMTPASRSKVNAKGPEAVDPLAEFMKARD

SEQ ID NO: 6580 - protein, 441 aa, Enterobacter cloacae
SHHGRFLMKKNKRPGRVKSALLNWLGVPISLTTGTFWEEWFGTSSSGKVVTADKAIQLSAVWACVRLLSESISTLPLKIYVRQPDGSRKAATDHPAYSILCRRPNSEMTPSRFMLMVVASICLRGNAFIEKKFIANRLVSLVPLLPQNMVVKRLVTGALEYKYTENGNERVIPVKNIMHIRGFGLDGVCGMMPMKTGRDVIGSAMAVEESAAKIFEQGLQSSGFLSAENALSDEQRERLRSYMAAFTGSKNAGKIMVLEGGLKYQGVTMNPEDAQMLESRSFSIEEICRWFRVPPFMVGHTTKQSSWASSLEGMNLQFLTHTLRPLLVNIEQEIGRCLLDSDDEVFAEFSVEGLLRADSAGRAAYYTSALQNGWMSRNDVRRLENMPPIEGGDIYTVQLNLTQLKNLESSNPAVQALALRELHNHIFPDISFEQSPLKQAA

SEQ ID NO: 6581 - protein, 135 aa, Enterobacter cloacae
ASPRLSATHRTPPGVEVSLMPALIPRACRKRGCPGTTTDRSGYCPKHLNEGWQQHQRGQSRHQRGYGSKWDRLRPIVLGRDKHLCQECLRNGRYTPAETVDHITAKANGGTDDLSNLESLCKPCHRAKTAVERLK

SEQ ID NO: 6582 - protein, 589 aa, Enterobacter cloacae
SAGRVYESEGLMAKVAEGIRYAERVVAGEIIACEYVRLACQRFLDDLAHGEERGIFFSEPRAQHILNFYNFVPHVKGALAGQPIELMDWHVFILINIFGFVIPLVNEETGETVLRNDGSGRPVMVRRFRTADVEVARKNAKSTLCSGVGLYMAGADGEGGAEVYSAATTRDQARIVFEDAKNMVKKAKATLGRIFEFNKLAIYQEQTASKFEPLSSDANNLDGLNIHCAIVDELHAHKTRDVWDVLETATGARLQSLLFGITTAGFNKEGICYELRDYAIKVLRGLVKDDTFFAIIYTLDEGDDPFDEKVWQKANPGLGICKRWDDLRRLAKKAKEQVSARINFFTKHMNIWVTAESAWMDMMKWEKCEFIAPQHELKTYPSWVGVDLSNKIDICAAAKVWRAPDGHVHADFKFWLPEGRLEKCSRQMAELYRKWAGMDKLILTDGDVIDHAQIKEELQLWVAGESLKEIGFDPWSATQFSLALAEEGLPLVEVPQTVRNFSEAMKEVEALVYGGRFHHSDHPVMNWMMSNVTVKPDRNENIFPNKSTPEAKIDGPAALFTAMSRVLVNGGNDQQDLSGFFNNPIMVGF

SEQ ID NO: 6583 - protein, 291 aa, Enterobacter cloacae
NRPLRSTFLMSKKQLPAAPAGRPCARVTCETLPSALDRWDGGIKAAATDDNSISVFDVIGQDYWGEGVTAKRIAGALRAMNGADVTVNINSPGGDMFEGLAIYNLLREYEGRVTVKVLGIAASAASVIAMAGDDILIGRGAFLMIHNCWVYAMGNRHDFAELAQSLEPFDNAMADIYAARSGLDMAAVQKLMDAESYIGGSDAVAKGLADSLLSADAVSDGDESPAAALRKLDALLAKTNTPRSERRKLIKALSGGMPGAVTTNDGTPGAAEDIKPETLNSLESALAALVK

SEQ ID NO: 6584 - protein, 416 aa, Enterobacter cloacae
AGRINMGLKHLFEKIEPHFTEGKLKKYYPLYEATTTIFYTPGLVTKGAAHVRDAIDLKRMMILVWFAVFPAMFWGMYNVGLQTIPALHHMYDAEQLAQVIQSDWHYRLAQSLGVSFAADAGWISMMTLGAVFFLPIYMTVFIVGGFWEVLFAIIRKHEINEGFFVTSILFALIVPPTLPLWQAAMGISFGVVIAKEIFGGTGRNFLNPALAGRAFLFFAYPAQISGDLVWTAADGFSGATPLSQWAAGGGETLVNNATGQPVTWFDAFIGNIPGSIGEVSTLMILIGGAIILFGRVASWRIVAGVMLGMVLTATLFNFIGSDTNPMFSMPWYWHLVLGGFAFGMMFMATDPVSASFTDRGKWCYGALIGVMCVLIRVVNPAYPEGMMLAILFANLFAPLFDYLVVRANIKRRKARG

SEQ ID NO: 6585 - protein, 408 aa, Enterobacter cloacae
QMEIILGVVMFTLIVLVLSGLILAARAKLVNSGDVIIDINDDPQNQIRTPAGDKLLNTLSGNGIFVSSACGGGGSCGQCRVTVKEGGGDILPTELSHITKREAKEGCRLACQVAVRQNMKIELPEEIFGVKKWECEVISNDNKATFIKELKLRVPEGESVPFRAGGYIQIECPAHTVAYADFDVPEEYRADWDKFNLFRFVSEVKEPALRAYSMANYPEEKGIIMLNVRIATPPPNVPDAPPGVMSSYIWSLKPGDKVTISGPFGEFFAKDTDAEMVFIGGGAGMAPMRSHIFDQLKRLGSKRKISFWYGARSLREMFYDDEFEQLARDNPNFTFHVALSDPQPEDNWTGYTGFIHNVLYENYLKQHPAPEDCEFYMCGPPMMNAAVIKMLKDLGVEDENIMLDDFGG

SEQ ID NO: 6586 - protein, 162 aa, Enterobacter cloacae
AVYKQAGTLHMSEKYVVTWDMLQIHARKLAARLMPSEQWKGIIAVSRGGLVPGALLARELGIRHVDTVCISSYDHDNQRELKVLKRAEGDGEGFIVIDDLVDTGGTAVAIREMYPKAHFVTIFAKPAGRPLVDDYVIDIPQDTWIEQPWDMGVVFVPPISGR

SEQ ID NO: 6587 - protein, 482 aa, Enterobacter cloacae
LAFRRARRRICCPWQGLKWYTPVSLDCCSWIPANHMFRIRKGLDLPISGVPEQHVTTGASIHHVAIVGDDYVGMRPAMLVQEGDRVIKGQALFEDKKNPGVMFTAPASGTVVAIHRGERRVLQSVVIQIEGDEKREFARFDAADLATLSHDVVQTQLLESGLWTALRTRPYSKTPVPGTVPAAIFVTAIDTNPLSADPQPLILAERKAFDAGLAVLTRLTPGKVHVCQACGGKLGGHPQGQVAFNEFAGPHPAGLVGTHIHFLEPVSLTKQVWHLNYQDVIAIGKLFTTGELCAERIIAIGGPQATQPRLVRTLLGADLTALLAGETKEGENRIISGSVLSGRHATGPMAWLGRFHLQVSVVLEGRDKELFGWVLPGAEKYSVTRTTLGHFLRHKLFNFSTSTNGGERAMVPIGNYERVMPLDILPTVLLRDLLAGDTDGAQALGCLELDEEDLALCTYVCPGKYEYGPVLREVLTRIEQEG

SEQ ID NO: 6588 - protein, 292 aa, Enterobacter cloacae
CWPFCLPICLRRCSTTWSCAPTLNGGRRVAEIKNNDSISKTLLVVLVLCLVCSIVVAGSAVGLKPLQQEQRALDKQRNILAVAGLMQEGMTKDDVAAVFAERITARLVDLKTGELMDKDPAKYNQALALKDPQMSTTLDASQDPAGIKRRSNVAEIYLVRDEQKRIQKIVLPIYGNGLWSMMYAFVALDTDGRTVKGITYYDQGETPGLGGEVENPNWRAQFVGKKVLDDNGQPALKVVKGGARPGDEFAVDGLSGATLTSNGVQHSFDFWMGELGFGPFLKNVREGALNNG

SEQ ID NO: 6589 - protein, 355 aa, Enterobacter cloacae
GLTMRKIIHVDMDCFFAAVEMRDNPALRDIPIAIGGSRVQRGVISTANYPARKYGVRSAMPTAMALKLCPHLTLLPGRFDAYKEASSHIREIFSRYTSLIEPLSLDEAYLDVTHSVHCHGSATLMAQEIRQTIFNELNLTASAGVAPVKFLAKIASDLNKPNGQYVITPEEVSAFLKTLPLSKIPGVGKVSAAKLESMGLRTCEDVQRSDLALLLKRFGKFGRVLWERSQGIDDRDVNNERLRKSVGVERTLSEDIHDWTECETIITEQLYPELERRLLKVKPDLLIARQGIKLKFNDFQQTTQEHVWPRLNKEDLIATAKKAWEERRGGRGVRLVGLHVTLLDPQLERQLVLGL

SEQ ID NO: 6590 - protein, 213 aa, Enterobacter cloacae
IMADTGELKEVKKVLIGPLLANNPITLQVLGVCSALAVTTKLETAVVMTLAVTLVTAFSSMFISMIRHHIPNSVRIIVQMAIIASLVIVVDQLLRAFAYETSKQLSVFVGLIITNCIVMGRAEAYAMKMPPLASFMDGIGNGLGYGVILLTVGFLRELIGSGKLFGIPVLDTVQNGGWYLPNGLFLLAPSAFFIIGLLIWLIRTLKPEQQEKE

SEQ ID NO: 6591 - protein, 200 aa, Enterobacter cloacae
PTMAHYLSLFVRAVFVENMALAFFLGMCTFLAVSKKVSTAFGLGVAVTVVLGLSVPINNLVFNFVLRDGALVEGVDLSFLNFITFIGVIAALVQILEMILDKYFPSLYNALGIFLPLIAVNCAIFGGVSFMVQRDYNFSESVVYGFGSGIGWMLAIVTMAGIREKMKYANVPAGLRGLGITFITTGLMALGFMSFSGVQL

SEQ ID NO: 6592 - protein, 71 aa, Enterobacter cloacae
FRRLIMLTFLATFAVFVLVIFGMSLGWIIKRKSIQGSCGGISSIGMEKVCDCPEPCDARKKRMAREQQRII

SEQ ID NO: 6593 - protein, 185 aa, Enterobacter cloacae
PATLFCSASTRRPIVSELSQLSPQPLWDIFAKICSIPHPSYHEEQLAEHIMGWAKEKGLHAERDQVGNILIRKPATAGMENRKPVVLQAHLDMVPQKNNDTVHDFTKDPIQPYIDGEWVKARGTTLGADNGIGMASALAVLADDSVEHGPLEVLLTMTEEAGMDGAFGLHANWLQADILINTDSE

SEQ ID NO: 6594 - protein, 313 aa, Enterobacter cloacae
QGEIYMGCAGGIDFISTLPLSREAIPAGFETFKLTLKGLKGGHSGGDIHLGLGNANKLLARFLAGHAAELDLRLVDFNGGTLRNAIPREAFATLAVPASKADELKNLSSVYLEILKNELSAKEKNLTVVLESVTTDKAALTAQSRDTFVQLLNATPNGVIRNSDVAKGVVETSLNVGVVTMGDDSAEIICLIRSLIDSGKEYVVSMLESLGTLAGAKTSAKGSYPGWQPDASSPVMALVRETYQRLFNSTPNIQVIHAGLECGLFKKPYPDMDMVSIGPTITGPHSPDEQVHIESVGHYWTLLTELLKAIPAK

SEQ ID NO: 6595 - protein, 566 aa, Enterobacter cloacae
YCLRGCPAPVVKTIEQMRLSATKALLERRDVVVVASVSAIYGLGDPDLYLKMMLHLTQGMIIDQRAILRRLAELQYTRNDQAFQRGTFRVRGEVIDIFPAESDDMALRVELFDEEVERLSLFDPLTGHVESVIQRFTIYPKTHYVTPRERIVQAMEEIKIELADRRKVLLANNKLLEEQRLSQRTQFDLEMMNELGYCSGIENYSRYLSGRGPGEAPPTLFDYLPADGLLVIDESHVTIPQIGGMYRGDRARKETLVEYGFRLPSALDNRPMKFEEFEALAPQTIYVSATPGNYELEKSGDDVVDQVVRPTGLLDPIIEVRPVATQVDDLLSEIRARSAINERVLVTTLTKRMAEDLTEYLEEHGEKVRYLHSDIDTVERMEIIRDLRLGEFDVLVGINLLREGLDMPEVSLVAILDADKEGFLRSERSLIQTIGRAARNVNGKAILYGDKITPSMAKAIGETERRREKQQRYNEEHGITPQGLNKKVVDILALGQNIAKTKAKGRGKARSVVEEDTVALTPKALQQKIHELEGQMMQHAQNLEFEEAAQIRDQLHQLRDLFIAAS

SEQ ID NO: 6596 - protein, 83 aa, Enterobacter cloacae
KAMIKVLFFAQVRELVNTDSLTLDGSFENVAALRAHLAAQGDRWALALDEGKLLAAVNQTLVELTHPLADGDEVAFFPPVTGG

SEQ ID NO: 6597 - protein, 147 aa, Enterobacter cloacae
ISREKSFRREAMKWQQRVRVATGLSCWQIMLHLLVVAVLVMGWMSGTLVRVGLGLCVVYGVTVLSMLFLQRHHDARWREVGDVLEELTTTWYFGAAMIVLWLLSRVLQNNLLLALAGLAILAGPAVVSLLTKEKKLRDVSSKHRIGH

SEQ ID NO: 6598 - protein, 170 aa, Enterobacter cloacae
PTRWPMGTKWPSSRRSQGVKMTETRILVGPERFSVGTEYSWLAERDEDGAVVTFTGKVRNHNLGDSVKALTLEHYPGMTEKSLAAIVEEARGRWPLGRVTVIHRIGEMWPGEEIVFVGVTSAHRGSAFAAGEFIMDYLKTKAPFWKREATPEGERWVESRDSDKHAASRW

SEQ ID NO: 6599 - protein, 403 aa, Enterobacter cloacae
KCTITSLCINLYSEKRQWRSGDFHATIAITTFSKLKTYTLALAPVSRDMAPWPWRICHQGTERNDCASRSGKVYMASQLTDAFARKFYYLRLSITDVCNFRCTYCLPDGYKPGSVTNNGFLSVDEVRRVTRAFSELGTEKVRLTGGEPSLRRDFPDIIAAVRENERIRQIAVTTNGYRMARDVANWRDAGLTAINVSVDSLDARQFHAITGQDKFRQVMDGIDAAFTAGFEKVKVNTVLMRDVNHHQLDTFLAWIKSRPIQLRFIELMETGEGSELFRRHHISGMVLRDELLKRGWIHQIRQRSDGPAQVFCHPDYEGEIGLIMPYEKDFCASCNRLRVSSVGKLHLCLFGDGGVDLRDLLEDDAQQDALEARISEALTHKKQTHFLHQGNTGITQNLSYIGG

SEQ ID NO: 6600 - protein, 178 aa, Enterobacter cloacae
SGFRRNQKMSQVSAEFIPTRIAILTVSERRGEEDDTSGHWLREAAHEAGHQIVDKAIVKENRYAIRAQVSQWIANDDVQVVLITGGTGFTAGDQAPEALLPLFDREVEGFGEVFRMLSFEEIGTSTLQSRAVAGVANKTLIFAMPGSTKACRTAWENIIAPQLDARTRPCNFHPHLKK

SEQ ID NO: 6601 - protein, 162 aa, Enterobacter cloacae
AMSQLTHINAAGEAHMVDVSAKAETVREARAEAFITMLPETLAMIIDGSHHKGDVFATARIAGIQAAKRTWDLIPLCHPLMLSKVEVNLQAQPAHNRVRIESLCRLTGKTGVEMEALTAASVAALTIYDMCKAVQKDMVIGPVRLLAKSGGKSGDFKVESHD

SEQ ID NO: 6602 - protein, 236 aa, Enterobacter cloacae
IMDRFPRSDSIVQQTRSGLQTYMAQVYGWMTVGLLLTAFIAWYAANTPELMMFIFSSKITFFGLIIAQLALVFVLSGLVHKLSSGMATTLFMLYSALTGLTLSSIFIVYTYSSIASTFVVTGGMFGVMSLYGYTTKRDLSGFGNMLFMGLIGIVLASLVNLWLKSDALMWAVTYIGVVIFVGLTAYDTQKLKNIGEQIDVRDSSNLRKYSILGALTLYLDFINLFLMLLRIFGNRR

SEQ ID NO: 6603 - protein, 432 aa, Enterobacter cloacae
KARGPNFPRGENFGGQVANPFSGGGEFPGGADFQTRCFKGVGRGSLFGWEGGETHTGGWIRGRAFFRGYGPLIAKGRQSMVRERRTRAIMGLPVLVPVVLFRFAPTVEVTTATFAIYNEDNGKHSVELTQRFARAKAFTHVLLLQSPQAIQPTIDTQKALLLVRFPADFSRNLDTFQTAPMQLILDGRNSNSAQIAANYLQQVVKDYQQELMDGKPKPNNSELVVRNWYNPNLDYKWFVVPSLIAMITTIGVMIVTSLSVAREREQGTLDQLLVSPLATWQIFVGKAVPALIVATFQATIVLGVGIWAYQIPFAGSLALFYFTMVIYGLSLVGFGLLISALCSTQQQAFIGVFVFMMPAILLSGYVSPVENMPVWLQDLTWINPIRHFTDITKQIYLKDASLDIVWGSLWPLLVIAATTGSVAYAMFRRNIA

SEQ ID NO: 6604 - protein, 384 aa, Enterobacter cloacae
VHGAETELVERGHRRGGVPLPAPLPGHGGLAARAYAETGAGGSACATRNGNPGPRRGGRWRENLMSKSHPRWRLAKKILTWLFFIAVAVLLVVYAQKVDWEEVWKVIRNYNRTVLLGAVGLVIVSYLMYGCYDLLGRAYCGHKLAKRQVMLVSFICYAFNLTLSTWVGGIGMRYRLYSRLGLPGGTITRIFSLSITTNWLGYILLGGVIFTIGVVQLPAHWYIDEATLRILGIVLLLIIAAYLWACAFAKRRHMTIKGQKLVLPSWKFAVLQMVVSSANWMAMGAIIWLLIGEDVNYFFVLGVLLVSSIAGVIVHIPAGIGVLEAVFIALLAGEHVSHGTIIAALLAYRMIYYFLPLALATVCYLVLESRAKKLRAKNEKAMAK

SEQ ID NO: 6605 - protein, 305 aa, Enterobacter cloacae
GIGMRNRTFADLDRVVALGGGHGLGRVMSSLSSLGSRLTGIVTTTDNGGSTGRIRRAEGGIAWGDMRNCLNQLITEPSVASAMFEYRFGGNGELSGHNLGNLMLKALDHLSVRPLEAINLIRNLLKVDAFLIPMSEQPVDLMAIDADDHEVYGEVNIDQLLLPPKELMTYPSVPATREAVEAIGEADLILIGPGSFYTSLMPILLVKELAQALRRTPAPMVYIGNLGRELSPAAASLSLADKLDLMEQYVGKKIIDGVVVGPKVDVSGIGDRVVVQEPLEASDIKYRHDRHLLREALEKAIQALG

SEQ ID NO: 6606 - protein, 101 aa, Enterobacter cloacae
SPRKVFMSKKTQHFSLKVLTINIHKGFTAFNRRFILPELRDAVRTVSADIVCLQEVMGAHEVHPMHFENWPDTPHYEFLADTMWSDYAYGRNAVYPEGASR

SEQ ID NO: 6607 - protein, 447 aa, Enterobacter cloacae
PHLRKKCPRQQPDGAGFTQLATSLRPCPTQRGDPLMKCTWQEGNRITLLENGDNYYPAVFEAISHAQQKVFLETFIWFEDDVGRQLHSALLHAARRGIKIEVLLDGYGSPDLSDEFVNELTAAGVVFRYYDPGPRLFGMRTNLFRRMHRKIVVVDETVAFVGGINYSAEHMSDYGPEAKQDYAIRIEGPVVQDIQLFVLENLPGKEAARRWWRRRHRPEENRKPGEAQALFVWRDNEEHRDDIERHYLKMLANAKREVIIANAYFFPGYRILHAMRNAARRGVSVKLIVQGEPDMPIVKVGARLLYRYLVKSGVQIYEYRRRPLHGKVAVMDDHWATVGSSNLDPLSLSLNLEANLIIHDRQFNHTLRDNLQGLINKDCVRVDESMVPKRSWWNVGIGVVVFHFLRHFPAMVGWLPAHTPKLALVDPPVQPEMETQDRVEAEDGGKT

SEQ ID NO: 6608 - protein, 238 aa, Enterobacter cloacae
TFIRASQHLTAASFYRSCATRYAPSAPILSASRRSWARMKCTRCISKTGPTRPTTSFWRIPCGAITPTGAMRSTRRGHHGNAVLSRFPIEHYENRDVSVGESEKRGLLYCRITPPELDFPIHVGCVHLGLREAHRQAQLQMLADWTNALPEGEPVVVAGDFNDWRQRANHPLKVNAGLEEIFTRARGRPARTFPVRFPLLRLDRIYVKNAHASSPTALALLNWRHLSDHAPLSAEIHL

SEQ ID NO: 6609 - protein, 238 aa, Enterobacter cloacae
KSPVTETSIMNSKRYERICEMLARRQPDLTVCMEQVHKPHNVSAIVRTADAVGVHEVHAVWPGARMRTMASTAAGSNSWVSVKTHQTIGEAVSHLKGRGMQVLATNLSAKAVDFREIDYTRPTCILMGQEKTGITQEALDLADRDIIIPMIGMVQSLNVSVASALILYEAQRQRQNAGMYERSNSMLPEEEQQRLLFEGGYPVLARVAKQKKLPYPHVNAQGEIEADAEWWSTMQYAG

SEQ ID NO: 6610 - protein, 694 aa, Enterobacter cloacae
IMKGRLLDAIPLNSLTGVGAAQSSKLAKIGLHTVQDLLLHLPLRYEDRTQLYKIGDLLPAIYATVEGEVLNCNITFGGRRMMTCQISDGTGILTLRFFNFNAAMKNSLATGRRVLAYGEAKRGKYGAEMIHPEYRVQGDLSSPELQETLTPVYPTTEGIKQATLRKLTDQALELLDTCAINELLPPELAQGMMSLPEALRTLHRPPPTLQLVDLESGKHPAQRRLILEELLAHNLSMLALRAGAQRFHAQPLSQRDELKDKLLASLPFKPTGAQARVTAEIERDMALDVPMMRLVQGDVGSGKTLVAALAALRAIAHGKQVALMAPTELLAEQHANNFRNWFAPLGIEVGWLAGKQKGKARLAQQEAIASGQVQMIVGTHAIFQEQVQFNGLALVIIDEQHRFGVHQRLALWEKGLQQGFHPHQLIMTATPIPRTLAMTAYADLDTSTIDELPPGRTPVTTVAIPDTRRSDIIDRVRNACTHEGRQAYWVCTLIEESELLEAQAAEATWEELKLALPELNVGLVHGRMKPAEKQAVMQSFKQGELHLLVATTVIEVGVDVPNSSLMIIENPERLGLAQLHQLRGRVGRGAIASHCVLLYKAPLSKTAQMRLQVLRDSNDGFVIAQKDLEIRGPGELLGTRQTGNAEFKVADLLRDQAMIPEVQRLARHIHERYPEQAAALIERWMPETERYSNA

SEQ ID NO: 6611 - protein, 474 aa, Enterobacter cloacae
NARFSTVGLPPMSVNTLESADAQPIAQKQNSELIYRLEDRPPLPQTLFAACQHLLAMFVAVITPALLICQALGLPAQDTQHIISMSLFASGVASIIQIKAWGPVGSGLLSIQGTSFNFVAPLIMGGTALKTGGADVPTMMAALFGTLMLASCTEMIISRVLHLARRVITPLVSGVVVMIIGLSLIQVGLTSIGGGYAAMSDHTFGAPKNLLLAGVVLAIIILLNRQRNPYLRVASLVIAMAAGYLLAWALGMLPENTTPTNSALITVPTPLYYGLGIDWSLLLPLMLVFMITSLETIGDITATSDVSEQPVSGPLYMKRLKGGVLANGLNSFVSAVFNTFPNSCFGQNNGVIQLTGVASRYVGFVVALMLVVLGLFPAVSGFVQHIPEPVLGGATLVMFGTIAASGVRIVSREPLNRRAIMIIALSLAVGLGVSQQPMILQFAPDWVKNLLSSGIAAGGITAIVLNLIFPPEKN

SEQ ID NO: 6612 - protein, 109 aa, Enterobacter cloacae
THFQYHAQSFLHLWSILSMARVTVQDAVKKIGNRFDLVLVAARRARQMQVGGKDPLVPEENDKTTVIALREIEEGLINNQILDVRERQEQQEQEAAELQAVTAIAEGRR

SEQ ID NO: 6613 - protein, 575 aa, Enterobacter cloacae
HPYVRFAGRKTMKFIGKLLIYLLVALLIVVLAFYFLLQTRWGASQVSSWITVNTDYELNFDLMDHRFSSPSHILLENVTFGRDGKPATLVAKKVDIGLSSRQITDPLHMDAITLFDGTLNLSPQTAPLPFQADRLQLNNMAFNSPNTEWDLSAQKVTGGVSPWQPEAGNVLGKNAQIQMSAGSLTLNGIPANNVLIQGQLNGKEVALNTIGADMARGSLTGSALRNADGGWVINTLRLNEIRLQSDKSLLDFFAPLSTLPSLQIGRLEVTDARLQGPDWAVTDLDLSLRNLTLSKGDWQSQEGRLSMNASEFIYGSLHLFDPILNAEFSPQGIALRQFTSRWEGGMVRTSGNWLREGQALVLDDVAIAGLEYTLPENWKTLWMDPLPAWLNSVTLKKFGLSRNLVIDIDPAFPWQITSLDGYGANLRLAQDHKWGVWGGNATLNGAAATFNRVDVRRPSLALNANAATVNITDLSAFTEKGILEATATVSQLPQRQTTVSLNGRGVPLNVLQQWGWPALPIAGDGNIQLTASGSVQANAPLKPTVNGKLSAVNMDKQQVQQTMTGGVVSTVAPAQ

SEQ ID NO: 6614 - protein, 709 aa, Enterobacter cloacae
TCGSPLYLFESLNQLIQTYLPEDQIKRLQQAYLVARDAHEGQTRSSGEPYITHPVAVACILAEMKLDYETLMAALLHDVIEDTPATYQDMEQLFGKSVAELVEGVSKLDKLKFRDKKEAQAENFRKMIMAMVQDIRVILIKLADRTHNMRTLGSLRPDKRRRIARETLEIYSPLAHRLGIHHIKTELEELGFEALYPNRYRVIKEVVKAARGNRKEMIQKILSEIEGRLQEAGIPCRVSGREKHLYSIYCKMVLKEQRFHSIMDIYAFRVIVHDSDTCYRVLGQMHSLYKPRPGRVKDYIAIPKANGYQSLHTSMIGPHGVPVEVQIRTEDMDQMAEMGVAAHWAYKEHGGESSTTAQIRAQRWMQSLLELQQSAGSSFEFIESVKSDLFPDEIYVFTPEGRIVELPAGATPVDFAYAVHTDIGHACVGARVDRQPYPLSQPLFSGQTVEIITAPGARPNAAWLNFVVSSKARAKIRQLLKNLKRDDSVSLGRRLLNHALGGSRKLAEIPPENIQHELERMKLASLDDLLAEIGLGNAMSVVVAKNLQQGETTAVPATTQNHGHLPIKGADGVLITFAKCCRPIPGDPIIAHVSPGKGLVIHHESCRNIRGYQKEPEKFMAVEWDKETAQEFITEIKVDMFNHQGALANLTAAINTASSNIQSLNTEEKDGRVYSAFIRLTARDRVHLANIMRKIRVMPDVIKVTRNRN

SEQ ID NO: 6615 - protein, 404 aa, Enterobacter cloacae
QEPFMIHLDTLSTLVAATLVLLLGRKLVHSVSFLKKYTIPEPVAGGLLVALALLILKKSMGWEIDFDMSLKDPLMLAFFATIGLNANLASLRSGGKVLGVFLIVVVGLLLMQNAIGIGMASLLGLDPLMGLLAGSITLSGGHGTGAAWSKLFIERYGFENATEVAMACATFGLVLGGLIGGPVARYLVKHSTTPEGRPDDEMVPTAFEKPDVGRSITSLVMIETIAMIAICLTVGKIVAQWLAGTAFELPTFVCVLFIGVILSNGLAQMGFYRVFERAVSVLGNVSLSLFLAMALMSLKLWELASLALPMVAILAVQAVFMALYAIFVTWRMMGKNYDAAVLAAGHCGFGLGATPTAIANMQAITERFGPSHMAFLVVPMVGAFFIDIVNALVIKLYLMLPMFG

SEQ ID NO: 6616 - protein, 194 aa, Enterobacter cloacae
AHDKVQPGGVRTCPRRGNDLHRLSAEKRLRQRIRLPVDAGTYAGVADIGMHGVSEVDRCRARRQFDNAPFRRENVNLIREEIGFNALDKFKRATCALLQLQQALHPALGADLRGGAAFAAVLFVSPVRRDTHLRHLIHIFGTNLHLNRDTVRANHGGVQRLISVRFWNGDVIFDAPRTRLVQAVHLPQHAITGV

SEQ ID NO: 6617 - protein, 84 aa, Enterobacter cloacae
VMANIEIYTKATCPFCHRAKALLSSKGVTFKELPIDGDAIKREEMIQRSGRTTVPQIFIDAQHIGGCDDLYALDARGGLDPLLS

SEQ ID NO: 6618 - protein, 361 aa, Enterobacter cloacae
CAVHELSTAAGWRRCRTTSGCLMSTVNASMTVIGAGSYGTALAITLARNGHDVVLWGHDPKHIATLQHDRCNVAFLPDVPFPDSLYLESDLATALAVSRNILIVVPSHVFGEVLRQIKPLMRADARIVWATKGLEAETGRLLQDVAREALGTAIPLAVISGPTFAKELAAGLPTAISLASTDQAFSDDLQQLLHCGKSFRVYSNPDFIGVQLGGAVKNVIAIGAGMSDGIGFGANARTALITRGLTEMSRLGEALGADPATFMGMAGLGDLVLTCTDNQSRNRRFGMMLGQGSDVKSAQEKIGQVVEGYRNTKEVRELAHRFGVEMPITEEIYQVLYCGKNAREAALTLLGRARKDERSSN

SEQ ID NO: 6619 - protein, 291 aa, Enterobacter cloacae
MTQPAQNWLVINYRLEQAMPCEELDIVWNNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNEGRRALAIFLQNQVSVTFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPDSDKPSMDMDQHFNGIHHTFEYGDGI

SEQ ID NO: 6620 - protein, 152 aa, Enterobacter cloacae
SLSRELLPPMQEIMQFVSRHPVLSIAWIGLLVAVLFTTFKGLTSKIKVITRGEATRLINKEDAVVVDLRQRDDFRKGHIAGAINLLPAEIKANNIGELEKHKAQPIIVVDGTGMQAQESANALHKAGFENVTVLKEGISGWSGENLPLVRGK

SEQ ID NO: 6621 - protein, 167 aa, Enterobacter cloacae
ARDFRTIKKGFSMSEQNNTEMTFQIQRIYTKDVSFEAPNAPHVFQKDWQPEVKLDLDTASTQLADDVYEVVLRVTVTASLGEETAFLCEVQQGGIFSIGGIEGNQMAHCLGAYCPNILFPYARECITSLVSRGTFPQLNLAPVNFDALFMNYLQQQAGEGAEQHQDA

SEQ ID NO: 6622 - protein, 172 aa, Enterobacter cloacae
SKARCIDSPGFFIWLFRRSDAVAVFEGVVNTVEVLIHIHRRLIAVWLTDDARRDASGGGVRRYRLEHNRPRANLRAASDFNIAEDFSTRANHHPFTNFRMAIAAGFTGTAQRNGLQDRHVIFDHRRFTDNNAGGVVEHDPTANFRRRMNIDLEGHGNLVLKKDGQRAASLIP

SEQ ID NO: 6623 - protein, 528 aa, Enterobacter cloacae
NYAKFLSLEHEVVAMSVSKKPMVLVILDGYGYREDQQDNAIFNAKTPVMDALWAKRPHTLIDASGLEVGLPDRQMGNSEVGHVNLGAGRIVYQDLTRLDVEIKERTFFANPTLTGAVDKAVAAGKAVHIMGLLSAGGVHSHEDHIMAMVELAAERGAEKIYLHAFLDGRDTPPRSAKGSLEAFEDKFAALGKGRVASIIGRYYAMDRDNRWDRVEQAYDLLTLAKGEFQFPTAVEGLEAAYARDENDEFVKATVIRAEGQADAAMEDGDALIFMNFRADRAREITRAFVNSDFDGFARKKVAKIDFIQLTEYAADIKAPCAYPPASLANTFGEWMAKNDKTQLRISETEKYAHVTFFFNGGVEEPFKGEDRILINSPKVATYDLQPEMSSAELTEKLVAAIESGKYDTIICNYPNGDMVGHTGVMEAAVKAVEALDHCVEQVAKAVESVGGQLLITADHGNAEQMRDPATGQAHTAHTNLPVPLIYVGDKSVKAVEGGKLSDIAPTMLSLMGMEIPEEMTGKPLFIVE

SEQ ID NO: 6624 - protein, 430 aa, Enterobacter cloacae
SLPMRGKAIFSITWVMKPLRLSVRPLLCASALSAGVLLCAASAHADDRDQLKSIQADIAAKERAVRQQQQQRATLLAQLKKQEEAISAAARKLRETQNTLAQLNKQIDEMNASIAKLERQRDAQERNLAAQLDAAFRQGEHTGLQLILSGEESQRGQRLQAYFGYLNQARQETIAQLKQTREEVTTQKAELEEKQSQQQTLLYDQQAQQEKLEQARNERKKTLAGLESSIQAGQSQLSEMRANESRLRNSIARAEAAAKARAEKEAREAQAVRNKQQEASRKGTTYKPTENERSLMSRTGGLGSPRGQAYWPVRGTILHRYGEQLQGELRWKGIVIGASEGSEVKAIADGRVILADWLQGYGLVVVVEHGKGDMSLYGYNQSALVSVGTQVRAGQPIALVGSSGGQGRPSLYFEIRRQGQAVNPQPWLGR

SEQ ID NO: 6625 - protein, 321 aa, Enterobacter cloacae
VLLQFRRIVFSVVSALALAAPVYAGKLAIVIDDFGYRPHYENQVLAMPSAISVAVLPNAPHAHEMATKAHNGGHQVLIHLPMAPLSKQPLEKDTLRPDMSSDEIDRIIRDAYNKVPYAVGLNNHMGSAMTSSLYGMLKVMQALERYNLYFLDSMTIGNSQAMRAAQGTGVKVIKRKVFLDDSQNEADIRVQFNRAVQLARRNGSAIAIGHPHPSTVRVLQQMLPGLPADITLVRPSDLLNEPQVDTSRPGSAQPPATRPRNPFRGVKNCTLKQPPEPVYATRFFTVIGESINSSTLVKIRPATVAGLGKKNPDRVNPIPAR

SEQ ID NO: 6626 - protein, 138 aa, Enterobacter cloacae
IVHEQRIKVYWREVQLRECTARNQAGDAFTRIREQDVRAVCTQAMRHLVTFDAADGEDTALLNFAQERSFFAQRGGHGDTQYDFIHIIRQLGGCGIQIKFNLWLPVFLENVRRIWRFERDILGVDALDLESHLGVILF

SEQ ID NO: 6627 - protein, 201 aa, Enterobacter cloacae
RRHSKGDDVYVMDINGLIEQYGYAALVIGSVAEGETITLLGGVAAHQGLLKFSLVVAAVALGGMIGDQLLYFLGLRFGPTLLQRFARHQKKIRRAQRLIQRHPYLFVIGTRFMYGFRIIGPILIGASRLPPKIFLPLNILGAIAWALIFTTLGYAGGEVIGPWLHNLDQHLKHWAWLILVVAVVIGVRLWLKHREKRRDEE

SEQ ID NO: 6628 - protein, 143 aa, Enterobacter cloacae
LYDEYVSARTFTMSKSLNTIWQYLRAFVLIYACLYAGIFIASLLPITIPGSIIGMLILFVLLALQVLPAKWVNPGCFVLIRYMALLFVPIGVGVMQYYDVLKAQFGPIVVSCAISTLVVFLVVSWSSHIVHGERKVVGEKTKK

SEQ ID NO: 6629 - protein, 119 aa, Enterobacter cloacae
IRHHADCHGRGRQHRGHSGHQRRVRDFRRYPGRGVWSYAAEYHENSYQSGTRSGDGYRLARAGHRTLRGTGLSGRGIQLAGAGDLRDYHFPGRAVYLPDYSGSNGLKFAMRRANFIFIS

SEQ ID NO: 6630 - protein, 297 aa, Enterobacter cloacae
GNVMHPRFQAAFSQLAENLQSALAPVLADAHFPALLTADQVTTLKQATGLDEDALAFALLPLAAACARADLSHFNVGAIARGVSGTWYFGGNMEFLGATMQQTVHAEQSAISHAWLRGEKALRAITVNYTPCGHCRQFMNELNSGLELRINLPGRAPHTLRDYLPDAFGPKDLEIKTLLMDEQDHGYALSGDELSEAAIAAANKSHTPYSKSPSGVALQCRDGRIFTGSYAENAAFNPTLPPLQGALNLLSLNGYDYPDIQRAILAEKADAPLIQWDATAATLKALGCSTIDRVLLA

SEQ ID NO: 6631 - protein, 239 aa, Enterobacter cloacae
GRRGENKKMMANIWWSLPLTLVVFFAARKLAVRFKMPLLNPLLVAMVVIIPFLLLTGISYERYFAGSKILNDLLQPAVVALAFPLYEQLHQIRARWKSIITICFVGSLVAMITGTSVALMMGASPQIAASILPKSVTTPIAMAVGGSIGGIPAISAVCVIFVGILGAVFGHTLLNIMKIRTKAARGLAMGTASHALGTARCAELDYQEGAFSSLALVICGIITSLVAPFIFPIILAVMG

SEQ ID NO: 6632 - protein, 254 aa, Enterobacter cloacae
PGGYSSLREISSSVRAICMLKRVFYSLSVLVGILLLIVLGLDRWMSWKTAPYIFDDLQDLPYRQVGVVLGTAKYYRTGVINQYYRYRIQGALNAYNSGKVNYLLLSGDNALQSYNEPVTMRKDLIAAGVDPADIVLDYAGFRTLDSIVRTRKVFDTNDFIIITQRFHCERALFIALHMGIQAQCYAVPSPKDMLSVRVREFGARFGALADLYLFKREPRFLGPLVPIPTMHEVPEDAQGYPAVTPEQLLEIQKK

SEQ ID NO: 6633 - protein, 325 aa, Enterobacter cloacae
RAATIARLFSQVLRMRVLLAPMEGVLDSLVRELLTEVNDYDLCVTEFLRVVDMLLPEKSFYRLCPELHRQSRTPSGTLVRVQLLGQYPEWLAENAARAVALGSYGVDLNCGCPSKLVNGSGGGATLLKDPELIYRGAKAMREAVPSHLPVTVKVRLGWDSGDKQFEIADAVQQAGATELVVHGRTKEDGYKAERINWQAIGEIRKRLTIPVIANGEIWDYESAQACLKETGCNAVMIGRGALNVPNLSRVVKYNEPRMPWADVVKLLQKYTRLEKQGDTGLYHVARIKQWLSYLRKEYDDALGLFQEIRTLQTSADIARVIQSKS

SEQ ID NO: 6634 - protein, 178 aa, Enterobacter cloacae
IIIRSLIMLKFRVSLLSLALLLGVSATAPAIAKTTAVATAAAQPQIASGSAMIVDLNTNKVIYASHPDLVRPIASITKVMTAMVVLDARLPLDEKLKVDISHTPEMKGIYSRVRLKSEISRKNMLLLALMSSENRAGGEPCPPLSWRLRRVYPRDECQSQSAGDEKYPFRGANRSVDP

SEQ ID NO: 6635 - protein, 309 aa, Enterobacter cloacae
SKNSGAQRAYCRVDAERSVRGCHAPAHLRAGWRISSRLTLRIIYTYLFADFQEVSMTRVAIVTASDSGIGKTTALMLAERGFDIGVTWHSDEEGALETCREVEARGQRAEAIHLDLGTLPEGAKAIETLISRFGRLDVLVNNAGAMNKAPFLELSFDDWRNIFTVDVDGAFLCSQIAARQMVKQGEGGRIVNITSVHEHTPLPDASAYTAAKHALGGLTKSMALELVQHKILVNAVAPGAIATPMNDMDDSEVKEGSMPEIPLARPGHTKEIASLVAWLCDSDASYTTGQSFIVDGGFMLANPQFKPEG

SEQ ID NO: 6636 - protein, 214 aa, Enterobacter cloacae
SKACIILKLSLTGRQQGGVMNHVWGLFSHPDREMQVIRNENETVAHHYTHHVLLMAAVPVVCAFIGTTQIGWNFGDGTVVQLSWFTGLYLAILFYGLMLAGVAVMGRVIHWMARNYPQRPSLAHCMVFAGYVATPLFLSGIVALYPLVWLCALIGTVALFYTGYLLYVGVPTFLNINKEEGLSFSSSTLAIGVLVLEALLALTVILWGYGYRLF

SEQ ID NO: 6637 - protein, 88 aa, Enterobacter cloacae
CPQRTARAASLAHHYPGGYDAFIRAMNAKAKALGMKNTHFVEPTGLSIHNVSTGRDLTKLLIASKQYPLIGQLNTTPEEMANFSKPGV

SEQ ID NO: 6638 - protein, 476 aa, Enterobacter cloacae
VHGVMKRSLTLSLSAPLVFMLAACAPEHATVSPVKTQAAAATVNTQLRHADWPKSEWWKDFNDSQLNALIDKALADAPDMQIARQRITLAEAQAKAAVAAEGPQLDFSADVERQKMSAEGLMGPFALTDPAAGTTGPWYTNGTFGLTAGWDLDLWGKNRAQIEARIGKVNAQKAELEQTRQLLASSVARLYWDWQTEAAVGDVLAQIKREQENIIGADRELYQHGITSSVEGVETDISASKTDEQLADVHGKMKAIEARLNALTNTPSVTLARHALPDAEASLPSTLGYELLARRPDLQEAHWYIEASMSEVDAARAAFYPDINLMAFLQQDALHLSDLFRSSAQQMGVTAGLTLPIFDSGRLNANLDIAQAQNNLSVANYNKAVVDAVNQVARTASEVETLTAKNQHQQQIEKDAARVVALAQARFRAGIIAGSRVSEAKIPALKERIAGLMLKGQYVDATLQLTSALGGGYHHG

SEQ ID NO: 6639 - protein, 852 aa, Enterobacter cloacae
VKPGAISYLPMNNTSEYIDAMPLTDIKKAALPASDIRAVHTALDGEHRHFSRDDDTPLGSVKARLEQAWPDSLAEGQLIKDDEGRDQLQAMPKATRSSMFPDPWRTNPVGRFWDRLRGRDVTPRYLSRLTKEQQASEQKWRTVGTIRRYILLLLTLAQTVVATWYMKTILPYQGWALINPADMIGQDIWVSFMQLLPYILQSGILLLFAVLFCWVSAGFWTALMGFLQLLMGRDKYSISASTVGDEPLNPEHRTALIMPICNEDVDRVFAGLRATWESVKATGNAAHFDVYILSDSYNPDICVAEQKAWMELIAEVQGEGQIFYRRRRRRVKRKSGNIDDFCRRWGNQYSYMVVLDADSVMSGDCLSGLVRLMEANPNAGIIQSSPKASGMDTLYARCQQFATRVYGPLFTAGLHFWQLGESHYWGHNAIIRVKPFIEHCALAPLPGEGSFAGSILSHDFVEAALMRRAGWGVWIAYDLPGSYEELPPNLLDELKRDRRWCHGNLMNFRLFLVKGMHPVHRAVFLTGVMSYLSAPLWFMFLALSTALQVVHALTEPQYFLQPRQLFPVWPQWRPELAIALFASTMVLLFLPKLLSIILIWCKGSKEYGGFCRVTLSLLLEVLFSVLLAPVRMLFHTVFVVSAFLGWEVVWNSPQRDDDSTPWSEAFMRHGSQLLLGLVWAVGMAWLDLRFLFWLAPIVFSLILSPFVSVISSRSTVGLRTKRWKLFLIPEEYSPPQVLVDTDTYLEQNRKRTLDDGFMHAVFNPSFNALATAMATARHRASQVLEIARDRHVEQALNETPEKLNRDRRLVLLSDPVTMARLHYRVWSAPERYSSWVNYYKDVKLNPLALKAK

SEQ ID NO: 6640 - protein, 78 aa, Enterobacter cloacae
RSDMKVIIVVMMACLLSGCGSIISRTIPGQGHGNQYYPGVQWDVRDSAWRYLTVIDLPFSLIFDTLLLPIDASHGPYE

SEQ ID NO: 6641 - protein, 378 aa, Enterobacter cloacae
RKLCGCKLSLFAISCRPIFISQRLQDLYTMPVLHNRVSNEMLKARMLAETEPRTTISFYKYFTIDDPQATRDALYQAFTALNVFGRVYLAREGINAQISVPESKVSAFRDLLYGFDPALNGLRLNIALDDDGKSFWVLRMKVRERIVADGIDDPSFNAANVGEYLKAAEVNAMLDDPDAVFIDMRNHYEYEVGHFENAMEIPADTFREQLPKAVEMMQEHKDKKIVMYCTGGIRCEKASAWMKHNGFNKVWHIEGGIIEYARRAREQGLPVRFIGKNFVFDERMGERISEDVIAHCHQCGTPCDTHTNCKNDGCHLLFIQCPACAEKFNGCCSELCSEESMLPEEEQRRRRAGRENGNKIFNKSRGRLNTKLGIPDPE

SEQ ID NO: 6642 - protein, 537 aa, Enterobacter cloacae
VSIKMDRIDISTQRGKCLLIMKHKPQMMKMRWLGVAVLLSLYTSSALAFNIDDVAKQAKSMAGKSYEAPKSNLPSVFRDMKYADYQQIQFNHDKAYWNNIKTPFKLEFYHQGMYFDTPVAINEVTATAVRKIKYSPDYFNFGDVQHDKDTVKDLGFAGFKVLYPINSKDKNDEIVSMLGASYFRVIGAGQVYGLSARGLAIDTALPSGEEFPRFREFWIERPKPTDKRLTIYALLDSPRATGAYRFVIMPGRDTVVDVQSKVYLRDKVGKLGVAPLTSMFLFGPNQPSPATNFRPELHDSNGLSIHAGNGEWIWRPLNNPKHLAVSSFAMENPQGFGLLQRGRQFSRFEDLDDRYDLRPSAWVTPKGDWGKGKVELVEIPTNDETNDNIVAYWTPDQLPEAGKEMNFKYAITFSRDEDKLHAPDNAYVMQTRRSTGDVKQSNLIRQPDGTLAFIVDFTGQDMKKLAPDTAVTAQASIGDNGEIVENAVRYNPVTKGWRLTLRVKVKDPKQTTEMRAALVSNDKPLSETWSYQLPANE

SEQ ID NO: 6643 - protein, 206 aa, Enterobacter cloacae
SACLAVRQLTLEHKMKKRLLGIALGSLLFTTGSALAADYKIDKEGQHAFVNFRIQHLGYSWLYGTFNDFDGTFTFDEKNPAADKVNVTINTNSVDTNHAERDKHLRSAEFLNVGKFPQATFASTEVKKDSDKLAITGNLTLNGVTKPVTLDAKLIGQGDDPWGGKRAGFEAAGKIHLKDFNITTDLGPASQDVELIISVEGVQQKS

SEQ ID NO: 6644 - protein, 318 aa, Enterobacter cloacae
PFRTLEHRTDMTQLPKFTAALLHPRYWLTWSGIGLLWLIVQLPYPVIFRMGKGLGRIAQQFMKRRARIAYRNLELCFPQMSESERHDMVVKNFESVGMGLMETGMAWFWSDKRMARWTEVAGTGMEPVHTLQANQTGVLLIGVHFLTLEIGARMFGMQAPGIGVYRPNDNPVIDLIQTNGRMRSNKSMIDRKDLKGMIRALKSGEVVWYAPDHDYGPQSSVFVPFFAVEDAATTTGTWMLARMSKAAIVPFVPRRKPDGSGYQLIMLEPELAPPLIDAETTARWMNGVVEKCIMLAPEQYMWLHRRFKTRPQGVPSRY

SEQ ID NO: 6645 - protein, 429 aa, Enterobacter cloacae
QAYYLTGHGALHLIMRIVMSPTDAPINWKRNLTVAWLGCFLTGAAFSLVMPFLPLYVEQLGVTGHSALNMWSGLVFSITFLFSAIASPFWGGLADRKGRKIMLLRSALGMAIIMLLMGMAQNVWQFLILRALLGLLGGFIPNANALIATQIPRQKSGWALGTLSTGGVSGALLGPLAGGLLADHYGLRPVFFITASVLFLCFLVTLICIRENFTPVAKKEMLHARDVLASLKNPKLVLSLFVTTMIIQVATGSIAPILTLYVRDLAGNVSNIAFISGLIASVPGVAALLSAPRLGKLGDRIGPEKILICALIVSVLLLIPMAMVQSPWQLGVLRFLLGAADGALLPAVQTLLVYNSTNQIAGRIFSYNQSFRDLGNVTGPLVGAGISASFGFRAVFIVTAGVVLFNAVYSWLSLSRALRPGRIRQHRDG

SEQ ID NO: 6646 - protein, 157 aa, Enterobacter cloacae
GEKSENAQSYMSTTPVQREYFLDSIRAWLMLLGIPFHISLIYSSHTWHVNSQMPSWWLTLFNDFIHAFRMQVFFVISGYFSYMLFLRYPLKRWWKVRVERVGIPMLTAIPLLTLPQFIMLQHVKGKAENWPNLSFYEKYNTLVWELISHLWFLLVLV

SEQ ID NO: 6647 - protein, 102 aa, Enterobacter cloacae
RQERQPYGAYPQDGSEAFTFLRNILPGVGGLLYGAACTYDNTLDEDFIIDTLPGHDNTLLVTGLSGHGFKFASVLGEIAAQFAQGIAPSFDLKPFALSRFDR

SEQ ID NO: 6648 - protein, 216 aa, Enterobacter cloacae
NTLFIFFSCIIYLTRPFLLLSHLRTEIHMQWRNSSRRYGIISMCLHWLFAIAVYAMFGLGLWMVTLSYYDGWYHQAPELHKSIGVLLMMGLVFRVIWRHISPPPPAPKSHGRLTRISAVGAHIALYALLFAILISGYLISTADGKPISVFGLFDVPATLADAGSQADTAGVVHLWLAWSVVILSVLHGLAALKHHFIDKDDTLKRMLGRSSVDSGA

SEQ ID NO: 6649 - protein, 140 aa, Enterobacter cloacae
SAILSLNTFTKNRETPMTMYATLEEAIDAAREEFLADNPGIEEEDADVQQLNIQKYVLQDGDIMWQAEFFADEGEDGECLPILSGEGAQAVFDGDYDEIELRQEWLEENTLHEWDEGEFQLEPPLDTEEGQAAADEWDER

SEQ ID NO: 6650 - protein, 90 aa, Enterobacter cloacae
SHHPACVCGSAPDRYRYPPAPAAENTLPGSGTASSVWYAGQPWNGWRSPTQTATGSARRRLAPARTGNADPARPYQRPTPGPAAAESRGA

SEQ ID NO: 6651 - protein, 432 aa, Enterobacter cloacae
SNSKLIFYHTMSKTHLTEQKFSDFALHPKVIEALETKGFHNCTPIQALALPLTLAGRDVAGQAQTGTGKTMAFLTSTFHYLLSHPAIADRKVNQPRALIMAPTRELAVQIHADAEPLAQATGLKLGLAYGGDGYDKQLKVLESGVDILIGTTGRLIDYAKQNHINLGAIQVVVLDEADRMYDLGFIKDIRWLFRRMPAANQRLNMLFSATLSYRVRELAFEQMNNAEYVEVEPEQKTGHRIKEELFYPSNEEKMRLLQTLIEEEWPDRAIIFANTKHRCEDIWGHLAADGHRVGLLTGDVAQKKRLRILDEFTRGDLDILVATDVAARGLHIPAVTHVFNYDLPDDCEDYVHRIGRTGRAGASGHSISLACEEYALNLPAIETYIGHSIPQSKYNPEALLSELPPPKRLTRPRSGNGPRRSGGAPRNRRRSG

SEQ ID NO: 6652 - protein, 496 aa, Enterobacter cloacae
ENMLSSTSLYAAIDLGSNSFHMLVVREVAGSIQTLTRIKRKVRLAAGLSSDNHLSPEAMERGWQCLRLFAERLQDIPLSQIRVVATATLRLAVNAGDFIARAQEILGCPVQVISGEEEARLIYQGVAHTTGGDDRRLVVDIGGASTELVTGTGAQATSLFSLSMGCVTWLERYFTDRNLAKENFDEAENAARAVLRPVMDELRYHGWKVCVGASGTVQALQEIMMAQGMDERITLAKLQQLKQRAIQCGRLEELEIEGLTLERALVFPSGLAILIAIFTELNIQCMTLAGGALREGLVYGMLHQSVDQDIRSRTLRNVQRRFIVDTDQAQRVSQLASQFADQVKKSWDIEPLSRDLLLSACALHEIGLSVEYKQAPLHAAWLVRNLDLPGYTPAQKKLLATLLLNQTNAVDLSSLHQQNAVPPRVAEHLCRLLRLAILFASRRRDDLLPAITLAADDEKLTLTLPENWLEDHPLGAELIEQEYQWQSYVHWALDVK

SEQ ID NO: 6653 - protein, 93 aa, Enterobacter cloacae
  UNSURE (93)
STQGTIMAKTAAALHILVKEEKLAQDLLEQIKNGADFGKLAKKHSICPSGKRGGDLGEFRQGQMVPAFDKVVFSLPRSWSQRFHTRRWKDNAX

SEQ ID NO: 6654 - protein, 134 aa, Enterobacter cloacae
LVNATSTRRWWRQNQRTRLIPVELYMSDKIIHLTDDSFDTDVLKADGLILVDFWAEWCGPCKMIAPILDEIADEYQGKLTVAKLNIDQNPGTAPKYGIRGIPTLLLFKNGDVAATKVGALSKGQLKEFLDANLA

SEQ ID NO: 6655 - protein, 676 aa, Enterobacter cloacae
SFMRLNPGQQQAVEFVTGPCLVLAGAGSGKTRVITNKIAHLIRGCGYQARHIAAVTFTNKAAREMKERVGQTLGRKEARGLMISTFHTLGLDIIKREYAALGMKSNFSLFDDTDQVALLKELTEGLIEDDKVLLQQLISTISNWKNDLMTPAQAAASAKGERDRIFAHCYGLYDAHMKACNVLDFDDLILLPTLLLQRNEEVRERWQNKIRYLLVDEYQDTNTSQYELVKLLVGQRARFTVVGDDDQSIYSWRGARPQNLVLLSKDFPALQVIKLEQNYRSSGRILKAANILIANNPHVFEKRLFSELGYGTELKVLSANNEEHEAERVTGELIAHHFVNKTEYKDYAILYRGNHQSRVFEKMLMQNRIPYKISGGTSFFSRPEIKDLLAYLRVLTNPDDDSAFLRIVNTPKREIGSATLQKLGEWAMTRNKSLFTASFDMGLSQTLTGRGYEALTRFTHWLGEVQRLAEREPVAAVRDLIHGIDYESWLYETSASPKAAEMRMKNVNQLFSWMTEMLEGSEIDEPMTLTQVVTRFTLRDMMERGESEEEADQVQLMTLHASKGLEFPYVYLVGMEEGLLPHQSSIDEDNVDEERRLAYVGITRAQKELTFTLCKERRQYGELVRPEPSRFLLELPQDDLIWEQERKVITAEERMHKGQANVANIRAMLAKAKEKG

SEQ ID NO: 6656 - protein, 166 aa, Enterobacter cloacae
EQSIVNLLTAVTELISIFLFTTCFLFIARKVAKRIGLVDKPNFRKRHQGLIPLVGGISVYAGICFTFGIADYYIPHAALYLACAGVLVLVGALDDRFDISVKFRATVQAAIGIIMMVVGGLYLRSLGYVFGPWELVLGPFGFFLTLFAVWAAIVFTDRGRKETRMR

SEQ ID NO: 6657 - protein, 445 aa, Enterobacter cloacae
TGMDDPAIPFTTLSSRITPSLRTHTIMNLTELKNTPVSELITLGENMGLENQARMRKQDIIFAILKQHAKSGEDIFGDGVLEILQDGFGFLRSADSSYLAGPDDIYVSPSQIRRFNLRTGDTISGKIRPPKEGERYFALLKVNEVNYDKPENSRNKILFENLTPLHANSRLRMERGNGSTEDLTARVLDLASPIGRGQRGLIVAPPKAGKTMLLQNIAQSIAYNHPDCVLMVLLIDERPEEVTEMQRLVKGEVVASTFDEPASRHVQVAEMVIEKAKRLVEHKKDVIILLDSITRLARAYNTVVPASGKVLTGGVDANALHRPKRFFGAARNVEEGGSLTIIATALIDTGSKMDEVIYEEFKGTGNMELHLSRKIAEKRVFPAIDYNRSGTRKEELLTTQEELQKMWILRKIIHPMGEIDAMEFLINKLAMTKTNDDFFDMMKRS

SEQ ID NO: 6658 - protein, 174 aa, Enterobacter cloacae
VKVVIMGQDPYHGPGQAHGLAFSVRPGVAIPPFLLNMYKELEGTIPGFTRPNHGYLESWARQGVLLLNTVLTVRAGQAHSHASLGWETFTDKVISLINEHREGVVFLLWGSHAQKKGAIIDRQRHHVLKAPHPSPLSAHRGFFGSNHFVLTNEWLEKRGEKPIDWMPVLPAESE

SEQ ID NO: 6659 - protein, 294 aa, Enterobacter cloacae
KISVWRGRLTTPFPFGFFSRLLPFFDKITTQITMLIIDLDNKIHRKNMMKHISGKAALLALSMISATAYASHWSYQGEGAPEHWGELDEAYKTCKSGMYQSPVNIDNTVKAHISPLETHYIDGPVILTNNGHTIQASENADTRDSITLDKQRWTLQQFHFHAPSENTVHGKKYAMEMHLVHKNADGELTVVAVMFDQGAANTELDKLWGVMPGQVDQNVTIKPTLDMNKLLPADKTYWRFSGSLTTPPCSEGVTWLVLKHPLTVSAEQLQKFTHTLHHENSRPVQPLHGRLVVE

SEQ ID NO: 6660 - protein, 382 aa, Enterobacter cloacae
GTVMTNHFRCLPLSGFIVCAALLTGCDGQENPQQHAQAPQVSVHIVKSAPLAVTTELPGRTDAYRVAEVRPQVSGIILHRNFTEGSDVKAGESLYQIDPATYQAAYDNAKGELVKAQAAANIAHLTVKRYVPLVGTQYVSKQEYDQAVATAQQADASVVAAKAGVESARINLAYTKVTSPINGRIGKSSVTEGALVTNGQSTALATVQQLDPIYVDVTQSSSDFMRLKQQTSLQKGDTSSVELLMENGQPYPLKGTLQFSDVTVDESTGSITLRALFPNPQHMLLPGMFVRARIDEGTQPDAILVPQQGVTRTPRGDATVLVVNDKNQVESRTVVAPQAIGDRWLITEGLKNGDRVIISGLQKVRPGVTVVAIPDTAATPAS

SEQ ID NO: 6661 - protein, 424 aa, Enterobacter cloacae
  UNSURE (125)
  UNSURE (135)
DKIVDVHSSADRDLKHVLLADETVCIGPAPSVKSYLNIPAIISAAEITGAVAIHPGYGFLSENANFAEQVERSGFIFIGPKADTIRLMGDKVSAITAMKKAGVPTVPGSDGPLTDDMDANRAHAXRIGYPVIIKXSGRRGGRGMRVVRSDAELAQSISMTKAEAKAALSNDMVYMEKYLENPRHIEIQVLADGQGNAIYLAERDCSMQRRHQKVVEEAPAPGITPELRRYIGERCAKACVDIGYRGAGTFEFLFENGEFYFIEMNTRIQVEHPVTEMITGVDLIKEQLRIAAGQPLSIKQEEVVVKGHAVECRINAEDPNTFLPSPGKITRFHAPGGFGVRWESHIYAGYTVPPYYDSMIGKLICYGENRDVAIARMKNALQELIIDGIKTNVDLQMRIMSDEHFQNGGTNIHYLEKKLGLNEK

SEQ ID NO: 6662 - protein, 96 aa, Enterobacter cloacae
APSCTIPAFFIHKGQKMDKRFVQAHKEARWALWLTLLYLAAWLVTAYLPDSAIGITGLPHWFEMACLLLPLVFILLCWAMVKFIYRDISLEDDDAA

SEQ ID NO: 6663 - protein, 299 aa, Enterobacter cloacae
QIKSFAMPWIQLKLNTTGANAEELSDALMEAGSVSITFQDTHDTPVFEPLPGETRLWGDTDVIGLFDAETDMKEVVAILENHPLLGAGFTHKIEQLEDKDWEREWMDNFHPMQFGQRLWICPSWREVPDENAVNVMLDPGLAFGTGTHPTTSLCLQWLDGLDLEGKTVIDFGCGSGILAIAALKLGAAKAIGIDIDPQAIQASRDNAERNGVSDRLELYLPDAQPEAMKADVVVANILAGPLRELAPLISVLPVEGGLLGLSGILASQADSVCEAYADLFALDPVVEKEEWCRITGRKK

SEQ ID NO: 6664 - protein, 103 aa, Enterobacter cloacae
RADRTMFEQRVNSDVLTVSTVNSQDQVTQKPLRDSVKQALKNYFAQLNGQDVNDLYELVLAEVEQPLLDMVMQYTRGNQTRAALMMGINRGTLRKKLKKYGMN

SEQ ID NO: 6665 - protein, 750 aa, Enterobacter cloacae
TGQLLRAGLTASILYKTLLTPNKNRGLNHFSSFPDDDNVCPLSNRSCLTSHTSEQTMLVSQYNQILVVISFVVAILAAYTALNMAARVAGSQGVAARVWLAGGGVSMGIGVWAMHFIGMLAMDLSMSMSYNAALTVLSMVIAISSSMFALWLVSGEQLRLRRLLPGAVVMGTGIVAMHYTGMAALEVTPGIVWDKTWVAISVVIALAASLAALWLTFRLRQEAARMALMRLGAAITMGIAIAGMHYAGMEAAQFPMSTMVHHHGINGSWLAILVSVVALAILGITLLVSMFDARLQARTSLLASSLAEANRELAQLALHDTLTRLPNRILLEDRLDQAISKADREGSPFALMFMDLDGFKTVNDAYGHDVGDKLLVAVTQRLLLQLKGQYTLARIGGDEFVLLAETATPDDAASLANSLVRVIDSPFHLDPYELMVTLSIGIALYPHDGKTDRELMFNADAAMYHTKHMGRNGYHFFQPSMNTLAQTHLQLMNDLWQAIDRDELRLLYQPKFHAPAGPVIGFEALLRWQHPKQGLLSPDLFLPLAEKTGLIIPIGNWVIDEACRQLREWHLQGHTDWSMAVNLSTLQFEQPSLVKTVLDCLTRHSVPPGMLILEVTETTAMSNPDESVRVLTALTDAGVKASIDDFGTGYSSLLYLKRLPACELKIDRAFVKELSGESEDATIVSAIVALAKTLNLKVVAEGVETAAQQTFLTELGCNTLQGYLLGKPITAQAIMEQCQHGEMSPPRAQS

SEQ ID NO: 6666 - protein, 495 aa, Enterobacter cloacae
NSSIAIFHWRTMMQLEVILPLIAYLCLVFGLSVYAMRKRSTGTFLNEYFLGSRSMGGVVLAMTLTATYISASSFIGGPGAAYKYGLGWVLLAMIQLPAIWLSLGILGKKFAILARRYNAVTLNDMLFARYQSRLLVWLASLSLLVAFIGAMTVQFIGGARLLETAAGIPYETGLVIFGVSIALYTAFGGFRASVLNDTMQGMVMLIGTLVLLVGIVHAAGGLSHAVETLEAIDPKLVSPQGADDILSPTFMTSFWVLVCFGVIGLPHTAVRCISYKDSKAVHRGIIIGTIVVAILMFGMHLAGALGRAVIPDLTVPDLVIPTLMVKVLPPFAAGIFLAAPMAAIMSTINAQLLQSSATIIKDLYLNLRPEQVENERRLKRMSAVITLVLGALLLLAAWRPPEMIIWLNLLAFGGLEAVFLWPLVLGLYWERANAAGALSGMIVGGVLYAVLATFKIQYLGFHPIVPSLLLSLLAFVVGNRFGRPVPQTALISTDK

SEQ ID NO: 6667 - protein, 322 aa, Enterobacter cloacae
LMRIGHHQLRNRLIAAPMAGITDRPFRTLCYEMGAGLTVSEMMSSNPQVWESDKSRLRMVHVDEPGIRTVQIAGSVPEEMADAARINVESGAQIIDINMGCPAKKVNRKLAGSALLQYPDQVKSILTAVVSAVDVPVTLKIRTGWSPEHRNCVEIAQLAEDCGIQALTIHGRTRACLFNGEAEYDSIRAVKQKVSIPVIANGDITDPLKARAVLDYTGADALMIGRAAQGRPWIFREIQHYLDTGELLAPLPLAEVKRLLCSHVRELHDHYGQAKGYRIARKHVSWYLQEHAPNDQFRRTFNAIEDASEQLEALEAYFENLA

SEQ ID NO: 6668 - protein, 78 aa, Enterobacter cloacae
  UNSURE (78)
YRRDSSQLRNNDMANFFIQRPVFAWVLAIILMIAGGLAILKLPVAQYPTIAPPAVAVTATYPGADAQTVQDTVTQVIX

SEQ ID NO: 6669 - protein, 217 aa, Enterobacter cloacae
QVMARKKKEEAQKTRQQLIEAAIRLFATRGVASTTLTDIADAAQLTRGAVYWHFSSKAEIFNAIWEQQLPLREIIRDRLMLSENDDPLLMLREQFIVALQYIASEPRQYALLQILYHKCEFHDDVISECEIRKRIGLNDDYLRKTLKRCIAHNIISSQTNIELALIVFHAFFSGVIKNWLMDNTSFNLYKQAPALVDNILATLNITRVAPVVYDTAL

SEQ ID NO: 6670 - protein, 305 aa, Enterobacter cloacae
TMVAQYYTDPEIQQLAEETGGCISDSLEMARFGAKHPASTLLVAGVRFMGETAKILSPEKTILMPTLNADCSLDLGCPIDEFTAFCDAHPDRTVVVYANTSAAVKARADWVMTSSIAVELIEHLDSLGEKIIWAPDRHLGNYVQKQTGADVLCWQGACIVHDEFKTQALTRMKGLYPDAAILVHPESPQSIVDMADAVGSTSQLIHAAKTLPNKQLIVATDRGIFYKMQQAVPEKELLEAPTAGEGASCRSCAHCPWMAMNGLKAISEALENGGAAHEIHVDAALREGALIPLNRMLDFAATLRT

SEQ ID NO: 6671 - protein, 262 aa, Enterobacter cloacae
FHLTVCWILRLHYVLNLLRPGEKMDFFSTQNILVHIPIGAGGYDLSWIEAVGTLAGLLCIWLASLEKISNYAFGLINVTLFAIIFFQIQLYASLLLQLFFFAANIYGWYAWSRQNSQQEAELQIRWLPLPKAIAWFAACVVAIGFMTVFIDPVFAFLTRVAVSVMSGLGLNVTMPELQPDAFPFWDSCMMVLSIAAMILMTRKYVENWLLWVVINVISVVIFARQGVYAMSLEYMLLTFIALNGSRMWINSARERGSRALSR

SEQ ID NO: 6672 - protein, 358 aa, Enterobacter cloacae
RYGRAGKKMNYQNDDLRIKEINELLPPVALLEKFPATENAANTVSHARKAIHKILKGSDDRLLVVIGPCSIHDPAAAKEYASRLLALREELKGELEIVMRVYFEKPRTTVGWKGLINDPHMDNSFQINDGLRIARKLLLEINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKAGLEKAGLAPQVMIDFSHANSSKQFKKQMEVGADVCQQIASGERAVIGVMIESHLVEGNQNLEGSEPLVYGKSVTDACIGWDDTDAILRQLADAVKARRG

SEQ ID NO: 6673 - protein, 370 aa, Enterobacter cloacae
TVRSQNGHQRNFLCLQSITRSRTVLNETPTLAPDGLPYRLLTLRNSAGMVVTLMDWGATLLSARVPMPDGSVRETLLGCASPEQYIEQTAFLGASIGRYANRIARSRFTLDGVTYSLLASQGENQLHGGPEGFDKRRWKIVQQNDAEVWFSLDSLDGDQGFPGNLTATARFTLTEDNRIAIEYRATVDKPCPVNLTNHAYFNLDGNQTDVRSHKLQILSDEYLPVDEMGIPYQGLKPVSGNSFDFRQPKTIAQDFLSDDDQRKVKGYDHAFLLQAKGDLSQPAAQVWSADEKLQMTVYTTAPALQFYSGNYLEGTTAREHDAYGAWQGLALESEFLPDSPNHPEWPQPDCVLRPGEEYVSVTEYHFIPRA

SEQ ID NO: 6674 - protein, 148 aa, Enterobacter cloacae
FRSPESFATEQDALLENVIQRNDKNRSTMMKMTKLTTLFLTATLTLASGSVLAADAGSSGSNGDANAAAEAGQVAPDAKQNIAPNNVDNSNINTGNTNTGGTNTGTMNHEGMTTDEVHKNSVCKDGKCPDPNDKVGSDANTKTDGTTQ

SEQ ID NO: 6675 - protein, 317 aa, Enterobacter cloacae
IRNDTMAHSHSHSHSTGDENAKRLLLAFGVTATFMIIEVTGGLISGSLALLADAGHMLTDAAALLFALLAVQFARRPPNARHTFGWLRLTTLAAFVNAIALVVITILIVWEAFQRFRHPQPIAGTTMMVIAIAGLVANILAFWILHRGSSEKNLNVRAAALHVLGDLLGSVGAIVAALIIMGTGWTPIDPILSVLVSCLVLRSAWRLLKESVNELLEGAPTSLDIGELKRNLSRSIPEVRNVHHVHVWLVGEKPLMTLHVQVIPPHDHDALLERIRHFLEHHYEIAHSTIQMEYQPCSGPDCHLNEAQSGHSHAHHH

SEQ ID NO: 6676 - protein, 393 aa, Enterobacter cloacae
RRPLPRIRSLKMSLKDKTQSLFAEKFGYPATHVIQAPGRVNLIGEHTDYNDGFVLPCAIDYQTVISCAKRDDRHVRVIAADYGNEIDEFSLDAPIVTHDSQQWSNYVRGVVKHLQKRNKNFGGADLVISGNVPQGAGLSSSASLEVAVGTVFQQLYHLPLDGAQIALNGQEAENQFVGCNCGIMDQLISALGKKEHALLIDCRSLGTKAVPLPKGAAVVIINSNFKRTLVGSEYNTRREQCETGARFFQQPALRDVSLDEFNKVAHELDPVVTKRVRHILTENARTVEAASALAKGDLKRMGELMAESHASMRDDFEITVPQIDTLVEIVKATIGDKGGVRMTGGGFGGCVVALVPEELVPAIQDAVAKQYEAKTGIKETFYVCKASQGAGQC

SEQ ID NO: 6677 - protein, 251 aa, Enterobacter cloacae
EMANTKLVLVRHGESQWNNENRFTGWYDVDLSEKGVSEAKAAGKLLKEEGFNFDFAYTSVLKRAIHTLWNILDELDQAWLPVEKSWKLNERHYGALQGLNKAETAEKYGDEQVKQWRRGFAVTPPELSKDDERYPGHDPRYAKLTEAELPQTESLALTIDRVVPYWNETILPRLKSGERVIIAAHGNSLRALVKYLDNMGEDEILELNIPTGVPLVYEFDENFKPVKHYYLGNADEIAAKAAAVANQGKAK

SEQ ID NO: 6678 - protein, 405 aa, Enterobacter cloacae
RSEGAALRFSDNLQQYISISLIYNALSLRKSACENQCKRYHYFIPCHTFRVSDMLWLIHTISLMERNMRVLVTGGSGYIGSHTCVQLLQSGHDVVILDNLCNSKRSVLPVIERLSGKQPTFVEGDIRNEALMTEILHDHAIETVIHFAGLKAVGESVAKPLEYYDNNVNGTLRLISAMRAANVKNFIFSSSATVYGDQPKIPYVESFPTGTPQSPYGKSKLMVEQILTDLQKAQPEWSIALLRYFNPVGAHPSGDMGEDPQGIPNNLMPYIAQVAVGRRDSLAIFGNDYPTEDGTGVRDYIHVMDLADGHVAAMQQLADKPGVHIYNLGAGVGSSVLDVVNAFSKACGKPVKYHFAPRRDGDLPAYWADATKADKELNWRVTRTLDEMAQDTWHWQSRHPQGYPD

SEQ ID NO: 6679 - protein, 351 aa, Enterobacter cloacae
GFVMTQFNPVDHPHRRFNPLSGQWILVSPHRAKRPWQGAQETPAKQTLPQHDPDCFLCPGNTRVTGDKNPDYKGTFVFTNDFAALMTDTPDAPESHDPLMRCESARGTSRVICFSPDHSKTLPELSVDALKEVVSTWQVQTAELGQSYPWVQVFENKGAAMGCSNPHPHGQIWANSFLPNEAEREDRLQKAYFAQNGSPMLVDYTQRELADGSRTVVETEHWLAVVPYWAAWPFETLLLPKAHVQRITELSDAQRDDLALALKKLTSRYDNLFQCSFPYSMGWHGAPFNGEENQHWQLHAHFYPPLLRSATVRKFMVGYEMLAETQRDLTAEQAAERLRAVSDVHYRESGV

SEQ ID NO: 6680 - protein, 231 aa, Enterobacter cloacae
QSRYSPPKRETKDDKESPDNMTLKHSNLLHLDLHTNHVTMTNIRTVLGSMELDEMLSQRDSINTRLLHIVDEATNPWGIKVTRIEIRDVRPPAELIASMNAQMKAERTKRAYILEAEGVRQAEILKAEGEKQSQILKAEGDRQSAFLQAEARERSAEAEARATQMVSEAIAAGDIQAVNYFVAQKYTDALKEIGSANNSKVVMMPLDASSLMGSIAGIAELIKDGGNERKK

SEQ ID NO: 6681 - protein, 285 aa, Enterobacter cloacae
TERLNLVPVRASMNLSVYGARMGLFNRIKTSFRALFPRRYAWPGMDISLPGGQHLHLVGSIHMGTQDMSPLPSGLIKLLKRADALIVEADISGHESPFAGLESDRPLAERLNETQLAELTRLADETGVSLSMLDTLPLWQIAMVLQATQAQRLGLRGDYGIDYQLLNAARARNLSIIELEGTGSQIALLRQLPDDGLILLDDTLTHWHTNARLLQTMIGWWLDAPPADGKLALPSTFSESLYDVLMNARNQAWRETLYALPAGRYVVAVGALHLYGEGNLPSLLK

SEQ ID NO: 6682 - protein, 192 aa, Enterobacter cloacae
PSLPILLRKMVLFFRQTSGVCCWHESSVVRRIAMTPAVKLLEKNKISFRIHTYDHDPNETNFGDEVVRKLGLNADQVYKTLLVAVNGDMKHLAVAVTPVAGQLDLKKVAKALGAKKVDMADPMVAQRTTGYLVGGISPLGQKKRLPTLIDAPSQEFETIYISGGKRGLDIELSAGDLAKMLDAKFADIARRD

SEQ ID NO: 6683 - protein, 879 aa, Enterobacter cloacae
AGFFRNIADIHISPLTFPLMEGLTFITVSEKQSEGQQLTRTLYGSFVMSHTIDLTLDGLSCGHCVKRVKESLEQRPDVESAEVTIDHAAVTGSASADALIDTIKQAGYGAELSHPKAKPLAESSSPSEALTAATPELPVADDIDDSQQLLINGMSCASCVSRVQNALQAVPGVAQARVNLAERTALVMGSASAAELVQAVEKAGYGAEAIEDDAERRERQQETAVATMKRFRWQAIVALLVGIPVMVWGMMGDNMMVTADNRTLWLVIGLITLAVMVFAGGHFYTSAWKSLKNRTATMDTLVALGTGAAWLYSMSVNVWPQWFPMEARHLYYEASAMIIGLINLGHMLEARARQRSSKALERLLDLTPPTARVVTDEGEKSVPLAEVQPGMTLRLTTGDRVPVDGKISQGEAWLDEAMLTGEPIPQQKSDGDAVHAGTVVQDGSVLFRASAVGSHTTLSRIIRMVRQAQSSKPEIGQLADKISAIFVPVVVGIALLSAAIWYFFGPAPQIVYTLVIATTVLIIACPCALGLATPMSIISGVGRAAEFGVLVRDADALQRASTLDTLVFDKTGTLTEGKPQVVAVSTVGCTETDALRLAAALEQGSSHPLARAILEKAGDARLPQVSNFRTLRGLGVSGEAEGHTLLLGNQALLTEHGVDTSALDAELNAQASQGATPVLLARDGQVAALLAVRDPLRQDSVDALQRLHRAGYRLVMLTGDNPTTANAIAKEAGIDEVIAGVLPDGKADAIKNLQSQGRQVAMVGDGINDAPALAQADVGIAMGGGSDVAIETAAITLMRHSLMGVADALAISKATLRNMKQNLLGAFVYNSLGIPIAAGILWPLTGTLLNPVVAGAAMALSSITVVSNANRLLRFKPKD

SEQ ID NO: 6684 - protein, 151 aa, Enterobacter cloacae
KMIELIVAHPHAFWLSLGGLLLAAEMLGGNGYLLWSGVAAVITGLVVWLLPVGWEWQGALFAVLTLLAAWLWWRWLNKRVKAQKPVDAHLNQRGQQIVGKRFTLDNTLINGRGHMRVGDSSWPVVADDDLSAGTRVEVIAVEGITLRVKAC

SEQ ID NO: 6685 - protein, 342 aa, Enterobacter cloacae
  UNSURE (331)
QIDVVFMAISESTQPVQGAPASPPKSRTSFKVLGAISLSHLLNDMIQSLILAIYPLLQSEFSLTFVQIGMITLTFQLASSLLQPVVGYWTDKYPMPWSLPIGMCFTLSGLVLLAMAGSFEAVLVAAALVGTGSSVFHPESSRVARMASGGRHGLAQSLFQVGGNFGSSLGPLLAAVIIAPYGKGNVAWFVLAALLAIVVLAQISRWYAAQHRVNKGKPAVKITNPLPRNKVILAVSVLLVLIFSKYFYMASISSYYTFYLMQKFGLSVQNAQFHLFAFLFAVAAGTVIGGPVGDKIGRKYVIWGSILGVAPFTLVLPYATLEWTGILSSTXADGTYTSPPPP

SEQ ID NO: 6686 - protein, 565 aa, Enterobacter cloacae
VTVIFAFVYGSGREKMKLMKRGVALALIAAWGLTSLPAQAYEKDKTYKITILHTNDHHGHFWRSEYGEYGLAAQKTLVDGIRKEVAAQGGSVLLLSGGDINTGVPESDLQDAEPDFRGMNLIGYDAMAVGNHEFDNPLSVLRQQEKWSKFPFLSANIYQKSTGERLFKPWALFKRQDLKIAVIGLTTDDTAKIGNPEFFTDIEFRKPADEAKLVIQELQQNEKPDVIIATTHMGHYDNGQHGSNAPGDVEMARSLPAGSLAMIVGGHSQDPVCMASENKKQVDYVPGTPCAPDRQNGIWIVQAHEWGKYVGRADFEFRNGEMKLVHYQLIPVNLKKKVTYPDGKSERVLYTPEIAENQQMLSLLTPFQSKGKAQLDVKIGTLNGRLEGDRSKVRFVQTNMGRLVLAAQMARTNADFAVMSGGGIRDSIEGGDITYKDVLKVQPFGNVVVYADMSGKEVIDYLTAVAQMKPDSGAYPQFANVSFVAKDGKLNDLKIKGEPVDTAKTYRLATLSFNATGGDGYPHIDNKPGYVNTGFIDAEVLKQFIQQNSPIDVNAYEPKGEVSWQ

SEQ ID NO: 6687 - protein, 147 aa, Enterobacter cloacae
TFHQGEGQGGNVNISDVAKKTGLTSKAIRFYEEKGLVTPPLRSENGYRSYTQLHLDELTLLRQARQVGFNLEECGELVNLFNDPKRHSADVKKRTLEKVAEIERHIIELQAMREQLLQLAESCPGDDSAECPIIDNLSGCCHRKTHA

SEQ ID NO: 6688 - protein, 69 aa, Enterobacter cloacae
RIGFQRWEPFLYRKFIMRTAYAYIRFSSEKQSAGDSVRRQQSLIDSWVKNNPDYILSFFTTAAKVTLLV

SEQ ID NO: 6689 - protein, 244 aa, Enterobacter cloacae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAPSDVTLHKIKIYHHEQ

SEQ ID NO: 6690 - protein, 75 aa, Enterobacter cloacae
NAHIGTYQCRFLGTIMGRGRRLKSYLDYENALGDGIGVGYGQSYQPWLRAQDVKSRGNRSIVFGLKTFRNHHHGV

SEQ ID NO: 6691 - protein, 286 aa, Enterobacter cloacae
TIKLSAYINSNTRGVMSHIQRETSCSRPRLNSNMDADLYGYKWARDNVGQSGATIYRLYGKPDAPELFLKHGKGSVANDVTDEMVRLNWLTEFMPLPTIKHFIRTPDDAWLLTTAIPGKTAFQVLEEYPDSGENIVDALAVFLRRLHSIPVCNCPFNSDRVFRLAQAQSRMNNGLVDASDFDDERNGWPVEQVWKEMHKLLPFSPDSVVTHGDFSLDNLIFDEGKLIGCIDVGRVGIADRYQDLAILWNCLGEFSPSLQKRLFQKYGIDNPDMNKLQFHLMLDEFF

SEQ ID NO: 6692 - protein, 261 aa, Enterobacter cloacae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSASTLATGLRVGDLGGSVLAFEVGAKERMALRATH

SEQ ID NO: 6693 - protein, 84 aa, Enterobacter cloacae
VRNVVQRQVSADDFMCFTVNGEMQLTPDTAAFLAMLFDFPLAFTEDLQPGGINYQVCDFTPGGRFETDINRLCPPADTAVIRAA

SEQ ID NO: 6694 - protein, 554 aa, Enterobacter cloacae
LSSMFLLVYYFPEVLMPVLFRVKVIPLVLLLAMIFAFLLNWPILLHFYEILSHLEHVKIGFVISIPFVLVAALNVVFMPFSVRFLLKPFFALLFITGSLVSYSTLKYKLMFDQTMIQNIIETNPQEAHSYLNGSIIIWFVFTGILPAILLFSIKIQYPEKWYKGIAYRLLSVLASLSLIAGVAALYYQDYASVGRNNSTLNKEIIPANYAYSTFQYVKDTYFTTKVPFQTLGNDAKRVVAHEKPTLMFLVIGETARSQNFSMNGYSRDTNAFTSKSGGVISFKNMHSCGTATAISVPCMFSNMNRTEYDSKKASNSENFLDIVQKTGVSLLWKENDGGCKGVCSRIPTVEIKPSDNPKLCDGKTCHDEVMLENLDDEIAKMPGDKLVAFHIIGSHGPTYYLRYPAEHRHFMPECARSDIENCTQEQLVNTYDNTLRYTDYVLAEMIEKLKNYSDQYNTVLLYVSDHGESLGESGLYLHGTPYKLAPDQQTHIPMQVWMSPGFIAGKHINMSCLENNAAKKSYSHDNLFSSILGLWDVSTSVYNPDRDLFRECRG

SEQ ID NO: 6695 - protein, 245 aa, Enterobacter cloacae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRTVDFYLSSRRNSKAAYRFLGKILNNVKKWQIPRFINTDKAPAYGRALALLKREGRCPSDVEHRQIKYRNNVIECDHGKLKRIIGATLGFKSMKTAYATIKGIEVMRALRKGQASAFYYGDPLGEMRLVSRVFEM

SEQ ID NO: 6696 - protein, 273 aa, Enterobacter cloacae
TWYESAALSSRGRPQRYSDLAITTVLVIKRVFRLTLRAAQGFIDSIFSLMNVPLRCPDYSCVSRRAKSVNVSFKTPTRGEIAHLVIDSTGLKVFGEGEWKVKKHGQERRRIWRKLHLAVDSKTHEIICADLSLNNVTDSEAFPGLIRQTHRKIRSAAADGAYDTRLCHDELRHKKISALIPPRKGAGYWPGEYADRNRAVANQRMTGSNARWKWTTDYNRRSIAETAMYRVKQLFGGSLTLRDYDGQVAEAMALVRALNKMTKAGMPESVRIA

SEQ ID NO: 6697 - protein, 245 aa, Enterobacter cloacae; identical to SEQ ID NO: 6695

SEQ ID NO: 6698 - protein, 332 aa, Enterobacter cloacae
FSVLVSVGRILGGGEVASADGMRFVTPVKTVNSGPNRKYFGSGRGITWYNFVSDQYSGFHGIVIPGTLRDSIFVLEGLLEQQTGLNPVEIMTDTAGTSDIIFGLFWLLGYQFSPRLADAGEAVFWRADKAANYGALDKLARGCVDLSKIESHWDEMMRVAGSLKLGTIHASELIRSLLRSTRPSGLAQAIMEVGRVNKTLYLLNYIDDEDYRRRILTQLNRGEGRHAVARAICYGQRGEIRKRYREGQEDQLGALGLVTNAVVLWNTLYMQEALSHLRSIGEGPEDEHIARLSPLMHGHINMLGHYTFTLPEDIMKGELRPLNLNLNNELSP

SEQ ID NO: 6699 - protein, 715 aa, Enterobacter cloacae
HSVPFWVVSKLITFETVKKRTEHPFTKGCVMAADFLTDKQTQNYGRYAAEPNEIQLARYFHLDERDLTFINLRRGRHNRLGIALQLTTARFLGTFLSDLMQIPPGVQFYVARQLNIRYPEIISRYAQRENTRWEHHGLIRQHYSYHDFGDFPWSFRLKRLLYTRAWLSNERPGLMFDFATAWLLQNKVLLPAASTLTRVIGEIRERATRRLWRKLAALPNRWQTAQLAGLLEIPEGQRLSVMEHLKRGPVTISGPAFTEALERYTRLRSLEFSCLNFTGLPAIQLRNLARYAGMASVKYISRMPEERRLAILTAFVKAQEISALDEAVDVLDMLILNITREAKKTGQKKRLRTLKDLDRAALLLARACALLLDEDTADDLLRKTIFSSVSVARLAESVEKVNELARPQDTNFQDEMVEQYGRVRRFLPALLRDLHFRAAPDGEHTLAAIHYLAELNGSKKRILDDAPEHIISGPWKRLVYDADGRIQRAGYSLCLLERLQDALRRRDIWLENSDRWGDPRQKLLQGEEWQAQRVPVCRALGHPTNGSKASEQLAAQLDETWKTVASRFDRNTAVDICNEGKHPSLTISSLDKLDEPPALIQLSSRVRQLLPPVDLTELLLEIDARTGFTREFSHVSESGARAQDLHISLCAVMLAEACNIGHEPLIKHNIPALTRHRLSWVKQNYIRAETLVSANARLVDFQSSLALAGYWGAGR

SEQ ID NO: 6700 - protein, 196 aa, Enterobacter cloacae
AEGITMQRLFPALWVVLFLVVSPLHAEPKVYGEQRIHRWWDAVTDDIAQTWEQPDRYDLYLPFLSWHARFMYDKEKTDNYNEMPWGGGLGVSRYNDEGNWSALFAMMFKDSHNEWQPAMGYGWEKGWFLDNAKDFRLGLGAAAGITARDDFANYVPLPFIFPLFSAGYKRVTVQFTYIPGTYNNGNVLFAWLRLGF

SEQ ID NO: 6701 - protein, 904 aa, Enterobacter cloacae
KEPEEGTMITEKPHRPYYQQTVDETLTNIQSSLDGLSSTEATARLEKYGENALPQKPGKPGWLRFLAHFNDVLIYVLLAAALLKLIMGHWVDMFVILGVAIINALIGHIQESNAEKSLQSIRNMLSSEAVVIRQGNHETIPTTALVPGDIVVIRAGDRIPADLRVIEAHNLRVEEAILTGESTVVEKSSDVLSGELPLGDRYNLLYSGTTVSSGGGKGLVVATGGETELGHINQMMSDIEKHRTPLMVQMDKLGKTIFITILVMMLALFVFSLIFRDMPVSELVLSLISLAVAAVPEGLPAIISIILSLGVQAMARRKAIIRKLPTVETLGAMTVICSDKTGTLTMNEMTVKAVITADTTYRVEGDSYEPVGAIHPVDDPTPVTVTQGSVLERYLRTVDLCNDSQLIKDEQGLWKITGGPTEGALKVLAAKIPLPTIDAELRSKIPFDSQYKYMSTLYHLGDEEVMLITGAPDVLFRLCQHQQTQNGLEPFNLHYWEEKIEEYAREGLRMVAAAWKPAASGQRELTHADLQEGVILLGIAGMMDPPRPEAISAIADCLQAGIRVKMITGDHPQTAMSIGQMLGIGNAASAITGRELEAMDDHQLSEAAQKYDIFARTSPEDKFRLVQALQSKQEVVGMTGDGVNDAPALKRADVGIAMGIKGTEVTKEAADMVLTDDNFATIARAVHEGRRVYDNLKKTILFVIPSNIAQALLIIIALLAGNLIPLTPVLILWMNMATSATLSFGLAFEAGEKDIMNRPPRKSNLHVMDGYAIWRVVFVGLMIAISAFVMEAWLQPRGYSPEIIRTVLLQTVVTAQWFYMLNCRVTDGFSLSKGLLANKGIWIVSGVLMALQLLIIYAPFMQMLFGTEALPFRYWIITCLIGFAMFMIVEAEKVFTRRWRTTKR

SEQ ID NO: 6702 - protein, 179 aa, Enterobacter cloacae
HPFLFSVKGIHACTHGVDAISPDSLTVVLVIKRMLDMYKTILVPVDVYETALSDKALQHAQFLAQSASGNVHLLYVMPKFSAELTRGFIADARKMDEYMINNAKEKLAALVKKINLPEANVHLHVRSGNIRDEVIKLADELNVGAIIVGSRNPNIQTHLLGSEAASIVRYAHVPVFVIR

SEQ ID NO: 6703 - protein, 238 aa, Enterobacter cloacae
  UNSURE (238)
VQNTMIRFASFVFTLGILVPAASAVTYPLPPEGSRLVGAPITITVPEGNTLPLEAFAAQHGQGLSNMLEANPGVDPFLPRAGTQLAVPQQLILPPTVREGIVVNVAEMRLYYYPPGSNTVEVLPIGIGQAGRETPRNWVTAVERKQEGPTWSPTPNTRRAYAKEGKTLPAFVPAGPDNPMGLYALYIGRLYAIHGTNSNFGIGLRVSQGCIRLRNNDIKYLFDDVSFSPGSAGSGIIX

SEQ ID NO: 6704 - protein, 369 aa, Enterobacter cloacae
NNYYQGNTVKRYLSLLPVVLLLLTACDPKSDRAAPLPKMVKVAEVVKAGNAQQRVFPARIESGDATDLAFKRAGQIETLDIRQGAVVKQGQRLASLNDREARQRLNDRQTAATLAQRQFDRFQTLAGRQAVSKAEMDVQRANRDSANAALQIAREELSQMTLVAPFSGTAASVHVRNHQVVSAGQPVVTLTRTDLLDVVFSLPENLFNTFDIRNAQYKPVVRINALPGREFTAVYKEHSGSSDSNTLTWQVILTMPRPDDFPVVGGVSGTVTINLTNLPAGVGSEALVVPVEAVFNPDNHPRNEPHVWVVTGEGDTLHLEDRKVSVGQVSAEGVIIVGGLKAGERVVAAGVGELHPNQPVRIWTRERGL

SEQ ID NO: 6705 - protein, 158 aa, Enterobacter cloacae
VVSAVITAFTVISFMVRVPVLSEQITVIAPSVSTVGSLRIIALRRAIACTPSERMIEIMAGNPSGTAATARLISDSTSSETGISRKMRLKTNSASIITRMVIKMVLPSLSICTINGVRCFSMSDIIWLIWPSSVSPPVATTSPFPPPELTVVPEYSRL

SEQ ID NO: 6706 - protein, 447 aa, Enterobacter cloacae
LKISTDRTTMDSTLISARRNEETPSLNRARRAALGSFAGAVVDWYDFLLYGITAALVFNREFFPQISPAMGTLAAFATFGVGFLFRPLGGIIFGHFGDRLGRKRMLMLTVWMMGIATALIGILPSFASIGWWAPVLLVTLRAIQGFAVGGEWGGAALLSVESAPKNKKAFYSSGVQVGYGVGLLLSTGLVSLISQLTTDEQFLSWGWRIPFIFSIVLVVVALWIRNGMEESAEFERQQREKPVAKKRLPVMEALVQHPGAFLKIIALRLCELLTMYIVTAFALNYSTQNLGLPRELFLNIGLVVGGISCLTIPCFAWLADRFGRRRVYITGALIGTLSAWPFFMALEAQSVFWIVFFAIMLANIAHDMVVCVQQPMFTELFGASYRYSGAGVGYQVASVVGGGFTPFIAAALVTFSGGNWHSVAIYLLAGCLLSAATALLMKETAHS

SEQ ID NO: 6707 - protein, 1024 aa, Enterobacter cloacae
TGTIMDISRQFISNPVRVWLTILLLGVGGIIALLNIGRLEDPAFTIKTAVVITHYPGASAQQVEEEVTLPLENALQQLPYLDNVSSISSSGLSQITVNIASRYHSNALPQIWDELRRRVGDAARQFPPGVVTPFVNDDFGDVFGFFFAISGDEFSNPELVRYAEQLRRELVLVPGVGKVAIGGALTQQINVDISLSKMAARGITLNQLSAQLSRLNVVSSAGEIPSGTESIRLHPTGEFESIDELADLIVTPPGVGAATRLRDIATLSRGLDASPASIYHANGKEAVTMGVSFIPGVNVIDVGHALEAKLEQMSAEKPAGIHIDLFYDQAAEVGHSVNGFIINFVMALAIVVGVLLIFMGLRSGIIIAFSLALNVLGTLLIMYLWGIELQRISLGALIIALSMLVDNAIVIVEGVLIARQQGSSLMNAISNIIRRSALPLLGATVIAILAFAPVGLSQDSTGEYCKSLFQVLLISLMLSWFSALTITPVLIKWWLFKRDAAPPEADETDPYDKRIYRIYQAVLNALLRRKAPTLVVMAALLAAAIWGFGSVRQNFFPSSSTPIFFVDLWLPYGTDIKWTEKMTSDIEKTINGQPGVETTVSTIGQGSMRFILTYSGQRQYSNYAQIMVRMDDQRNIPALTRHVDEYIARNYPQVNASTKRVMFGPSGDSAIEVRIKGPDPDRLRLIASQVDNILTRDPATDSVRNDWQNRSKVIRPQYITALGRELGVDKQDVDNALEMNFSGSRAGLYREGSDLLPVVVRPPESERLDANHLNNVLVWSQTRQQYIPLSNVVSGFALEWEDPLILRRDRSRVLTVQTDPDPLSQQTSGDILARVKPQIDALPLPHGYSIEWGGDAENSSEAQQGLFTTLPIGYLVMFVITVLMFSSVKNAVAIWLTVPLALIGVTPGFLITGIPFGFMALIGLLSLSGMLIRNGIVLVEEIEQQKAQQDQHSAIVYAATSRLRPILLTAFTTVLDLAPLLLDVFFQSMAVVIMFGLGFATILTLLVLPVIYACFHRKDKAEQQ

SEQ ID NO: 6708 - protein, 516 aa, Enterobacter cloacae
RKPRTADLLTFVSQACDILSGKAAHLWNKETDMNNKGSSLTPAQALEKLDALYEQSVNALRSAISDYIETGKLPDEKARTQGLFVYPSLSVTWDGSASSNPKTRAYARFTHSGCYSTTITRPALFRPYLEEQLTLLYQDYGAHISVEPSLHEIPYPYVIDGSALTLDRSMSAGLTRHFPTTELSQIGDETADGIYHPAEFSPLSHFDARRVDFSLARLRHYTGTPAEHFQPFVLFTNYTRYVDEFVRWGCSQILAPDSPYVALSCAGGIWITAETEAPEEAISDLAWKKHQMPAWHLITADGQGITLINIGVGPSNAKTICDHLAVLRPDVWLMIGHCGGLRESQLIGDYVLAHAYLRDDHVLDAVLPPDIPIPSIAEVQRALYDATKEVSGMPGEEVKQRLRTGTVVTTDDRNWELRYSASALRFNLSRAVAIDMESATIAAQGYRFRVPYGTLLCVSDNPLHGEIKLPGQANRFYEGAISEHLQIGIRAIDLLRAEGDKLHSRKLRTFNEPPFR

SEQ ID NO: 6709 - protein, 180 aa, Enterobacter cloacae
  UNSURE (180)
RVLKHIILTAICALLNLYAKKFRCPDVLTSILSMFTLVPDFSPHSPGSLTMTRKQATIAVRSGLNDDEQYGCVVPPIHLSSTYNFTGFNEPRAHDYSRRGNPTRDVTQRALAELEGGAGAVLTNTGMSAIHLVTTVFLKPGDLLVAPHECYGGHYPLFDIPANTGFYLVFLPPSSIYTTX

SEQ ID NO: 6710 - protein, 103 aa, Enterobacter cloacae
PTSVNLVASTLMNGALASLARRRAISVLPTPVGPIIRIFFGVTSWRSSSSSCMRRQRLRSAIATERLALSWPIMCLFSSLTISRGVISDMGDPYALDGNSSMV

SEQ ID NO: 6711 - protein, 73 aa, Enterobacter cloacae
GSPMKKDIHPKYEMITANCSCGNSIQIRSTVGHDLNLDVCGKCHPFYTGKQRDVATGGRVDRFNKRFSIPGAK

SEQ ID NO: 6712 - protein, 254 aa, Enterobacter cloacae
NYTALDINSYLPFQQRWLSGCIYFEGKRMKLKQLLFVLPLLSCAAQAGYVDYRHEYYDDGRNYDRVYMSHRFGTGFGVAVEAVSRSDEKQSNDALNNMESNSNEYTASYQFTWQGFIWQPGVAVEMGDDMAIYKPYLRVQYNINESWWTAFRYRTEYTRRNADGKDDRLVYRPEMWLGYNIDNWMFELNGIYKFADNEDLYNNKKEDYEYNFRVAYNIDSWVPFVEVGNVSSGYNTATTDDRQTRLRVGLGYNF

SEQ ID NO: 6713 - protein, 359 aa, Enterobacter cloacae
LSVKMVRSAVRCSGEEKTLKSRKEVASATMKDVAEKAQVSTATVSRALMNPDKVSQATRNRVEKAALEVGYFPQAMGRNVKRNESRTILVIVPDICDPFFSEIIRGIEVTAAAQGYLVLIGDCAHQNQQEKTFIDLIITKQIDGMLLLGSRLPFDASIEEQRNLPPMVMANEFAPELELPTVHIDNLTAAFNAVNYLQELGHKRIGCIAGPEEMPLCHYRLQGYVQALRRTGAIVDPHYIARGDFTFEAGGQALEKLLALPEPPTAVFCHSDVMALGALSYAKRHGLRVPQDLSIIGFDNISLSEFCDPPLSTVAQPRYDIGREAMLLLLDQLHGQTVSSGSRLLDCELIVRGSTQALT

SEQ ID NO: 6714 - protein, 152 aa, Enterobacter cloacae
TKCRGTNKPRRSVSKHCSASVRLSSKRNSSSGRRRSRYSSRVHNRSSRRVPYKLSLSSSNRRRSRRSKRHSRIRICCRRLRIPLRNSQKRSRLRRSPKRPRCRSRRLRKKMNAAGWFSAVRLKAPNRQKRCVLSWHLKDLTHALPPITAGIA

SEQ ID NO: 6715 - protein, 181 aa, Enterobacter cloacae
PGGLLVTTIVSVRRNGQVVIAGDGQATLGNTVMKGNVKKVRRLYNDKVIAGFAGGTADAFTLFELFERKLEMHQGHLVKAAVELAKDWRTDRMLRKLEALLAVADENASLIITGNGDVVQPENDLIAIGSGGPYAQAAARALLENTDMNARDIAVKALDIAGDICIYTNHNHTIEELPSKA

SEQ ID NO: 6716 - protein, 358 aa, Enterobacter cloacae
GSPMSEMTPREIVSELNKHIIGQDNAKRSVAIALRNRWRRMQLDEELRHEVTPKNILMIGPTGVGKTEIARRLAKLANAPFIKVEATKFTEVGYVGKEVDSIIRDLTDSAIKMVRVQAIEKNRYRAEEMAEERILDVLIPPAKNNWGQAEQQSEPSAARQAFRKKLREGELDDKEIEIDLAAAPMGVEIMAPPGMEEMTSQLQSMFQNLGGQKQKARKLKIKDAMKLLIEEEAAKLVNPEELKQDAIDAVEQHGIVFIDEIDKICKRGNASGPDVSREGVQRDLLPLVEGCTVSTKHGMVKTDHILFIASGAFQIASPSDLIPELQGRLPIRVELQALTTEDFERILTEPILTPRLEN

SEQ ID NO: 6717 - protein, 774 aa, Enterobacter cloacae
VLWRKIHQRRRIIQNLTNVCKLIRTPLSLMCILTRHFSSQEDSMPVAHVALPVPLPRTFDYLLPDSMSAKAGCRVTVPFGKQQRVGIVVSVSDKSELPLNELKSVVEVLDSEPVYSTSTWRLLLWAADYYHHPIGDVLFHALPIMLRQGKSASHAPMWYWFATEQGQAVDINSLKRSQKQQQALAALRQGKIWRHQVDELEVSETALQALRKKGLSELASEAPALHDWRDGFSVSGDRLRLNTEQATAVGAIHSAADRFSAWLLAGVTGSGKTEVYLSVLENVLAQGKQALVMVPEIGLTPQTIARFRERFNAPVEVLHSGLNDSERLSAWLKAKNGEAAIVIGTRSSLFTPFKNLGVIVIDEEHDSSYKQQEGWRYHARDLAVYRAHSEQIPIILGSATPALETLHNVRQRKYHMLRLTRRAGNARPAIQHVLDLKGQQVQAGLAPALISRMRQHLQAGNQVILFLNRRGFAPALLCHDCGWIAECPRCDHYYTFHQAQRHLRCHHCDSQRPVPRQCPSCGSTHIVPVGLGTEQLEQALAPFFPDVPISRIDRDTTSRKGALEQQLAEVHRGGARILIGTQMLAKGHHFPDVTLVALLDVDGALFSADFRSAERFAQLYTQVAGRAGRAGKQGEVVLQTHHPEHPLLQTLLHKGYDAFADQALAERQTMQLPPWTSHVIIRAEDHNNQQAPLFLQQLRNLLQASPLVDNQLWILGPVPALAPKRGGRFRWQLLLQHPSRIRLQQIVSGTLALINTLPEARKVKWVLDVDPIEG

SEQ ID NO: 6718 - protein, 108 aa, Enterobacter cloacae
RYLMAEWSGEYISPYAEHGKKSEQVKKITVSIPLKVLKILTDERTRRQVNNLRHATNSELLCEAFLHAFTGQPLPNDDDLRKERSDEIPEEAKVIMRELGIDPETWEY

SEQ ID NO: 6719 - protein, 331 aa, Enterobacter cloacae
RTNKYSETIVAQRDYVRRGQPAPSRRKKSSSKSKQRSLSAVSPAMVAIAAAVLVAFIGGLYFITHHKKEESEALQGNKVVGNGLPPKPEERWRYIKELESRQPGVRAPTEPSAGGEVKNADQLTDEQRQLLAQMQADMRQQPTQLNEVPWNEQTPAQRQQTLQRQRQAQQQTQQQQWTQTQPVQQPRSQPQQQTRTVQTQPVQQQPKAQPQKQTAQPYQDLLQTPAHTTAQQPKTQQAAPVTKETEVPKQTAEKKDERRWMVQCGSFKGAEQAETVRAQLAFEGFDSRITTNNGWNRVVIGPVKGKENADGTISRLKVAGHTNCIRLASGG

SEQ ID NO: 6720 - protein, 713 aa, Enterobacter cloacae
LNGDQHAGLLVLPGMDPNACHLPDLRVRAIRSHHQLYGQLIVVVQRQEIPALMTMQAFQRVRHAQRHLRVRLQRLPECLLEHVVFHHIAQARQFQLGGIKRHMSIFPLPGFETAVRMRAHRQHRLPDAQPAKQINRGRADGGNTYVRLAGRIECRRSRLFNNGYVKSLLRQPQRQCAADHTAANNGNFGVQECHGHYSLLKNTLSLPDFCGPEVDNLHTGHNRTKALQYAACNPELSKSMTKKLHIKTWGCQMNEYDSSKMADLLDTTHGYQLTENAKEADVLLLNTCSIREKAQEKVFHVLGRWKLLKRKNPDLIIGVGGCVASQEGKLIRQRAPYVDIVFGPQTLHRLPEMINQVRGSRSPVVDVSFPEIEKFDRLPEPRADGPTAFVSIMEGCNKYCTYCVVPYTRGEEVSRPADDILFEIAQLAAQGVREVNLLGQNVNAWRGENYDGTTGSFAELLRLVAAIDGIDRIRFTTSHPMEFTDDIIDVYRDTPELVSFLHLPIQCGSDRVLNLMGRPHTVLEYKSTIRKLREARPDIQISSDFIVGFPGETADDFERTMKLIGEVNFDVSYSFIFSARPGTPAADMVDDVPEEEKKQRLYILQERINQQANAWSRRMLGTVQRILVEGTSRKSIMELSGRTENNRVVNFEGTPDMIGKFVDVEIVEVLTNSLRGKVVRTEDEMGLRIAQTPESVISRTRKVNDSGVGIYQP

SEQ ID NO: 6721 - protein, 157 aa, Enterobacter cloacae
TEMSQVILDLQLACEDNSGMPEEAQFQKWLDAVIPQFQEESEVTIRLVDEAESHELNLTYRGKDKPTNVLSFPFEAPPGIEMPLLGDLIICRQVVEQEAKEQQKPLEAHWAHMVVHGSLHLLGYDHIEDDEAEEMESLETEIMLALGYEDPYIAEKE

SEQ ID NO: 6722 - protein, 320 aa, Enterobacter cloacae
SVTDYHAAAQGHSAAVNVELTREPLTNAMSDDNSHSSDTTTTKKGFFSLILNQLFHGEPKNRDELLELIRDSGQNDLIDEDTREMLEGVMDIADQRVRDIMIPRSQMITLKRNQTLDECLDVIIESAHSRFPVISEDKDHIEGILMAKDLLPFMRSDAEAFSMEKVLRPAVVVPESKRVDRMLKEFRSQRYHMAIVIDEFGGVSGLVTIEDILELIVGEIEDEYDEEEDIDFRQLSRHTWTVRALASIEDFNDTFGTSFSDEEVDTIGGLVMQAFGHLPARGETVDIDGYQFKVAMADSRRIIQVHVRMPDDSPVPKLED

SEQ ID NO: 6723 - protein, 408 aa, Enterobacter cloacae
VFTSRDPPGLPVRQALYFLSSPPISTATLAPLFCGVNNFGNDRFITPCGHRSVNQLKRNSLNIDTREISLEPADNARLLSLCGPFDDNIKQLERRLGIEINRRDNHFKLTGRPICVNAAADILRSLYVDTAPMRGEIQDIEPEQIHLAIKEARVLEQSAESVPDYGKAINIKTKRGVIKPRTPNQAQYIANILDHDITFGVGPAGTGKTYLAVAAAVDALERQEIRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDVTQIDLPRNTKSGLRHAIEVLAEVEEISFNFFHSEDVVRHPVVARIVNAYEAWEEADQKRRAELAAERKREAQEHEQK

SEQ ID NO: 6724 - protein, 256 aa, Enterobacter cloacae
QACITLHSHCARYNNITMGIYASLALIRKELGMQLRKLATAMLVMGMSAGVVHAEDAPAAGSTLDKIAKNGVIVVGHRESSVPFSYYDNTQKVVGYSQDYSNAIVEAVKKKLNKPDLQVKLIPITSQNRIPLLQNGTFDFECGSTTNNLERQKQAAFSDTIFVVGTRLLTKKGGDIKDFADLKGKAVVVTSGTTSEVLLHKLNDEKKMDMRIISAKDHGDSFRTLESGRAVAFMMDDALLAGERAKAKKPDNWEIV

SEQ ID NO: 6725 - protein, 512 aa, Enterobacter cloacae
MAFAPLVERQRVRLLLALLLGASGTLAFSPYDIWPAAILSLMGLQGLTLNRRPVQAAAIGYFWGLGLFGSGINWVYVSIAQFGGMPGPVNVFLVVLLAAYLSLYTGLFAGILSRLWPKTTWLRVAIAAPVVWQITEFLRGWVLTGFPWLQFGYSQVDGPLKGLAPVMGVEAINFLLMIVSGLLVLALVTRNWKPLVAALILFALPFPLRYIQWFTLEPARATQVSLVQGDIPQSLKWDENQLLNTLKIYANATEKVMGKSQLIIWPESAIPDLEINQQPFLKMMDDLLRARGSTLITGIVDARLNQQNRYDTYNTIITLGKGSEYSYTSTNRYNKNHLVPFGEFVPLESILRPLAPFFDLPMSSFSRGPYVQPQLHAHGFALTAAICYEIILGEQVRDNFRPDTDYLLTISNDAWFGKSIGPWQHFQMARMRSLELARPLLRSTNNGITAVIGPQGEIQAMIPQFTREVLSTNVTPTTGLTPYARTGNWPLWILTVLFGFGAVLMSLRQRRK

SEQ ID NO: 6726 - protein, 395 aa, Enterobacter cloacae
GIVTMTLLNTEVAVVGGGMVGGALALGLAQQGFDVTVIEQAAPPAFDPASQPDVRISAISAASVDLLRGLGVWEAVLAMRAHPYSRLETWEWENAHVSFDAAELKLPRLGYMVENNVLQQALWQALEAHPKVTLRVPDSLKGLHRHEGGYLLTLDNNDELAVKLVVGADGANSQVRQMAGIGIHAWQYQQSCMLITVQSENAPGESTWQHFTPNGPHAFLPLFDNWASLVWYDKPARIRQLQGLSMDQLQREIRQHFPSRLGNVTPVAAGAFPLMRRHALQYAREGLVLVGDAAHTIHPLAGQGVNLGYRDVDALLDVLGNARAHAEAWASHQVLKRYQTRRMADNFIMQSGMDLFYAGFSNDVGPVRIVRNIGLMAAERAGGLKRQALKYALGL

SEQ ID NO: 6727 - protein, 98 aa, Enterobacter cloacae
GEGIRPHYSEQQKQKSPQSGLVCLKWLGCRDSNPGMLVSETRALPLGDTPIALNKLLNDFKVAGVRGFEPRNAGIRIRCLTAWRYPNNVQFTESYSIT

SEQ ID NO: 6728 - protein, 81 aa, Enterobacter cloacae
PVLQSSMAGVPGFEPGNAGIKNRCLTAWRYPNTAENRMIEEIWLGYLDSNQGMPVSKTGALPLGDTPSVQRLPGNGAGGET

SEQ ID NO: 6729 - protein, 81 aa, Enterobacter cloacae
SKKYGWGTWIRTRECRYQKPVPYRLAIPHPCNAYLGMVREARLELAHLAAPEPKSGASTNFATPAKKMVATTGFEPVTPSL

SEQ ID NO: 6730 - protein, 125 aa, Enterobacter cloacae
VMCSNQLSYVASTAIFDGWGTWIRTRECRYQKPVPYRLAIPQYRGEPHDRRNMAGVPGFEPGNAGIKNRCLTAWRYPIRATLTWEWCGRRDLNSHTLRRQNLNLVRLPISPLPQKRWWLRRDSNL

SEQ ID NO: 6731 - protein, 195 aa, Enterobacter cloacae
FFCRKYWVKNMQIGYVRVSTNDQNTDLQRQALERAGCEQVFEEKMSGTVANRPALKKLLQTLNEGDTLVVWKLDRLGRSMRNLVLLVDELRQRGIHFKSLTDSIDTSSPMGRFIFHIMSALAEMERELIVERTRAGLAAAREKGRIGGRRPKLTPEQWAQAGRLIANGVDRKQVAIIYDVAVCTLYKKFPASKPA

SEQ ID NO: 6732 - protein, 166 aa, Enterobacter cloacae
TVATTKVYCALTETKLLYIKTVLEVCVMEFIRPTELREIIAIPLYSDLVQCGFPSPAADYVEQRIDLNELLVSHPSSTYFVKAAGDSMIEAGISDGDLLVVDSSRTVEHGDIVIAAVDGEFTVKRLQLRPTVQLNPMNGAYSPIVVGSEDTLDVFGVVTFIVKSAS

SEQ ID NO: 6733 - protein, 176 aa, Enterobacter cloacae
GSFQPRGEDWSMDFVMDALSTGRRIKCLTCVDDFTKECLTVTVAFGISGVQVTRILDSIALFRGYPATIRTDQGPEFTCRALDQWAFEHGVELRLIQPGKPTQNGFIESFNGRFRDECLNEHWFSDIVHARKIINDWRQDYNECRPHSTLNYQTPSEFAAGWRKGHSENEDSDVTN

SEQ ID NO: 6734 - protein, 214 aa, Enterobacter cloacae
SSEALMNQTQFQKAAGISAGLSARWFPHIDAAMKEYGITTPLDQAMFIAQMGHESTRFTRVVENLNYAAENLVPTFGSHRITPQQAAALGRTAAHPANQKAIANLVYGGEWGKEHLGNQVAGDGWKYRGRGLKQVTGLSNYHSCGYALKLDLVTHPELLEQDEYAARSAAWFYASRGCLLHSGDVERVTLLINGGRNGLDKRRELFNLAKSVLV

SEQ ID NO: 6735 - protein, 340 aa, Enterobacter cloacae
GRFFIGVYMAKPDWGELQQRFLSEHAATGVSPKEWCEAQGLNYATARRYIKKPSAQSVQKSAQKKVRTAQKEQSAEELVDDDGLTAQQRRFVAEYLKDGNATQAAIRAGYSKKSAEQIGYQLLQKTSVAQAIAQQQKASIARTLGSADEVLAQMWQLATFDANQLSQYRRGACRYCWGFGHHYQWRDAVEFEEKRLEAVERDRREPEDSGGYGYDHNREPNPECPRCNGDGIGQPYFPDTRKLPAVSRLAYSGVKVGKNGVEITAISRERMFEAVMKRLGLADSEFAQRLQQIEIDRRLLEVEKLRKELAGDGDDDEPTPVQININVVDARAEDGDQPDT

SEQ ID NO: 6736 - protein, 432 aa, Enterobacter cloacae
LLSLLNRPADMFALCDVNSFYASCETVFRPDLRGRPVVVLSNNDGCVIARSAEAKAAGIAMGEPFFKQKELFRRAGVVCFSSNYELYADMSNRVMTTLEEMSPRVEIYSIDEAFCDLTGVRSCRDLTDFGKEIRATVLKRTHLTVGVGIAQTKTLAKLANHAAKKWQRQTGGVVDLSNIDRQRRLLAIVPVEDVWGVGRRIIKKLNAMGIKTALDLSEQSTWIIRKHFNVVLEGTVRELRGEPCLELEEFAPSKQEIVCSRSFGERVTEYEQMRQAICSYAARGAEKLRGEHQYCRFISAFVKTSPFALNEPYYGNSASMKLLTPTQDTRDIFNAAVKCLDKIWKDGHRYQKAGIMLGDFFSQGVAQLNLFDENAPRAGSERLMEVLDHLNAKDGKGTLYFAGQGIQQQWQMKRSMLSPRYTTRFSDLLHVR

SEQ ID NO: 6737 - protein, 119 aa, Enterobacter cloacae
TSLAAWPGDMLRRLMVRMEKGRRQETALLHSPSRRDAEGFLIVTSAADKGLVDIHDRRPLVLSPEVALEWMRQDVGGKKAEELASDGVVPTEKFIWHAISRAVGNTANNHFSLIESINL

SEQ ID NO: 6738 - protein, 211 aa, Enterobacter cloacae
NVGLGSSATKDVGTDSGNVMQVGAFGVGTYQAPRPNDANSSFISDADGNTSWAPANGCGYQSSYNTQRIAQMWVTTGGAGYCRFLLNTNPQTAKTDAPWTVFQSAGTSDINFKKVTGDLDLNESLSNIAAMDFKTFYYLADEDKVIRRGVIAQELEKIDPQYVHSAEESGKMTLDLNPLVLDALAAIKALTIRVRELENEAQAVVPVSSAD

SEQ ID NO: 6739 - protein, 105 aa, Enterobacter cloacae
LEVSMCGRFAQAQTREEYLVYLADEADRDIAYDPEPIGRYNVAPGTKVLLLSERDEQLHLDPVLWSYAPGWWDKPPLINARIETTATSRMFKPLWQHGRAICFAD

SEQ ID NO: 6740 - protein, 381 aa, Enterobacter cloacae
SKRIDVKVLTVFGTRPEAIKMAPLVHALARDPDIEAKVCVTAQHREMLDQVLTLFSIVPDYDLNIMKPGQGLTEITCRILQELKPILESFKPDVVLVHGDTTTTVATSLAAFYQRIPVGHIEAGLRTGNLYSPWPEEANRTLTGHLAMYHFAPTENSRQNLLRENISDSKIFVTGNTVIDALIWVRDRVLANSELQAELAARYPFLNNGKKTILVTGHRRESFGRGFEQICHALAEIAAQNEDVQIVYPVHLNPNVSEPVNRILGHVENVLLIEPQDYLPFVWLMNHAWLILTDSGGIQEEAPSLGKPVLVMRETTERPEAVTAGTVRLVGTDPRRIVEEVTRLLHDDEEYQAMSRAHNPYGDGQACGRILHALKHNRVTL

SEQ ID NO: 6741 - protein, 421 aa, Enterobacter cloacae
VISPDMSLAKASVWTAASTLVKIGAGLLVVKLLAVSFGPSGVGLAGNFRQLVTVLGVLAGAGIFNGVTKYVAQHHDDAEKLRTVVGTSSAMVLGFSTLLAVVFLLAAAPISQGLFGHTHYQGLVRLVALVQMGIAWANLLLALMKGFRDAAGNALALILGSIIGVIAYYFCYRLGGYEGALLGLALVPALVVIPAAFMLMRRGNVPLSYLKPQWDKILAGQLGKFTLMALITSVTLPVAYVMMRNLLAAHYSWDEVGIWQGVSSISDAYLQFITASFSVYLLPTLSRLTSRQDITREIFRSLRFVLPAVAIASFTVWLLRDFAIWLLFSAKFTAMRDLFAWQLVGDVLKVGAYVFGYLVIAKASLRLYILAEIGQFALLTAFSHWLIPTHGALGAAQAYMATYIVYFAACCGVFLLWRKRA

SEQ ID NO: 6742 - protein, 326 aa, Enterobacter cloacae
FRVLWQGRLWIVGIALGFALLALAYTFFAKQEWSATAITDRPTVNMLGGYYSQQQFLRNLDIKANLATPDQASVMDESYKEFVMQLASWDTRRDFWSQTDYYKQRMVGNSKADAALLDDLINNIQFMPGDVLRNVSDSVKLIAETAPDANNLLRQYVAFASQRAASHLNDELKGAWAARTIQMKAQVKRQEEVAKAIFARRVHNLEQALKIAEQHNISRSETDVPADELPDSEMFLLGRPMLQARLENIQAVGPDFDLDYDQNRAMLNTLNVGPTLDPRFQTYRYLRTPEEPVKRDSPRRAFLMIMWGIVGALTGAGVALLRRRTN

SEQ ID NO: 6743 - protein, 231 aa, Enterobacter cloacae
YQRRVALSILNGVLESLEWESAFFARPSAIVRLRDNAPALQDADFSAWQRVQAKIPADRADLLDALQQHGFRLVEGEVDLSVTVARYASPGAEIATEQDIPTLRKMAALAFAQSRFRAPWYAPDDSGRFYAQWIENAVKGTFDHVCLVFRTDGGQIQGFVSLRRLTEHEARIGLLAGRGMGEKLMQAALHWAEQQQVSTLRVATQMGNTAALKRYIASGASIDATAYWLYR

SEQ ID NO: 6744 - protein, 474 aa, Enterobacter cloacae
HRLFQPELPHAVAPRAAYCFRRQRMSQLQFSGLLVVWLLSTLFIATLTWFEFRRVSFNFNVFFSLLFLLTFFFGFPLTSILVFRFDVGVAPPEILLQALLSATCFYAVYYVTYKTRLRAAKDTAPRRPLFTMNRVETHLTWVMLMTIALVSVAIFFMHNGFLLFKLQSYSQIFSAEVSGVALKRFFYFFIPAMLVVFFLRQDSKAWLFFLVSTVAFGILTYMIVGGTRANIIIAFAIFLFIGIIRGWISLWMLAAAGVFGIVGMFWLALKRYGLNVAGDEAFYTFLYLTRDTFSPWENLALLLQNYDKIEFQGLAPIVRDFYVFIPTWLWPDRPGIVLNTANYFTWEVLNNHSGLAISPTLIGSLVVMGGTWFILPGAIAVGLIIKWFDWLYTLGNEETNRYKAAVLHSFCFGAIFNMIVLAREGLDSFVSRVVFFMVVFGLCLLLAKLLYWLFDSAGLVHRREPQGSTTLSQV

SEQ ID NO: 6745 - protein, 250 aa, Enterobacter cloacae
VGIIMTDTTSAPRYALRGLQLIGWRDMQHALDFLFADGQMKSGTLVAINAEKMLAVEDNAEVKSLIEAAEFKYADGISVVRSIRKKFPDANVSRVAGADLWERLMERAGAEGTPVFLIGGKPEVLAQTEQKLRNQWNVNIVGSQDGYFRPEDRQTLYERVRDSGAKIVTVAMGSPRQEILMRDCRLVSPDALYMGVGGTYDVFTGHVKRAPKVWQNLGLEWLYRLLSQPTRIKRQIRLLRYLAWHYTGKM

SEQ ID NO: 6746 - protein, 327 aa, Enterobacter cloacae
ETIRSVFQYPSKTIPGNKSGNSKHNRGIMAEKKPELQRGLEARHIELIALGGTIGVGLFMGSASTLKWAGPSVLLAYIIAGLFVFFIMRSMGEMLFLEPVTGSFAVNAHRYMSPFFGYLTAWSYWFMWMAVGISEITAIGVYVQFWFPEMAQWIPALIAVGLVALANIAAVRLYGEIEFWFAMIKVTTIIVMIVVGLGVIFFGFGNGGHAVGFGNLTGHGGFFAGGWKGFLTALCIVVASYQGVELIGITAGEAKNPQVTLRSAVGKVLWRILIFYVGAIFVIVTIFPWNEIGTTGSPFVLTFAKIGITAAAAIINFVVLTAALSRL

SEQ ID NO: 6747 - protein, 426 aa, Enterobacter cloacae
TQSGNAMSFTTISVVGLGYIGLPTAAAFASRQKQVVGVDINAHAVETINRGEIHIVEPDLDRVVKKAVDGGFLRASTTPVEADAYLIAVPTPFKGDHEPDMVYVEAAAKSIAPVLKKGALVILESTSPVGATEQMAQWLAEARPDLSFPQQVGDQADINIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPEQARLIRTAREVNDHKPHWVINQVKATVADCLADSGKRASELKIACFGLAFKPNIDDLRESPAMEIAEMIAAWHSGETLVVEPNIHALPAKLAGHCTLTALDDALATADVLVLLVDHNAFKAVSGDAVRQQYVVDTKGVWR

SEQ ID NO: 6748 - protein, 434 aa, Enterobacter cloacae
PGAAWARNSCRRRCTGRSNNRYRRCGSQPRWATPLRLNVILRVVPASTPPPTGYTGDKMIPFNAPPVVGTELDYMQSAMGSGKLCGDGGFTRRCQQWMEQRFHSAKVLLTPSCTASLEMAALLLDIQPGDEVIMPSYTFVSTANAFVLRGAKIVFVDIRPDTMNIDETLIEAAITDKTRAIVPVHYAGVACEMDTIMAIAKKHNLFVVEDAAQGVMSTYKGRALGTIGHIGCFSFHETKNYTAGGEGGATLINDRALVERAEVIREKGTNRSQFFRGQVDKYTWRDIGSSYLMADLQAAYLWAQLEAAERINLQRLSLWQTYYDALEPLAKAGRIELPTIPADCIHNAHMFYIKLRDNDDRSKLIAWLKEAEIMAVFHYIPLHSSPAGEAFGMFAGEDRYTTKESERLLRLPLFYNLAPVNQRTVINSLLSYFA

SEQ ID NO: 6749 - protein, 361 aa, Enterobacter cloacae
TRMTALIHILGSDIPHHNQTVLRFFNDELASGTPDAREFMVVGRDNGLSVACPALHITFWPDKAALTKAVVAKAKADRSQRFFFHGQFNTGLWLALLSGGIKPSQFSWHIWGADLYEVSRGWKFRLFYPLRRLAQARVGCVFATRGDLNYFAKQHPKVRGELLYFPTRMDPALNTLANDAVREGKLTILVGNSGDRSNEHVAALRAVHQQFGDTVNVVVPMGYPANNDAYINDVRQQGLALFSAENLHILNDKLEFDDYLALLRKCDLGYFIFARQQGIGTLCLLIQAGVPCVLNRENPFWQDMAEQHIPVLFTSDTLNVEVVREAQRQLTLVDKNSIDFFSPNYLTPWHHALRIASGDNA

SEQ ID NO: 6750 - protein, 290 aa, Enterobacter cloacae
QPIPAVVCRLTKAKSELSRLSNQPAAARRVNPLNGVLMQISTEVLNVLSRCRAEGNFLFLADQLDRSIYVKTNKVLEAAGGKWNRKEQAHIFTADAAERIEQIILTGSVDIPRDLFNFFPTPENLVTDMVLRAEPAAGERVLEPEFGDGRILKALKLAAPDALITGIELNDERFLAVKNDSVLSTGVELVHTDFLGYQPDETFDVIVMNPPFLKRSDVKHVMHAIAMLAKRGRLQAILSAGVLFREDTLTKALRERVKQLGGQISPLPDDTFRESGTKVKTARLEIDLRR

SEQ ID NO: 6751 - protein, 364 aa, Enterobacter cloacae
LIMTKEKDTEQQDLVTRAFSVREKESGKDIILRPNSNRTVQSIALMRLGLFVPSPKSVGRQNREYKTVGFDATKELQTLSLMESEGFTNISIVGERLDMSVDFKTWMGIIRTYANHPINNDTISLKFTEFLKLCTPENYRSSTASRKRIDASLRRLASVTLSFTSNNSSKVYTTHLVQSALLDPESDQVVLQVDPKIFELYQYDHKVLMQLKAIKELAKKESAQALYTFIESLPPNPIPISLTRLKNRLNLKTRANSQNATVRKALEELASIGYLQYTEIKKDGKVYFQIHKRDPDLNLNNTQPPLEVVEDEEENSGSSVLEGELCPPADPIDGDDVLTVHDLTAEELRYIRSLRSQKKNSNAS

SEQ ID NO: 6752 - protein, 272 aa, Enterobacter cloacae
RPYVKDMTGGGPFQLRAGEWTDDTSMALCLAETLLEKGDADTICFRNKLLEWYQHGYNSSIGVCFDIGNTTRFALEQYLTIGPGWSGNTAPETAGNASIIRQAPVSIFFRKSLSKAFYEAKKQCIATHGAAEAINSTQYLSYLLVHMINGSNKDFVFSPHVMPLQPRVMIINAGEYKQKTRDQIRSSGYVIDTLEAAMWSVWNTDNFRDAILLAANLADDADSVAATAGQIAGALYGYSGIPQEWKNNLVQHERIAKMAGELFDRAPEDTFL

SEQ ID NO: 6753 - protein, 1456 aa, Enterobacter cloacae
GMSDNNAARKGDEIIHSSIFADITSIVAEGAAYAVIGAAVGAAATVAAPLLGAGAAAAGVAAIGSSCLLSGIIGGVLANVAGITDDISNAAEGLGNALFPPSPAGKITTGSNNVLTNAIPAARAAGTLTPADTPSPEPQSPGSFADYAGMLLSAAGQFGSEMWQPSVASAAAGTSPLEEDKVACEKHSGPQYLAEGSKSVFINGQPAVRAKDRTTCEGTVSDDVSPNVIIGGDTLTVRDIKSGKTPGLALGMIALSLLRGRPGKILKNMPCALAAAGGGMLADMAVNAVFGSSHPVHAATGVKVLNDDDELDFSLPGRFPLRWQRSYNSLTTREGLFGLGWATTFDSYLTLEENNATWFDETGRELSFELPPVDRAFYSISEGIIIRRNESGDVAIADDDGAVWRLYKPTRANPSILRLASLSDEYGNALLTAWDEHGRLVGIHDEPRAIDVSLRYDDERFPQRVTAASHFDGNQTWPLMHWGYDARGQLASATDASGVVTREYRYNDHGLMVWHRMPGGLESEYRWQKFDHWRVVENRTSTGDGCRFTYDLAAGLTTVEHYDGQTRKHYWNAQNLIVRYVDESGENWRYEWDDNELLTRRIDPLGNAVTFVYDDMGNRVQEIDADGNTRTTTWLEHRALPAAIIEADGNATRFWYDEHHGLKRVVDPMGQTTLLRRDEFGQVVEEVDAAGNSRYQEYNEAGQMVRATDCSGRVTQYRYHPLGWLMAETAADGEETRYRYDAAGRPVQLDRPEGWTESLKWNERGLPVKHAGADGKESEFRYDEAGRLTATRNTQGEEVRRRWDSRGRLIALENENGEAYQFRWGPDSLLLEEVGLDGVASQYRYDACGRTIARTFAAGHPEAITHAFAWSASGQLVARTTPEGQTRYHYTPSGLLSRIGLHPALSADAWSAEAEQELVFEYDALGRVTRETGEHGELAWEYDALGNRTSVTLPDGRELKQFYYGSGHLLSIALDKLSVSDFTRDELHRETSRTQGLLTTRSEYDRLGRLHRRDVFTGNAQRPSPRRWSRRWDYDYRNNLVREERDDNPFNWYRWQYDSAGRLLVQDGTLPGQEQWRWDAAGNPLEGSVEKVTHNRLTQLNGIRWRYDVHGRTVEKDNGQTRWHYRYDGEHRLTEVISQPRDRNRPQTQVSFRYDPLGRRISKTRRQMLGGQPAGKPVTTRFVWEGFRLLQEVHGEVPLTYVYSDQDSYDPLARIDGVDAPEIFWFHCQPNGTPERMTDSEGQVRWVGVNSAWGKLLRESETQVSGYSQNLRMQGQYLDRETGLHYNLFRYYDPDCGLFTQQDPIGLAGGINLYQYAPNALGWVDPWGLKCGFSQKDRITQRWVDRLTGKKPADVHNILTSKGWTRTYPQANKPGAIQHIQYVKTTKSGTTYKLDYHPGGTPTQPNIHGNDYWKVYREVDGADVVYGRIGHGEFKNYDLITDSPVYVDGVLLNGGV

SEQ ID NO: 6754 - protein, 760 aa, Enterobacter cloacae
NATVTCVSSNAQTVRRLSKPCWVSIKLNLQKQLTGSYRVWDYCVQYQESSLDFISRLMELEGIAYYFRHEADKHTLVLTDAATQHQPFSGYEVIPYHQTPSGGSTDEEGISQWALEDCVTPGIYSLDDYDFRKPNAWLFQAQQNPASPKPGSIDVYDWPGRFVETGHAEFYARIRQERWQVEHQQIQATATAAGIAPGHIFTLTNAPFFSDNGEYLVTAAGYHFEENRYASGEGETIHRTDFTVIPASVSYRPAQSTAWPRTYGPQTAKVVGPQGESIWTDKYGRVKVKFHWDRLAKGDDTSSCWVRVSSAWAGQGYGGVQIPRVGDEVVVDFINGDPDRPIITGRVYNDASMPPWALPAAATQMGFMSRTKDGSVDNANALRFEDKAGAEQVWIQAERNLDTSVKNDETHSVGGARSHYVKKNELHRVEANQIQAVKGGTEILTGKGKLDAAVEQYVIASGTKLRLVSGESAIELNANGKINLIGKEFNFFVEGDGYITTGGKLHLNTSGTKPGTTAPGSGHKGDIDAAVQEKFSPNKSAKNPAPAASAPAATRPKPTTKFASAPPLKGSYVYQNNSYNSDVMPFSEDVVKEINKSPTLQTQLKDLKDKGWAIQPGAAGGGSYADTNNKLIVMDPEHMEDTATTVQTLAHEAGHATYPVAVDSSSKESFINSQLMDEGGATLNNIKIQREILANGGIDIDIAGSAENLKAYNSAYDKMVSGELSRIDAAKAIGKVYGKGEIASGTNLNYNDYYGGFYGK

SEQ ID NO: 6755 - protein, 356 aa, Enterobacter cloacae
KPCIIGSTVLFIACSTAAPSTLMATSAAPKLPPNTISPRANISGEANHSATLRPSIPTTAQHMVVRITARVPKRFTSQAEQRMPLIEPIDRPNSTIPISAVETDSVSRIAGVRVAQEAISSPGMKKNINSAHMRRCRALRGEVSVIGISTRSTTIATTLATLCTFVHKLDEDFMSRPPNDPNRREKILQATLDTIAEHGIHAVTHRKIATCAGVPLGSMTYYFDGMESLLEEAFTWFTQQMSQQYRDFFAGVTGRERACEAITTLINSSAVTTPHNMALMYQLYAFMHRSAALKTVMQDWMKMSQTTLEQWFDSATARALDAFIEGMTLHFVTDRSPLTREEIRVMVGRIAGEDTV

SEQ ID NO: 6756 - protein, 245 aa, Enterobacter cloacae
MSTRKKLGLTNTTFKTVHGLDAPGQFSTARDMALLGKALIHDVPDEYAIHKEKEFTFNNIRQPNRNRLLWSSNVNVDGMKTGTTAGAGYNLVASATQGDMRLISVVLGTKTDRIRFNESEKLLTWGFRFFETVTPIKPDATFVSQRVWFGDKSEVNLGAGEAGSVTIPRGQLKNLKASYTLTEPQLTAPLKKGQVVGTIDFQLNGKSIEQRPLVVMEAVEEGGFFSRIWDFVLMKFHGWFGSWFS

SEQ ID NO: 6757 - protein, 413 aa, Enterobacter cloacae
RDCMINRSSSGNRLGRQALLFPLCLVLYEFSTYIGNDMIQPGMLAVVEQYNAGIEWVPTSMTAYLAGGMFLQWLLGPLSDRIGRRPVMLTGVVWFIVTCLATLLAQNIEQFTLLRFLQGVSLCFIGAVGYAAIQESFEEAVCIKITALMANVALIAPLLGPLVGAAWVHVAPWEGMFVLFAALAAISFFGLHRAMPETATRLGEKLSLKELGRDYKAVLQNGRFVAGALATGFVSLPLLAWIAQSPVIIISGEQLSSYEYGLLQVPIFGALIIGNLVLARLTSRRTVRSLIIMGGWPIAAGLIIAAVATVASSHAYLWMTAGLSIYAFGIGVANAGLVRLTLFASEMSKGTVSAAMGMLQMLIFTVGIEVSKHAYAFGGNGLFSLFNLANGVLWIALMVVFLKDKRVGNALQP

SEQ ID NO: 6758 - protein, 162 aa, Enterobacter cloacae
GNYMSTPAHLWLEDENGSPIIGSCMMPTRLGSIELKSFSHGVTIPADPSWGKLTGTRVHRPITIVKEFDQTTPLLYRAVCEGRVMKKGIIKMYRILESGIEAEYFNIVMENVKFTTVAPFMTPNGMSSTHLETLELRYEAISWKYTEGNIIYRDTWNDRCCA

SEQ ID NO: 6759 - protein, 430 aa, Enterobacter cloacae
KMFLAGAIFLFTLVLVIWQPKGLSIGWSATIGAVLALMSGVIHINDIPVVWNIVWNATATFIAVIIISLLLDESGFFEWAALHVARWGNGRGRLLFTWIVLLGAAVAALFANDGAALILTPIVIAMLLALGFSKQATLAFVMAAGFIADTASLPLIVSNLVNIVSADFFKLGFSEYASVMIPVDIAAIAATLVMLHLFFRNEIPPEYDLAKLREPALAIHDLPTFRTGWIVLLLLLVGFFVLEPLGIPVSAIATTGALILFAVAKRGHAINTGKVLRGAPWQIVIFSLGMYLVVYGLRNAGLTESLSGVLDYLAGYGLWVTTLGTGFITAFLSSIMNNMPTVLIGALSIEGSAATGLVKEAMIYANVIGCDLGPKITPIGSLATLLWLHVLAQKNMTITWGYYFRTGIIMTLPVLFVTLAALALRLSFTL

SEQ ID NO: 6760 - protein, 146 aa, Enterobacter cloacae
VTDMSHITIYHNPACGTSRNTLEMIRNSGTEPEIILYLENPPSRDELTRLIADMGISIGDLLRKNVEPYEQLGLSQGHFTDDQLIDFMLQYPILINRPIVVTPLGTRLCRPSEVVLDILPDAQKGAFTKEDGEVVVDANGKKISRQ

SEQ ID NO: 6761 - protein, 458 aa, Enterobacter cloacae
IPCSAMVSSVAWSIFSRRLGSFGGLLIKSSSSLCTNVHKVASVVAIVVLLVLIPMTLTSPRKALHLRMWALFMFFFIPGLLMASWATRTPAIRDTLSVSTAEMGIVLFGLSIGSMSGILCSAWLVKRFGTRAVIRTTMCCAVVGMLGLSVALWFASPLMFALGLMVFGGSFGAAEVAINVEGAAVEQAMNKTVLPMMHGFYSLGTLAGAGVGMALTALGIAANVHILLAALVCIIPILTGIRAIPAGTGQHATDEQKSAEKGLPFYRDFQLMLIGVVVLAMAFAEGSANDWLPLLMVDGHGFSPTSGSLIYAGFTLGMTVGRFTGGWFIDRYSRVAVVRASALLGGLGIAMIIFVDVDWIAGVSVILWGLGASLGFPLTISAASDTGPDAPTRVSVVATTGYLAFLVGPPLLGFLGEHYGLRSAMLVVLGLVIIAALVARAVAKPEAETTSMEKGYER

SEQ ID NO: 6762 - protein, 246 aa, Enterobacter cloacae
WDSGRSCAARIFSLTTCGPGGGSGFPRCWFTGWFPPGLLKSNEIMLENLNYELFYLLNATPSSPEWMIDLATFIAKDVISIVPALAVILWLWGPRTQVTAQRHLVIKMAMAIGVSVLASYVLGHAFPHDRPFVDRVGYNFLHHAPDDSFPSDHGTVIFTFALAFLFWHRLWSGVVLMGVAVAIAWSRVYLGVHWPLDMVGGFLVGLMGCVSAAILWSLFGPALYRGLSQAYRVLFALPIRKGWIRD

SEQ ID NO: 6763 - protein, 142 aa, Enterobacter cloacae
RVLQSLFYPSCYLLLLSFTTIKYDLMHMKQNIQDDRMLHPLQLFKTLSDETRLSIVMLLREAGELCVCDLCSATNEPQPKVSRHMALLREAGLVIDRREGKWIYYRLSPNMPAWAATVIDNSWNCLREETRMKLKNRLPGSC

SEQ ID NO: 6764 - protein, 294 aa, Enterobacter cloacae
SLLPPWWRERWQNRKQKQRQWRRDMSVKLIAVDMDGSFLSDAKTYNRARFLAQYARMKAQGIRFVVASGNQYYQLISFFPEIAHEIAFVAENGGWVVDAGEDVFNGELSKEHFLTVATLLNDVPGIEIIACGKNSAYTLKTYNDLFKEIAAKYYHRLESVSSFDNLNDIFFKFGLNVSDDEIPRIQALLHEKLGDIMVPVTTGHGSIDLIIPGVHKANGLRILQARWGIEDSEVVAFGDSGNDVEMLRQAGFGFAMANARPHIKAVARYEAPNNNDEGVLDVIDRVLDGEAPFN

SEQ ID NO: 6765 - protein, 266 aa, Enterobacter cloacae
APALRGLTFLARGSMETRRDDRIAQLLQALKRSDKLHLKEAATLLGVSEMTIRRDLNNDSAPVVLLGGYIVLEPRSASHYLLSDQKTRLVEEKRKAARLAASLVQPHQTLFFDCGTTTPWIIEAINSTVPFTAVCYSLNTFLALQEKPACRVILCGGEFHASNAIFKPLNIQDTLSNVCPDIAFYSAAGVNVKQGATCFNLEELPVKQWALNAAQQHVLVVDHSKFGKVRPARMGELSRFDAIVSDCRPDDELVAYAKAQQVKLMY

SEQ ID NO: 6766 - protein, 135 aa, Enterobacter cloacae
GFTEKDKVMRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRSEKAEAAAE

SEQ ID NO: 6767 - protein, 161 aa, Enterobacter cloacae
GGHAMFDVLMYLFETYIHNEAEMQVDQDKLTRDLTDAGFEREDIYNALMWLDKLADYQDGLAEPMQLASDPLSVRIYTAEECERLDASCRGFILFLEQIQVLNLETREMVIERVMALDTAEFELEDLKWVILMVLFNIPGCENAYQQMEELLFEVNEGMLH

SEQ ID NO: 6768 - protein, 208 aa, Enterobacter cloacae
NAFAPVNNVESRFRRIKSVNNNLPSGSIAQAVEILKKEEVIAYPTEAVFGVGCDPDSEVAVNRLLALKQRPVEKGLILIAANYAQLKPYIDDSMLTPAQRETIFSAWPGPVTFVFPAQPTTPRWLTGRFDSLAVRVTDHPLVVELCQAFGKPLVSTSANLTGLPPCRTTEEVLAQFGSDFPVAVGETGGRLNPSEIRDALTGERFRQG

SEQ ID NO: 6769 - protein, 121 aa, Enterobacter cloacae
ECIVARIAGINIPDQKHAVIALTSIYGVGKTRSKAILAAAGIAEDVKISELSEEQIDTLRDEVAKFVVEGDLRREISMSIKRLMDLGCYRGLRHRRGLPVRGQRTKTNARTRKGPRKPIKK

SEQ ID NO: 6770 - protein, 207 aa, Enterobacter cloacae
KMARYLGPKLKLSRREGTDLFLKSGVRAIDTKCKIEQAPGQHGARKPRLSDYGVQLREKQKVRRIYGVLERQFRNYYKEAARLKGNTGENLLALLEGRLDNVVYRMGFGATRAESRQLVSHKAIMVNGRVVNIASYQVKANDVVSIREKAKKQSRVKAALELAEQREKPTWLEVDAGKMESTFKRQPERPDLSADINEHLIVELYSK

SEQ ID NO: 6771 - protein, 152 aa, Enterobacter cloacae
KVNTKNKQGVAMYRIGELAKLANVTPDTIRYYEKQQMIDHEVRTEGGFRLYTDNDLQRLRFIRYARQLGFTLESIRELLSIRIDPEHHTCQESKSIVQARLDEVEGRIQELQAMQRSLQRLNDPCCGTAHSSVYCSILEALEQGASSEAQGC

SEQ ID NO: 6772 - protein, 77 aa, Enterobacter cloacae
LCSGEMMSRYQHTKGHIKDNAIEALLHDPLFRQRVEKNKKGKGSYLRKGKHAQRGKWEASGKQANRFFTTGLSVSVS

SEQ ID NO: 6773 - protein, 102 aa, Enterobacter cloacae
PANVFARDNVMETYAVFGNPIAHSKSPLIHQLFAEQLQIDHPYGRVLAPVDAFLPTLNSFFVAGGKGANVTVPFKEEAFGRADELTERACLLPRGLAGPLIE

SEQ ID NO: 6774 - protein, 130 aa, Enterobacter cloacae
IMAKAPVRARKRVRKQVSDGVAHIHASFNNTIVTITDRQGNALGWATAGGSGFRGSRKSTPFAAQVAAERCAEAVKEYGIKNLEVMVKGPGPGRESTVRALNAAGFRITNITDVTPIPHNGCRPPKKRRV

SEQ ID NO: 6775 - protein, 335 aa, Enterobacter cloacae
YQREDTMQGSVTEFLKPRLVDIEQVSSTHAKVTLEPLERGFGHTLGNALRRILLSSMPGCAVTEVEIDGVLHEYSTKESVQEDILEILLNLKGLAVRVQGKDEVILTLNKSGIGPVTAADITHDGDVEIVKPQHVICHLTDENAAISMRIKVQRGRGYVPASARIHSEEDERPIGRLLVDACYSPVERIAYNVEAARVEQRTDLDKLVIEMETNGTIDPEEAIRRAATILAEQLEAFVDLRDVRQPEVKEEKPEFDPILLRPVDDLELTVRSANCLKAEAIHYIGDLVQRTEVELLKTPNLGKKSLTEIKDVLASRGLSLGMRLENWPPASIADE

SEQ ID NO: 6776 - protein, 169 aa, Enterobacter cloacae
SFRESRSCCRVICSNVKKPASAGFFISAESPLIYNVCIFSAHPLEFIMWLLDQWSERHICDAQNKGEFENLPGSGEPLILDDDSHIPPELRAGYRLLKNAGCLPPELQQRNEAVELADLLKGIHKNDPRYSEISRRLALIELKLRQTGMNTDFLHGEYSERLIQKINKE

SEQ ID NO: 6777 - protein, 399 aa, Enterobacter cloacae
TNPRSIDSISDQSQRLLRLLMAGKRMTSTEIWLRLINIGSLYGDAMLEIAQRLLRQATVDAEAVNAAGLSPKHAVKFFSFSESELERSLEWLEHTDNHLLTADDPRFPPLLRSIPDFPGALFVRGRVDVLNSMQLAVVGSRAPSWYGERWGKMLSEQLSQCGFTITSGLACGIDGVAHHAALSAKGRSVAVLGNGLFSLYPRRHHILAEQLIASEGAIVSEFSLSTSPRPGNFPRRNRIISGLSQGVLVVEAAIRSGSLVTARCALEQGREVFALPGPLGNPGCEGPHWLIKQGATLVTCKEDILENLQYGLHWLQDDLQKRHISSDQEAVALPFPKLLANVGDEVTPVDVVAERAGQPVPVTVAQLLELELAGWIAAVPGGYVRLRRACHVRRTDVFV

SEQ ID NO: 6778 - protein, 198 aa, Enterobacter cloacae
RYAALILCAATRVVMAKSALFTVHKNEPCPQCGAELVIRSGKHGPFLGCSHYPECDYVRSLKSQADGHIVKILEGQLCPLCGGELALRQGRFGMFIGCSRYPECDHTEQIDKPDETAIACPQCQRGQLVQRRSRYGKTFHSCDRYPECQFVINFKPVAGVCHNCDYPLLIEKKTAQGLKRFCASKQCGKPVSADQISE

SEQ ID NO: 6779 - protein, 440 aa, Enterobacter cloacae
GPVFPGIFIFTVMKRQNLRTMAAQAVEQVIEQGQSLSNVLPPLQQKVSDKDKALLQELCFGVLRTLSQLEWLINKLMSRPMSGKQRTVHYLIMVGFYQLLHTRIPPHAALAETVEGAVAIKRPQLKGLINGVLRQFQRQQDELLAEFAQSEARFLHPEWLLNRLKKAYPQQWQDIVDANNQRPPMWLRVNRNHHTRDAWLALLEETGMSGFTHAAYPDAVRLASPAPVHALPGFEEGWVTVQDASAQGCMAWLEPKDGEQILDLCAAPGGKTTHILEVAPQACVMAVDVDEQRLSRVYDNLKRLGMKAQVKQGDGRKPADWCGDTRFDRILLDAPCSATGVIRRHPDIKWLRRDRDIKELAQLQSEILDAIWPHLKPGGTLVYATCSVLPEENSQQIAAFLKRTPDATLHDTGTPEHPGLQNLPGAEEGDGFFYAKLIKE

SEQ ID NO: 6780 - protein, 469 aa, Enterobacter cloacae
SKSDVENRSRKMKIIILGAGQVGGTLAENLVGENNDITIVDTNGDRLRVLQDKFDLRVVQGHGSHPRVLREAGADDADMLVAVTSSDETNMVACQVAYSLFNTPNRIARIRSPDYVRDAEKLFNSEAVPIDHLIAPEQLVIDSIYRLIEYPGALQVVNFAEGKVSLAVVKAYYGGPLIGNALSTMREHMPHIDTRVAAIFRHDRPIRPQGSTIVEAGDEVFFIAASQHIRAVMSELQRLEKPYKRIMLVGGGNIGAGLARRLEKDYSVKLIERDQQRASELAEKLQNTIVFYGDASDQELLAEEHIDQVDLFIAVTNDDEANIMSAMLAKRMGAKKVMVLIQRKAYVDLVQGSVIDIAISPQQATISALLSHVRKADIVGVSSLRRGVAEAIEAVAHGDETTSRVVGRAIDEIKLPPGTIIGAVVRGNDVMIANDNLRIEQGDHVIMFLTDKKFITDVERLFQPSPFFL

SEQ ID NO: 6781 - protein, 175 aa, Enterobacter cloacae
TRLWKFMAVLQVLHIPDERLRIVAEPVKEVNAEIQRIVDDMFDTMYAEEGIGLAATQVDIHKRIIVIDVSENRDERLVLINPELLEKSGETGIEEGCLSIPEQRALVPRAEKVKIRALDRDGNPFELEADDLLAICIQHEMDHLVGKLFIDYLSPLKQQRIRQKVEKLDRLRSRA

SEQ ID NO: 6782 - protein, 323 aa, Enterobacter cloacae
RPPDTRNNVSTSLRIIFAGTPDFAARHLDALLSSGHQIVGVFTQPDRPAGRGKKLMPGPVKVLAETHGLPVFQPASLRPEENQQLVADLNADVMVVVAYGLILPKAVLDMPRLGCVNVHGSLLPRWRGAAPIQRALWAGDAETGVTIMKMDVGLDTGDMLYKLACPITAEDTSATLYDKLADLGPQGLIETLQQLADNTATPEVQDEAQVTYAEKLSKEEARIDWSLSAAQLERCIRAFNPWPMSWLMIDEQPVKVWKASVINGNTSAEPGTIIDASKNGIQVATGEGILNLESLQPAGKKAMSAQDLLNSRREWFIPGNRLA

SEQ ID NO: 6783 - protein, 152 aa, Enterobacter cloacae
SFVKLIGVSWHKENIMSFIKEFREFAMRGNVVDLAVGVIIGAAFGKIVSSLVADIIMPPLGLLIGGIDFKQFAFTLREAQGDIPAVVMHYGVFIQNVFDFVIVAFAIFMAIKLINRLNRKKEEPAAAPPAPTKEEVLLTEIRDLLKEQNNRV

SEQ ID NO: 6784 - protein, 135 aa, Enterobacter cloacae
QEVIMAQIPAGADCPGQLSRKQTGDAWELKARRWLEGKGLRFVAANVRGRGGEIDLIMKDGQTIVFVEVRYRQSSRFGGAAASVTLAKQQKLLQTAHLWLARHNGSFDTVDCRFDVVAFTGNAIDWLKNAFGEDA

SEQ ID NO: 6785 - protein, 199 aa, Enterobacter cloacae
RDTVLERIKVCFTESIQTQIAAAEALPDAISRAAMTLVQSLLNGNKILCCGNGTSAANAQHFAASMINRFETERPSLPAIALNTDNVVLTAIANDRLHDEIYAKQVRALGHAGDVLLAISTRGNSRDIVKAVEAAVTRDMTIVALTGYDGGELAGLLGPQDVEIRIPSHRSARIQEMHMLTVNCLCDLIDNTLFPHQDD

SEQ ID NO: 6786 - protein, 194 aa, Enterobacter cloacae
GVLMKVLSALAVVMSALLLQGCIAAAVVGTAAVGTKAATDPRTVGTQVDDGTLELRVNSALSKDEQIKKEARINVTAYQGKVLLAGQAPNPELASRAKQIAMGVEGTAEVYNEIRQGQPIGLGTASSDTWITTKVRSQLLGTDQVKSSNVKVTTENGEVFLLGLVTEREGKAAADIASRVSGVKHVTTAFTYIK

SEQ ID NO: 6787 - protein, 390 aa, Enterobacter cloacae
GGGIPNRGRRAMFRRQCGRGSSPNFVHERFQDTVLHDAFAFFSGIRIVPIVTALTLSLVGLFIPLLWEYVAMGIAGIGHIIQSTSVFGPFLYGVGVLLLKPFGLHHILLAMVRFTPAGGIEMVNGQEVAGALNIFYAELKAGLPFSPHVTAFLSQGFMPTFIFGLPAVAYAIYRTARPENRPVIKGLLLSGVLVSVVTGISEPIEFLFLFIAPVLYAFHIVMSGLALMVMALLGVTIGNTDGGILDLLIFGVMQGMSTKWYLLFPVGMAWFAIYFFVFRWYILRHDIKTPGREVDAQGALQAVEANTRARGKSKYDHGLILRALGGKENIESLDNCITRLRLVVKDMGLIDQQALKAAGALSVVVLDAHSVQVIIGPQVQSVKSGIEALI

SEQ ID NO: 6788 - protein, 394 aa, Enterobacter cloacae
QGDVVFDFDRIIERKSDKCRKWDHAFVCSRFGDVPEGFIPLWIADMDFTSPPAVIEGFQRIVEHGTFGYTWCFDEFYDAVIAFQRTRHQVEVHKSWITLTYGTVSTLHYTVQAFCKPGDCVMMNTPVYDPFAMATQRQGVRVLANPLSVKENRYHLDFNLIEVQLKTHRPKLWFFCSPHNPSGRIWRADEIRQVSDLCKRYGTILVVDEVHAEHILDGTFVSCLTSGCAAQDNLIVLTSPNKAFNLGGLKTSYSIIPDDSLRQRFRQQLEKNSITSPNIFGVWGIILAYQQGLPWLDALNGYLRGNARYLADAIQTHFPAWKMMNPESSYLAWIDVSADDRSATALTQHFAKQAGVVIEDGSHYVQNGENYLRINFGTQRYWLEQSINRMLKHY

SEQ ID NO: 6789 - protein, 722 aa, Enterobacter cloacae
ALRKKITGYSMVPLTFLRKKAAHSVPLLLAALIFTGCGTQAPDQSTAHMQGSAQADSGFYLQQMSQSTNDTRINWQLLAIRALLKEGKTQQAAELFSQLPQDLNDTQRHEQTLLSAELKVAQKDYDGAKKILGTIDLSTLDKNQQTRFWQAGITAEQGRTSLTLLRALIAQEPLLAGADKQKNIDATWQALASMTQDQAKALVINADENVLQGWLDLQQMWFNNRSDPNMLKAGITDWQKRYPQNPGAKMLPTQLVNVQNFKPASTSKIALLLPLNGQAAVFGRAIQQGFEAAKNGTTAVSGSAVPTQAAQAANVNDVVSPSAAETSDLTTAQTPAQGTMQNPVTAPTTQPAPPAPAATQAPAETPAPATAEQPQPQTEQPEQQPATQPQAVATTSANPGAELKIYDTSAQPLDQVLAQVQQDGASIVVGPLLKNNVEALMKSNTTLNVLALNQPEQVQNRANICYFALSPEDEARDAARHIHEQGKQAPLLLIPRSTLGDRVANAFAQEWQTLGGGVVLQQKFGSAAELRAGVNGGAGIALNGSPVSASLPQQQSVTIGGLTIPAPPTDAQISGGGKVDSAYIVATPEEIAFIKPMIAMRNGSQSGATLYASSRSAQGTAGPDFRLEMEGLQYSEIPMLAGSNPQLMQQALGAVRNDYSLARLYAMGVDAWALANHFTQMRQVPGFELNGNTGDLTADQDCVINRKLSWLKYQQGQIVPAS

SEQ ID NO: 6790 - protein, 294 aa, Enterobacter cloacae
IGNTDETMKQHETADNSQGQLYIVPTPIGNLSDITQRALTVLQAVDLIAAEDTRHTGLLLQHFAINARLFALHDHNEQQKAETLVAKLKEGQNIALVSDAGTPLINDPGYHLVRTCREAGIRVVPLPGPCAAIAALSAAGLPSDRFCYEGFLPAKSKGRRDVLEDLEAEPRTLIFYESTHRLLESLEDMVTVWGEGRYVVLARELTKTWETIHGAPVGELLAWVKEDENRRKGEMVLIVEGHKAQEDALPADALRTLALLQAELPLKKAAALAAEIHGVKKNALYKYALEQQGE

SEQ ID NO: 6791 - protein, 112 aa, Enterobacter cloacae
KYILAVLVLGAARVWLFPHADGAIDNTLMWVIAMAVAGCLFVIPTAAEIPIIQTMMMAGMGTAPALALLITLPAVSLPSLIMLRKSFPAKALWLTAGLVALSGVIVGSMALV

SEQ ID NO: 6792 - protein, 96 aa, Enterobacter cloacae
GEAVLHPAVKTWVVEGSKKRLQAFEGVVIAIRNRGLHSAFTVRKISNGEGVERVFQTHSPVVDSIAVKRRGAVRKAKLYYLRERTGKSARIKERLN

SEQ ID NO: 6793 - protein, 331 aa, Enterobacter cloacae
TKKQFMAQRVELTATVSENQLGQRLDQALAELFPDYSRSRIKEWILDQRVLVNGKIWDKPKEKVFGGEAVAINAEIEEEIRFEPQDIPLDIVYEDDDILVINKPRDFVVHPGAGNPDGTVLNALLHYYPPIADVPRAGIVHRLDKDTTGLMVVAKTIPAQTRLVESLQLREITREYEAVAIGHMTSGGTVEEPISRHPTKRTHMSVHPMGKPAVTHYRIMEHFRIHTRLRLRLETGRTHQIRVHMAHITHPLVGDPVYGGRPRPPKGASDEFISVLRKFDRQALHATMLRLYHPITGIQMEWHAPIPQDMVELIDAMRADFEEHKDHVDWL

SEQ ID NO: 6794 - protein, 377 aa, Enterobacter cloacae
YRCVTSSRKTTIANEFDRIAIMQKDALNNVHITDEQVLITPDQLKAEFPLSVAQEAQIEHSRQTISDIIAGRDPRLLVVCGPCSIHDPETAIEYARRFKALAEEVSDSLYLVMRVYFEKPRTTVGWKGLINDPHMDGSFDVEAGLKIARRLLVELVSMGLPLATEALDPNSPQYLGDLFSWSAIGARTTESQTHREMASGLSMPVGFKNGTDGSLATAINAMRAAAMPHRFVGINQAGQVCLLQTQGNPDGHVILRGGKAPNYSPADVAQCEKEMEQAGLRPALMVDCSHGNSNKDYRRQPAVAESVIAQIKDGNRSIIGLMIESYIHEGNQSSEQPRIAMKPGVSVTDACISWETTDALLREIHKDLNGQLATRLA

SEQ ID NO: 6795 - protein, 128 aa, Enterobacter cloacae
PITASWNISVFIPACVCAWKPGVLTRSACTWRILPIRWWVTRFTAVVRVHQRAHRMNSSPCCVNSIARRCMRRCCVFTTQSPEFRWNGMRRSHRIWWNLSTRCAQISKNIRITWTGYDQTDCPGVATA

SEQ ID NO: 6796 - protein, 517 aa, Enterobacter cloacae
TKRRRYIAILRGLKERYELHHHVQITDPAIVAAATLSHRYIADRQLPDKAIDLIDEAASSIRMQIDSKPEELDRLDRRIIQLKLEQQALNKESDEASKKRLDMLNEELDEKERQYSELEEEWKAEKASLSGTQTIKAELEQAKIAIEQARRVGDLARMSELQYGKIPELEKQLEIATQSEGKTMRLLRNKVTDAEIAEVLARWTGIPVARMMESEREKLLRMEQDLHQRVIGQNEAVEAVSNAIRRSRAGLSDPNRPIGSFLFLGPTGVGKTELCKALANFMFDSDDAMVRIDMSEFMEKHAVSRLVGAPPGYVGYEEGGYLTEAVRRRPYSVILLDEVEKAHPDVFNILLQVLDDGRLTDGQGRTVDFRNTVVIMTSNLGSDLIQERFGELDYSHMKDLVLGVVSQNFRPEFINRIDEVVVFHPLGEKHIASIAQIQLQRLYKRLEERGYEIHISDDALKLLSENGYDPVYGARPLKRAIQQQIENPLAQQILSGELVPGKVIRLEANEDRIVAVQ

SEQ ID NO: 6797 - protein, 532 aa, Enterobacter cloacae
SMRLLRAVSACTGRDAGAYRSAQRGVAAAAREAASSGGQPLALFPLALPRYPRAAASVCFLPLKQNHSLFALKRKSMTTCTPRAAWGNLLRRLHFYIGLFVGPFIFFAALTGTLYVATPQLENALYHYALHTDAVGEAQPLAKQITVAEKAVGSALRLHAVRPGLEEGETTRVMFADPALGPSEHRAIFIDPASLEVRGDMTVYGTSGILPLRQTIDYLHTSLMLGNIGRLYSELAASWMWVAALGGIALWFYTRPKRRINNRFQNRRRLHVILGWTLLTGMLLFSVTGLTWSQWAGGNVDKLRAEMNWLTPQVNTTLSGAPEMRDEHAEHRGHHGGMTMPEMPVELSLFDSVLQAARQSGIDAKKVEIRPASRDDQAWTVTEIDRRWPTQVDAVAVDPHSLKVLDSTRFGDFPLMAKLTRWGVDFHMGILFGLANQLLLIAFGVALCVLIIWGYRMWWMRRPATSAANPVQTLCQSWLALPLWGRGVTFLISLLLGLALPVMGVSLVVFIVIDWLRWRAVSGVSLAGTSVK

SEQ ID NO: 6798 - protein, 386 aa, Enterobacter cloacae
TASWRRVWHKRIVMVAELTALRDQIDEVDKALLDLLARRMALVAEVGEVKSKYGLPIYVPEREASMLASRRKEAQALGVSPDLIEDVLRRVMRESYSSENDKGFKTLCPSLRPVVIVGGGGQMGRLFEKMLTLSGYQVRILEKEDWPHAPELMKDAGMVIVSVPIHVTEQIIAKLPPLPEDCILVDLASVKNGPLQAMLAAHTGPVLGLHPMFGPDSGSLAKQVVVYCDGRQPEAYQWFLEQIQVWGARLHRISAVEHDQNMAFIQALRHFATFAYGLHLAEENVQLEQLLALSSPIYRLELAMVGRLFAQDPQLYADIIMSSENNLALIKRYYQRFGEAITLLEHGDKQAFIDSFRKVEHWFGDYATRFQSESRTLLRQANDSRQ

SEQ ID NO: 6799 - protein, 310 aa, Enterobacter cloacae
CNDVYTESQHCWLFSFWGTVMAEPQLLLNYTGHLPECPTWSAEEKALYWADILEGEIHRYHLPTAEHSVLSFHEEVGCFALRERGGFIVAMRNAIWLTDKHGLLQRKVCDNPSNPQLARFNDGGTDHQGRFYAGTFWGPGDYNGAMLMRIDNDLTPKVIQCDIHGHNGLAFSPDKRWMFTSDTPNGVIYRTPLDEQGEPGKREEFRRFSEGDGIPDGAAMDEEGCYWSALFDGWRIARFSPQGEQLEEHRLPVRCPTMVCFGGDDMKTLFITTTRENMEAEELAKYPLSGAIFTLPVNVAGMKKSRFIEH

SEQ ID NO: 6800 - protein, 249 aa, Enterobacter cloacae
GSRGLVMTKLIVPEWPLPEGVAACSSTRIGGVSQGAWESLNLGAHCGDNLEHVEENRKRLFAAGNLPSKPVWLEQVHGKAVLKLTGEPYASKRADASYSNTPGTVCAVMTADCLPVLFCNQAGTEVAAAHAGWRGLCEGVLEETVACFQDDSANLIAWLGPAIGPQAFEVGPEVRDAFMEKDPQAVEAFVASGDKYLADIYQLARQRLNNVGVTQIFGGDRCTFTEKGDFFSYRRDKTTGRMASFIWLI

SEQ ID NO: 6801 - protein, 358 aa, Enterobacter cloacae
  UNSURE (343)
PVMGGVMRLDRLTNKFQLALADAQSLALGHDNQFIEPLHLMSALLNQEGGSVRPLLTSAGINAGQLRTAIDQALSRLPQVEGTGGDVQPSQDLVRVLNLCDKLAQKRGDNFISSELFVLAALESRGTLTDLLKSAGATTANVTQAIEKMRGGESVNDQGAEDQRQALKKFTVDLTERAEQGKLDPVIGRDEEIRRTIQVLQRRTKNNPVLIGEPGVGKTAIVEGLAQRIVNGEVPEGLKGRRVLALDMGALVAGAKYRGEFEERLKGVLNDLAKQEGNVILFIDELHTMVGAGKADGAMDAGNMLKPALARGELHCVGATTLDEYRQYIEKDAALERHFQKVXVAEPSVEDTSPFCVV

SEQ ID NO: 6802 - protein, 232 aa, Enterobacter cloacae
AWLWWAAPVWNEQVPDNPPNEIYATAQQKLQDGNWKQAITQLEALDNRYPFGPYSQQVQLDLIYAYYKNADLPLAQATIDRFMRLNPTHPNIDYVMYMRGLTNMALDDSALQGFFGVDRSDRDPQHARDAFNDFSKLVRSYPNSQYITDATKRLVFLKDRLAKYEYSVAEYYTRRGAWVAVVNRVEGMLRDYPDTQATRDGLKLMENAYRQMQMTAQADKVAKIIAANSSNT

SEQ ID NO: 6803 - protein, 131 aa, Enterobacter cloacae
HWVGYAGITKTERQEVKFMTMNITSKQMEITPAIRQHVADRLAKLDKWQTHLINPHIILSKEPQGFIADATINTPNGHLVASAKHEDMYTAINDLINKLERQLNKVQHKGEARRAATSVKDASFAEEVEEE

SEQ ID NO: 6804 - protein, 142 aa, Enterobacter cloacae
NYTRTLVSQAMLTKRRIAMRSITLMLLSLILSGCQINPYAFQPGWTSPDWFTAGKEDAMNGVPVKDNQALADSFNDPQVDRGEYLRGYADGQKKICEEGFIHAWGLAGKSFPASCDTTENAVKLYESWQQGMDESMRSSRLN

SEQ ID NO: 6805 - protein, 199 aa, Enterobacter cloacae
TMVFCRQFLRTSISGAVWRILMRNAILIALLRLPLALMLFILVAPAKAGSFTETDKSVRSIVSGIVSYTRWPALSGQPKLCIYASSHYRQALSSEDEHNPLPYSPVIVHSDREALTARCDALYFGSESPAKQQEIINQYQGQALLLMSEQNPECVIGSAFCLIIEHNQVRFSVNLDALARSGVRVNPDVLMLARNKKHE

SEQ ID NO: 6806 - protein, 392 aa, Enterobacter cloacae
NETDNTMTPENPLLDLRVKISALDEKLLALLAERRALAVEVGKAKLESHRPVRDIDRERDLLERLIQLGKAHHLDAHYITRLFQLIIEDSVLTQQALHQQHLNKTNPHSARIAFLGPKGSYSHLAARQYAARHFEEFIESGCAKFADIFNQVETGQADYAVVPIENTSSGAINDVYDLLQHTSLSLVGELTIPIDHCVLVSGSTDLNQIETVYSHPQPFQQCSQFLNRYPHWKIEYTESTSAAMEKVAQANSPAVAALGSEAGGALYGLQVLERNLANQTQNITRFVVLARKAINVSDQVPAKTTLLMATGQQAGALVEALLVLRNHNLIMTKLESRPIHGNPWEEMFYLDVQANLESASMQKALRELGEITRSMKVLGCYPSETVVPVDPA

SEQ ID NO: 6807 - protein, 413 aa, Enterobacter cloacae
CSHGIRSMNKEVVPTPRPTFKRTLRRISMISVIITMTFIWLLLCFASVVTLKQYAQKNLELTGATMSHSLEASLVFNDAVAANETLATLGKQGQFAVAEVLNAHHKRFAWWSWNPADNTDTLGALVNRWLFPVPVAQPIIHNGNVIGEIRLTARDSLISHFIWLSFAVLTGCILFASAVALTITRSLHHGMVVEMQNITDVVHDVRTNRNFSRRVTEGRIEEFHQFGEDFNSLLDEMEEWQLKLQAKNAQLLRTAMHDPLTGLANRAAFRNNIAALMNDASAKTNSALLFLDGDNFKFINDTWGHAAGDCVLIEAAKRMVEFGEKRHQSYRLGGDEFAMILYGVHTAREVEYICAALSQQFIRPFDLHNGHTASMSLSIGFALAWENASVEALLEQADRNMYLVKNQRSKTIS

SEQ ID NO: 6808 - protein, 165 aa, Enterobacter cloacae
KEDDMLKRYFAPLLLASLAMSGCQSSPEGKFTPEQIAAMKSYGFNELNGDWSLGLSDKILFDKNDARLRPESQTQIQTMASRLAATGLNHARMDGHTDNYGEESYNEALSLKRANVVADAWAKGANIPRSNLTTRGLGKKYPVSSNRTAQGRAENRRVAVVISTP

SEQ ID NO: 6809 - protein, 271 aa, Enterobacter cloacae
LAALEPGLHRSGGESMNTARLNQGTPLLLNGVTKRYGDNTILNALDLHIPAGQFVAVVGRSGGGKSTLLRLLAGLEAPNSGDILAGTTPLATIQDDTRMMFQDARLLPWKTVMDNVGLGLKGSWREDARQALAAVGLENRAGEWPAALSGGQKQRVALARALIHRPGLLLLDEPLGALDALTRIEMQDLIETLWQTHGFTVLLVTHDVSEAVAMADRVLLIEEGKIGLDLTVDIPRPRRVGSARLGELEAEVLDRVMKRGVSERVLIKANA

SEQ ID NO: 6810 - protein, 82 aa, Enterobacter cloacae
TGYTPELFIVLNAPVRGCYSAPMTQFASPVLHTLLDTDAYKLHMQQAVFHHYHDVHVAAEFRCRGDDLLGIYADSIRATGLH

SEQ ID NO: 6811 - protein, 194 aa, Enterobacter cloacae
GATMRVITLAGSPRFPSRSSALLEYAREKLNALDVEVCHWNLHNFAPEDLLYARFDSPALKTLIEQLKSADGLVVATPIYKASFSGALKTLLDLLPERALDGKVVLPLATGGTVAHLLAVDYALKPVLNALKAQEILHGVFADDSQVIDYQHKPHFTPNLQTRLDSALETFWHALNRRDRHAAAFHQSQGVAHV

SEQ ID NO: 6812 - protein, 385 aa, Enterobacter cloacae
RKKIMSLNLFWFLPTHGDGHYLGTEEGARPVDHGYLQQIAQAADRIGFTGVLIPTGRSCEDAWLVAASMIPVTQRLKFLVALRPSVVSPTVAARQAATLDRLSNGRALFNLVTGSDPQELAGDGVFLDHTERYEASAEFTRVWRRLLEGETVTFEGKHIHVRDAQLYFPPLQQPRPPLYFGGSSDVAQELAAEQVDLYLTWGEPPELVKEKIAQVRAKAAEHGRTVRFGIRLHVIVRETNDEAWQAADRLIAHLDDDTIAKAQAAFAKTDSVGQHRMASLHNGKRENLEISPNLWAGVGLVRGGAGTALVGDGPTVAARINEYAALGIDSFILSGYPHLEEAYKVGELLFPHLDVAIPEIPQPRQLQLQGEAVANAFIPRKVAQS

SEQ ID NO: 6813 - protein, 266 aa, Enterobacter cloacae
GATMSATAQKWLLRAAPWFLPVGIVLVWQLASSTGWLSSRILPSPEGVVEAFWSLSASGELWQHLAISSWRAVIGFSIGGSIGLTLGLISGLSRWGERLLDTSVQMLRNVPHLALIPLVILWFGIDESAKIFLVALGTLFPIYINTWHGIRNIDRGLVEMARSYGLSGFALFTHVILPGALPSIMVGVRFALGLMWLTLIVAETISANSGIGYLAMNAREFLQTDVVVVAIVLYALLGKLADVSAQWLERSWLRWNPAYTAQEAKA

SEQ ID NO: 6814 - protein, 337 aa, Enterobacter cloacae
TVGIATRRHFINHKEWRMFKTVTRIGLAGLLAVASLAQATEKAPESLRIGYQKGSVSMVLAKSHALLEKRFPETKFSWVEFPAGPQMLEALNVGSIDLGSTGDIPPIFAQAAGADLVYVGVEPAKPKAEVILVPENSEIKSVADLKGHKVAFQKGSSSHNLLLRALQEAGLKFTDIQPVYLTPADARAAFQQKNVDAWAIWDPYYSAALLQGGVRVLKDGTTLKQTGSFYLAARPYAEKNGAFIQQVLDTFSQADALTQSQRQQSITLLAKTMGLPEPVIATYLDHRPPTTIAPVDAHVAALQQQTADLFYQNRLVPKQVNIRERIWQPAGIEGKKS

SEQ ID NO: 6815 - protein, 102 aa, Enterobacter cloacae
YRTFRGRERNMRIKPDDNWRWYFCEEHDRMMLDLANGMLFRSRFARRMLTPDAFAPSGFCVDDAALYFSFEEKCRDLDLSKEQRAELVLSLHHGTGRIRVML

SEQ ID NO: 6816 - protein, 905 aa, Enterobacter cloacae
LKRALCLKRRTFCIARFTQQEYIESLLDKRCIRFSMTQQPQAKYRHDYRAPEYLISDIDLTFDLDATKTVVTAVSQVTRQSATAVSLRLDGEDLTLVSLHINDEAWSDYKEEGNQLVIDNLPERFTLRIVNEISPAANTALEGLYQSGVALCTQCEAEGFRHITWYLDRPDVLARFTTKIIADKTLYPYLLSNGNRIGEGELENGRHWVQWQDPFPKPCYLFALVAGDFDVLRDTFKTRSGREVALELFVDRGNLDRAPWAMTSLINSMKWDETRFGLEYDLDIYMIVAVDFFNMGAMENKGLNIFNSKYVLARTDTATDKDYLDIERVIGHEYFHNWTGNRVTCRDWFQLSLKEGLTVFRDQEFSSDLGSRAVNRINNVRTMRGLQFAEDASPMAHPIRPDKVIEMNNFYTLTVYEKGAEIIRMIHTLLGEENFQKGMQLYFERHDGSAATCDDFVQAMEDASNVDLSHFRRWYSQAGTPIVTVKDDYNPETEQYTLTISQRTPPTAEQEEKHPLHIPFSVELYDNEGNVIPLQKGGHPVHNVLNVTQAEQTFIFDNVYFQPVPALLCEFSAPVKLEYKWSDQQLTFLMRHARNDFSRWDAAQSLLATYIKLNVNRYQQGQPLTLPVHVADAFRAILLDENIDPALAAEILTLPSATEIAELFDIIDPIAIVAVREALTRTLVTELADEFLAIYNANKLDAYRVEHADIGKRSLRNTCLRYLAFGEAELANTLVSKQYHEADNMTDALAALAASVAAELPCRDALMQEYDDKWYQDGLVMDKWFILQATSPAADVLSKVRSLLKHRSFTMSNPNRVRSLIGAFASSNPAAFHAEDGSGYQFMVEMLTELNSRNPQVASRLIEPLIRLKRYDAQRQAKMRAALEQLKGLENLSGDLYEKIAKALA

SEQ ID NO: 6817 - protein, 349 aa, Enterobacter cloacae
SPPGLHTGNPGEFMYYPFVRKALFQLDPERAHEFTFQQLRRITGTPLAALVHQNVPEKPVQCMGLTFKNPLGLAAGLDKNGECIDALGAMGFGSIEIGTVTPRPQPGNDKPRLFRLVEAEGLINRMGFNNLGVDHLVENVKKAHFDGVLGINIGKNKDTPVEQGKDDYLICMEKVYAYAGYIAVNISSPNTPGLRSLQYGEALDDLLSAIKNKQTALQAIHHKYVPVAVKIAPDLSAEELIQVADSLVRHNIDGVIATNTTLDRSLVQGMKNCDEAGGLSGRPVQLKSTEIIRALSAELKGQLPIIGVGGIDSVIAAREKMAAGASLVQIYSGFIFKGPPLIKEIVTHI

SEQ ID NO: 6818 - protein, 467 aa, Enterobacter cloacae
LADLEFDPAHMLSSQSPSIYTVSRLNQTVRLLLEQEMGQVWISGEISNFTQPASGHWYFTLKDDTAQVRCAMFRNSNRRVTFRPQHGQQVLVRANITLYEPRGDYQIIVESMQPAGEGLLQQKYEQLKAMLSAEGLFDQQFKKPLPSPAHCVGVITSKTGAALHDILHVLKRRDPSLPVIIYPTAVQGDDAPGQIVRAIELANARQECDVLIVGRGGGSLEDLWSFNDERVARAIFASLIPVVSAVGHETDVTIADFVADLRAPTPSAAAEVVSRNQQELLRQIQNGQQRLEMAMDYFLANRTRRFTQLHHRLQQQHPQLRLARQQTVLERLRQRMNFALDNQLKRAVSRQQRMTQRLNQQNPQPKVYRAQTRIQQLEYRLAENIRSRLSATRERFGNAVTHLEAVSPLSTLARGYSVTTATDGKVLKQTKQVKAGDVLTTRLSDGWVESEVKEIKPVKKTRQRKSG

SEQ ID NO: 6819 - protein, 368 aa, Enterobacter cloacae
KKRASVKADKSSPVTNYTAAIAFFDKESSMPHLHSVIPPYILRRIIESGSEPQQRCARQTLTHVQTLMAHMPGKPAAPHVNKAGQLERDIYDAKQTQELPGSQVRYEGQPSNGDVAVDEAYDYLGITHDFFWKEYQRDSLDNKGLILTGTVHYGREYQNAFWNGQQMVFGDGDGEIFNRFTIAIDVVAHELSHGVTETEAGLIYFEQSGALNESLSDVFGSLVKQYYLKQTADQADWLIGEGLLAAGINGKGLRSMSEPGTAYDDPLLGKDPQPAHMKDFIKTREDNGGVHLNSGIPNRAFYLAATAIGGYAWEKAGYAWYDTVCDRNLAQDADFDAFAKLTIAHGEKRSGSDVGAAIKQAWEQVGVL

SEQ ID NO: 6820 - protein, 145 aa, Enterobacter cloacae
NFARVHFISALHGSGVGNLFESVREAYDSSTRRQSTAMLTRIMNMAAEDHQPPLVRGRRVKLKYAHAGGYNPPIVVIHGNQVKDLPDSYKRYLMNYFRKSLDVMGTPIRIQFKEGENPFANKRNTLTPNQMRKRKRLIKHIKKSK

SEQ ID NO: 6821 - protein, 532 aa, Enterobacter cloacae
PFGVHAGVYKHDTYLFGRIMQSSVNQKESRTFFGHPYPLGSLFFTEMWERFSFYGIRPLLILFMAATVYDGGMGLARENASAIVGIFAGTMYLAALPGGWLADNWLGQQRAVWYGSILIALGHLSIALSAIMGDNLFFIGLMFIVLGSGLFKTCISVMVGTLYKKGDARRDGGFSLFYMGINMGSFIAPLISGWLIKTHGWHWGFGIGGIGMLVALIIFRVFAVPAMKRYDSEVGLDSTWNSPVVKRNGVGAWLLALAVGVAIIVTLIAQGVIVINPVAVASVLVYVIAASVALYFIYLFIFAGLNRKERARLLVCFILLVSAAFFWSAFEQKPTSFNLFANDYTNRMIGDFEIPAVWFQSINALFIILLAPVFSWAWPKLASKNIRPSSITKFVIGILCAAAGFGLMMLAAQNVLSNGGAGVSPFWLVGSILMLTLGELCLSPIGLATMTLLAPERMRGQMMGLWFCASALGNLAAGLIGGHVKADQLDMLPDLFARCSIALLICAAVLIVLIVPVRRMLENAQTKPATEA

SEQ ID NO: 6822 - protein, 496 aa, Enterobacter cloacae
PPRSEILPMLRIAKEALTFDDVLLVPAHSTVLPNTADLSTQLTKTIRLNIPMLSAAMDTVTEARLAIALAQEGGIGFIHKNMSIERQAEEVRRVKKHESGIVSDPQTVLPTTTLHEVKALTERNGFAGYPVVTEDNELVGIITGRDVRFVTDLNQPVSVYMTPKERLVTVREGETRDVVLAKMHEKRVEKALVVDANFHLRGMITVKDFQKAERKPNACKDEHGRLRVGAAVGAGAGNEQRVDALVAAGVDVLLIDSSHGHSEGVLQRIRETRAKYPDLQIIGGNVATGAGARALAEAGCSAVKVGIGPGSICTTRIVTGVGVPQITAVSDAVEALEGTGIPVIADGGIRFSGDIAKAIAAGAAAVMVGSMLAGTEESPGEIELYQGRSYKSYRGMGSLGAMSKGSSDRYFQTDNAADKLVPEGIEGRVAYKGRLKEIIHQQMGGLRSCMGLTGCGTIDLLRTKAEFVRISGAGIQESHVHDVTITKESPNYRLGS

SEQ ID NO: 6823 - protein, 115 aa, Enterobacter cloacae
SSSLFRYVACWKMRKLNRLPKPDTIQSAGAVVLSRPNSTGESMSITCPDCHAALEPQNGIAHCDSCNKDIPLEARCPDCHQPLQVLKACGAVDYFCQNGHGLISKKRVEFVRAGA

SEQ ID NO: 6824 - protein, 561 aa, Enterobacter cloacae
RSPKSPRTTVWAPDKFPRPAQCRALCFVSLASELASMTENIHKHRILILDFGSQYTQLVARRVRELGVYCELWAWDVTEAQIREFNPSGIILSGGPESTTEENSPRAPQYVFEAGVPVFGVCYGMQTMAMQLGGHVEGSNEREFGYAQVEVVTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVERIRQQVGDDKVILGLSGGVDSSVTAMLLHRAIGKNLTCVFVDNGLLRLNEAKQVMDMFGDHFGLNIVHVEGEQRFLDALKGENDPEAKRKIIGRVFVEVFDEEALKLEDVKWLAQGTIYPDVIESAASATGKAHVIKSHHNVGGLPKEMKMGLVEPLRELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVNGISRVVYDISGKPPATIEWE

SEQ ID NO: 6825 - protein, 169 aa, Enterobacter cloacae
TYSADLPSYFCMGCVVEMFALTYTLKKTRRHSMKENDIVEILTTTRSIALVGASDKPDRPSYRVMKYLLDQGYHVIPVSPKVAGKTLLGQQGYATLADVPEKVDMVDVFRNSEAAWGVAQEAIAIGAKTLWMQLGVINEQAAVLARDAGLKVVMDRCPAIDIPRLGLAK

SEQ ID NO: 6826 - protein, 233 aa, Enterobacter cloacae
VAYFPANGSVSKKYRGYCMIFNGIIMKKISYERIYQSQEYLSPLGEIHHRALFGGYTLAVDEAVFAMVSDGELYLRACEQSAKYCVKNASSFLTLMKRGRPVLLNYYRVDEGLWQNREKLLQLSSFALDAARKERYQRHQRNRLKDLPNLTFQIEVLLMEAGITNEETLRQLGAKTSWLKMRSKNKALSIRVLFALEGAIEGLHEAALPADIRRELTEWFNALPESQGHHSAR

SEQ ID NO: 6827 - protein, 691 aa, Enterobacter cloacae
PRGSRQDMELKATSMGKRLAQHPYDKVVLLNAGVKVSGERHEYLIPFNQLLAIHCKRGLVWGELEFVLPADKVVRLHGTEWAETQRFHYHLNTRWQQWSQEMSVIAAQVLQQVLDDIALSNTQQKWLTRQQTAGLQHKIAQALTALPLPVARLEEFDNCRDAWRKCQAWLNDIEKSRLAHNQAWTEAMLTQYADFFSTVESSPLNPAQARAVVNGEQSLLVLAGAGSGKTSVLVARAGWLLTTGEAVADQILLLAFGRKAAQEMDERIQARLHTQDISARTFHSLALHIIQQGSKKVPVVSKLENDAQARQTLFIKAWRQQCSEKKAQAKGWRQWLEEELNWEVPEGSFWQDEKLARRLGSRLDRWVSLMRMHGGSQAEMIESAPESIRAVFSKRVKLMAPMLKAWKTALKDENAVDFSGLIHQAIIILEKGRFVSPWKHILVDEFQDISPQRAALLSALRAQNKHTSLFAVGDDWQAIYRFSGAQLSLTTAFHHYFGEGDRSDLDTTYRFNSRIGEIANRFIQQNPHQLSKPLNSLRSGDKKAVTLLADDQLEPLLDKLSGYAKPDERILVLARYHHLKPTALEKAATRWPKLQLDFMTIHASKGQQADYVIVVGLKEGSDGFPAPARESVMEEALLPVPEDFPDAEERRLLYVAITRARHRVWLLFNKEEPSVFVDILKSIDVPVARKP

SEQ ID NO: 6828 - protein, 252 aa, Enterobacter cloacae
GQIGRICLYVSKRVYRKILIHSYRVVCLQESAMKTGIAWAVVALIMPVCVFATTLRLTTDIDLLVLDGKKVSSSLLRGADSIELDNGPHQLVFRVEKTIRLADDEQQVYISPPLVVSFNTQRISQVNFRLPRLETEKESLAFDASPRIELVDGDSMPIPVKLDILALTKRPKGTDYEADTETYNRASRRASLPQFATMMADDSTLLSGVSELDVLPPQSQTLTEQRLKFWFQNADPDTRARFLQWAKQQPSS

SEQ ID NO: 6829 - protein, 84 aa, Enterobacter cloacae
CVKRGSGTCAPRYPGYANAPECAHPSPAPPCDQRPAAKSGRQPPRPLSEASPRVPPAPTFCRSRRLPALKETARHSPRRAPGQD

SEQ ID NO: 6830 - protein, 398 aa, Enterobacter cloacae
QIMSVRLVLAKGREKSLLRRHPWVFSGAVARMEGKASLGETIDIVDHQGKWLARGAYSPASQIRARVWTFDKEEAIDIDFFVRRLQQAQQWREWLAKRDGLDSYRLIAGESDGLPGVTIDRFGNFLVLQLLSAGAEYQRAALISALQTLFPECAIYDRSDVAVRKKEGMELTQGPVTGELPPALLPIEEHGMKLLVDIQGGHKTGYYLDQRDSRLATRQYVADRRVLNCFSYTGGFAVSALMGGCAQVVSVDTSQEALDVAKQNVELNKLDLSKAEFVRDDVFKLLRKYRDQGEKFDVIVMDPPKFVENKSQLMGACRGYKDINMLAIQLLNPGGVLLTFSCSGLMTTDLFQKIIADAAIDAGRDVQFIEQFRQAADHPVIATYPEGLYLKGFACRVM

SEQ ID NO: 6831 - protein, 115 aa, Enterobacter cloacae
CVCNVSREVTMIASKFGIGQQVRHTLLGYLGVVVDIDPEYSLDEPSADDLAVDAELRAAPWYHVVMEGDDGQPVHTYLAEAQLSGELQDEHPEQPTMDELAQTIRKQLQAPRLRN

SEQ ID NO: 6832 - protein, 150 aa, Enterobacter cloacae
GFMRTVLNVLNFVLGGFATTLSWLFATLVSIVLIFTLPLTRSCWEITKLSLVPYGNEAVHVDELEPERKNALMNTGGTLLNILWLIFFGWWLCLMHIFAGIAQCITIIGIPVGIANFKIATIALWPVGRRVVPVEVAQAAREANARRRFQ

SEQ ID NO: 6833 - protein, 725 aa, Enterobacter cloacae
GLAALMLSPLLRRYTWNSNWLYNVRIFIALCGTVALPWWLNDVKLTIPLTLGVVAGALADLDDRLAGRLRNLVITLVCFFIASASVELLFPWPWLFALGLTVSTSGFILLGGLGQRYATIAFGALLIAIYTMLGVSLYEQWYQQPVLLMLGAIWYNLLTLTGHLIFPVRALQDNIARSYEQLAHYLELKSRLFDPDIEEDSQAPLYDLALANGQLVATLNQTKASLLTRLRGDRGQRGTRRTLHYYFVAQDIHERASSSHVQYADLREKFRYSDVMFRFQRLLSMQSQACQQLARSILLRTPYQHDPCFERAFSHLDAALDRVQASGTSPEQFKALGFLLNNLRAIDAQLATIESEQAMAMPGNDADNQLADDSLNGFSDMWLRLSRHFTPESALFRHAVRMSLVLCVGYAFIQITGLHHGYWILLTSLFVCQPNYNATRHRLALRIVGTLVGVAIGLPVLYFVPSVEGQLLLIVITGVLFFAFRNVQYAHATMFITLLVLLCFNLLGEGFEVALPRVIDTLIGCAIAWAAVSFIWPDWRFRNLPRVSDRAMNANCRYLDAILEQYHQGRDNRLAYRIARRDAHNTDAELASVVSNMSTEPRATAEIRETAFRLLCLNHTFTSYISTLGAHREKLTNPDILALLDDAVCYVDDALHHQPADEPRVHQALDELVQRIAHLDPGTDNKAPLVLQQIGLLIALLPEICRLRQQIATWRNDGPATQAAH

SEQ ID NO: 6834 - protein, 160 aa, Enterobacter cloacae
RGNLTDKIMELTTRTLPARKHIALVAHDHCKQMLLNWVRRHQPLLQHHALSATGTTGNLIHRETGLEVNAMLSGPMGGDQQVGAQISEGKIDVLIFFWDPLNAVPHDPDVKALLRLATVWNIPVATNLSTADFIIESPQFNDPVEILIPDYQRYLAERLK

SEQ ID NO: 6835 - protein, 223 aa, Enterobacter cloacae
GNKMKKRVLVIAALVSGALAVSGCTTNPYTGEREAGKSGIGAGIGSLVGAGVGVLSSSKKDRGKGALIGAAAGAALGGGVGYYMDVQEAKLRDKMKGTGVSVTRSGDNIILNMPNNVTFDSSSATLKPAGANTLTGVAAVLKEYNKTAVNVIGYTDSTGSQDLNMRLSQQRADSVASSLITQGVEANRIRTSGMGPANPIASNSTAEGKAQNRRVEITLSPVQ

SEQ ID NO: 6836 - protein, 194 aa, Enterobacter cloacae
PMQRCGWVSQDQLYIDYHDKEWGVPETDGKKLFEMICLEGQQAGLSWITVLKKRENYRKAFHQFDPAAVAAMTDDDVQKLVLDTGIIRHRGKIQAIIGNARAYLAMEQNGEPFSAFVWSFVDNEPKVTQAATLAEIPTSTPASDALSKALKKRGFKFVGTTICYSFMQACGLVNDHITGCFCHPEGHHDPQMAK

SEQ ID NO: 6837 - protein, 389 aa, Enterobacter cloacae
KQNGNPVAVLVFAPSPVGEGWGEGIRPPPGKLLDSPDFPAKVFSLNSGKSAMIKPTRATISDVAKAAKTGKTSISRYLNGEKHLLSDALLARIEQAIADLDYRPSLMARGLKRGRTRLIGLIIADITNPYSVNVLSGIEAACREKGFTPLVCNTNNEVDQELHYLDLLRSYQVEGIVVNAVGMREEGLNRLQQSSLPMVLIDRKIPEFACDVVGLDNTQAATTATEHLIEQGFEAILFLSEPLGMVNTRRDRLAAFRATLARYPGVIAENAEIPLHEAGQLDNTLRQFHTRHRGMRKAVISANGALTLQVARSLKRIGLHWGSDIGLLGFDELEWAELAGVGITTLKQPTWQIGYAAVEQVVRRIEGTRDAVREQVFSGELIVRGSTAR

SEQ ID NO: 6838 - protein, 313 aa, Enterobacter cloacae
TMHKTLDVITIGEAMAMFVATETGELSAVEHFIKRVAGAELNVATGLARLGLNVGWVSRVGNDSFGHFVLDSLKKEGIDAAGVTLDGRFPTGFQLKSKVENGTDPIVEYFRKGSAASHLSVDDYHAAYFSSARHLHLSGVAAALSASSYDLLDHAASAMKAQGKTISFDPNLRPVLWKSEAEMAEKLNRLAFQADWVLPGIKEGMILTGESTPEGIADFYLNRGVKAVVLKTGADGAWFKTADGEQGAVAAVKVDNVIDTVGAGDGFAVGVISALLEGKPLSQAVARGNKIGSLAIQVQGDSEGLPTRAELGV

SEQ ID NO: 6839 - protein, 445 aa, Enterobacter cloacae
ATVYPTDNGGNNLNNRGKPMNSSTNAVKRWWYIMPIVFITYSLAYLDRANFSFASAAGINEDLGITKGVSSLLGALFFLGYFFFQIPGAIYAERRSVRKLIFICLILWGACASLTGVVNNIPALAAIRFILGVVEAAVMPAMLIYISNWFTKSERSRANTFLILGNPVTVLWMSVVSGYLIQSFGWREMFIIEGVPAIIWAFCWWVLVKDKPAQAKWLSEDEKAALQAQLDKEQQGLKAVRNYGEAFRSRNVILLCAQYFTWSIGVYGFVLWLPSIIRSGGENLGMVEVGWLSSVPYLAATIAMIIVSWASDKLQNRKLFVWPLLLIAAFAFIGSWAVGANHFWVSYTLLVIAGAAMYAPYGPFFAIIPEMLPRNVAGGAMALINSMGALGSFFGSWFVGYLNGATGSPSASYIFMGVALFASVWLTLIVKPANNQQLPVGARHA

SEQ ID NO: 6840 - protein, 333 aa, Enterobacter cloacae
ILLKSTEISMKPSVILYKALPEDLQKRLEEHFTVTRVKNLSPETVAQHADAFASAEGLLGSSEKVDAALLEKMPKLRATSTVSVGYDNFDVDALNAPNILLMHTPHALTETVADTLNALVLNTARPVMEIGERVKAGEWTKSIGPDWFGVDVHGKTLGIVGMGRIGLALAQRAHFGFNMPILYNARRHHSEAEERFNALYCELDTLLREADFVCLILPLTDETRHLIGKAAFEKMKKSAIFINAGRGPVVDEKALIEALQNGEIHAAGLDVFEQEPLPVDSPLLTMPNVVALPHIGSATHETRYNMAATAVDNLIAALGGKVDKNCVNPQIQQ

SEQ ID NO: 6841 - protein, 168 aa, Enterobacter cloacae
LFHLREQQHVINVLSAVTRLGANLLAVGDVIRHGVGVEPHLTLHGEQIGAKSKLLQNSKHVLLFESALRIITRTALTNKHTAQRELRGGIAGVAAVSYKILFLRQFRGGIAVITEDTHMIPARRFADNEDHVSIIQPVSRSLVGELFGWVNQRFHIAGFVRLSPGIKT

SEQ ID NO: 6842 - protein, 183 aa, Enterobacter cloacae
KNAALSLWAPPSVTPLCRPAGWSMTTLRAASAIRRATMIRKWQSENTAPLLSLWLESTTEAHPFIDASYWQANEAVVRDEYLPAAETWVWEENGTLCGFISVMQFQFVGALFVAPAFIGKGIGRALLNHVQQHYPYLTLEVYQKNVRAVNFYHAQGFRIEDSAWQDDTQHPTWIMSWQADQTP

SEQ ID NO: 6843 - protein, 76 aa, Enterobacter cloacae
VTGSALAFSAFIRAHGRIWRWKEGGICKNGALNVLTQDLPSSKLGNGCAGNTALAWVEKYEGPALTLTAFDPPASS

SEQ ID NO: 6844 - protein, 124 aa, Enterobacter cloacae
HISPNSALSGVALMMIKKISGRHAASGLVGVSVCLLFCHTAFAWQQEYIVSDAQSNTTERYTWDADHQPRYEDILAERINRTQNAYGVYPERSLRFGCGNRSERWLEFSRGGTFHHRARHGVAH

SEQ ID NO: 6845 - protein, 107 aa, Enterobacter cloacae
DPYLARLEKTKQGQDLKPVYDQVYEKVVTKPSNALQPLIPAAQVFTQQLVQVGDFISEQGTQVSFVSNGIQFPTSQQASQYNALIGPLASQHQAFSQAWSAAVAATE

SEQ ID NO: 6846 - protein, 97 aa, Enterobacter cloacae
PFLHRLKICNAIHQAGRHNIFVNKVISMSAKMTGLVKWFNADKGFGFITPDDGSKDVFVHFSAIQNDGYKSLDEGQKVSFTIESGAKGPAAGNVVSL

SEQ ID NO: 6847 - protein, 177 aa, Enterobacter cloacae
KKSVVAMLLLAWWVFQSACFFVTPLLRGNRNISFQMHKVIRRNVIHGTPITNLVMKIFSRSVLTAPRMPTGFTLNDPSGSDAETVLSVGWNFPVAGHFTTGPVMAWRTDGAPPVTVNAFEDTTTTQSLTDPLWHASVNSLGWRVDTQYGDLHPWAKISYNQQTEEEYLYTLGLSAKF

SEQ ID NO: 6848 - protein, 429 aa, Enterobacter cloacae
DSAGLYTPSPRVVCMKYIRSLTQQRLCLMLAVYIGLFLNGAVLFRRVEGYFEHLTVRNGIFAAIEVFGSILATFFLLRLLSLFGRRTWQVLASLVVIISAAASYYMTFMNVVIGYGIVASVMTTDIDLSKEVVGQGFILWTILTCLIPLFFIWSNTCRYTLLRQLRTRGQRIRNVAVVLLAGLLVWAPIRLMEKQQKRIEKATGVDMPSYGGVVANSYLPSNWLSALGLYAWAQADESSDVKSLINPTKKFTYQAPADGLDDTYVVFVIGETTRWDHMGILGYDRDTTPKLAQEKNLVAYRGYSCDTATKLSLRCMFVREGGASDNPQRTLKEQNVFAVLKQLGFSSDLFAMQSEMWFYTNTMADNIAYREQIGAEPRNRGKNVDDMLLLSEMEQSLKNHPQGKHLIVLHTKGSHYSLHARGRGYRAMR

SEQ ID NO: 6849 - protein, 743 aa, Enterobacter cloacae
IASMKGRNTCTQPGAHALSTSTKTILTAAHWGPMLVETDGDTVLSSRGALPSRHLNSLQTVVRDQVHSKTRVRWPMVRKGFLASPDKPQGIRGQDEFVRVSWDDALALIHTQHKRIRDSYGPSSIFAGSYGWRSNGVLHKAATLLQRYMSLAGGYTGHLGDYSTGAAQAIMPYVVGGNEVYQQQTSWPLVLEHTEVVVLWSANPLNTLKIAWNASDEQGVSYFDALRKSGKRIICIDPMRSETLDFFGNSAEWIAPHMGTDVAMMLGIAHTLVENGWHDTEFLARCTTGFDKFADYLTGQSDGIAKTAEWAAAICGVNAVKIRELAALFHSHVTMLMTGWGMQRQQFGEQKHWMLLTLAAMLGQIGTPGGGFGLSYHFANGGNPTRKAAVLASMQGSVQGGVDAVDKIPVARIVEALENPGGFYQHNGQDRHFPDIKFIWWAGGANFTHHQDTNRLIRAWQKPELVVISECFWTASAKHADIVLPATTSFERNDLTMTGDYSNQHMVPMKRVVAPRDEARDDFDVFADLSEMWEAGGRERFTEGKTDLQWLETFYQIASQRGAAQGVSLPPFAEFWEANQLFEMPESEQNARFVRFADFRRDPENHPLKTESGKIVIYSERIASFGYADCPPHPAWLEPDEWHGNAQPGQLQLLSAHPAHRLHSQLNYSALREQYAVAGREPIALNSDDAKARGINDGDLVRVWNARGQVLAGAVVSDGIRPGVFCIHQGAWPDLALEGGRYL

SEQ ID NO: 6850 - protein, 407 aa, Enterobacter cloacae
FILQDTAMNTSTYNRTRWLTLFGTIVTQFALGSVYTWSLFNSALSDKLGAPISQVAFSFGLLSLGLAISSSVAGKLQERFGVKRVTMASGILLGLGFFLTAYSNNLMMLWLSAGVLVGLADGAGYLLTLSNCVKWFPERKGLISAFAIGSYGLGSLGFKFIDAHLLASVGLEKTFMIWGVIVLVMILFGATLMKDAPQQEVKTVNGVVENDFTLAQSMRKPQYWMLAVMFLTACMSGLYVIGVAKDIAQGMVKLDAATAANAVTVISIANLSGRLVLGILSDKIARIRVITLGQVISLVGMAALLFAPLNEATFFAAIACVAFNFGGTITVFPSLVSEFFGLNNLAKNYGVIYLGFGIGSICGSLIASLFGGFYVTFCVIFALLIISLALSTTIRQPQREVYKEAHA

SEQ ID NO: 6851 - protein, 397 aa, Enterobacter cloacae
KCATMLTTLIYRSHLRADAPIQSIIDMVSEANSRNERAGVTGVLLFNGIHFLQLLEGDEAAVMQIYEKICLDTLHFNIVELLSDYAPYRRFGRSGMELIDIRLFSKEECLDRVLQRGTTQHKMLYNDRALRFFRTFIDSAETDNYYELPDRFSWFFSSDQIDVSSVDPAIIEDMYAVIDPLAAQIHSFVLNAKSDNDVIKVNNLLFDLESKKDLLKIAGGFITSSQRVSITLLPLTLLRVPNAIEILLDYIRESNLHPEQVLVEFSESEIIPEIDEFAHSVQILKSCGLSVAINDFGVGNAGLLFLSKFQPEKLKIHPQLIHNIHKDGSKQAILQSLIRCGELLEIRICATGVEQPEEWMWLESAGIFCFQGNLFSKYDKNGYLKIFWPESNEFIQC

SEQ ID NO: 6852 - protein, 285 aa, Enterobacter cloacae
GREVRTHHYRVGERMNLENTLKYHFAKSTMISDSPRATASDSLSGTDIMAAMGMTQERAALGYSAFLGKMGISNNDRERAIELLAQYALTKCDRVAALRKLDARVKPLVMHQLASFAFEDYSRSAASVKQCDCCSGQGFIEADVFTMKSHYTMKLPQWAKDLKQSPSYFEVKRQVKEVAKVLCSTCKGKKVVSCACKDCHGRGKAVNQDLTEKQGVPVLADCKRCGGRGYERIPSTEAYAAVRQITDTISLDTWKKSVKPFYDQLITKFDIEEAWADAQLKQITK

SEQ ID NO: 6853 - protein, 232 aa, Enterobacter cloacae
RGAGMKNLAESIRNFDREQACRVAHNLPEQYTEREQTQQVAQIINGLFVQLAAAFPASLVNRSQDDVDEIRRQWVLAFKENGINTMEQVEAGMRMVRRQERPFLPSPGQFIKWCREGRCVLGVTTADVMAEYWKWRKLVFRYPSSEQYPWPKPVYYHICLELRRRGTDGQLSHKELEREAGDILDRWEKRVLAGKPIPPIRRALAAPVAPKGPTPAELLKTKYQRMKADGRA

SEQ ID NO: 6854 - protein, 103 aa, Enterobacter cloacae
RSCEASFYFKRLKKVEITMKRPNWFQVSDKGGKAIAALHHYATTGTGLPAELIHLIFLRVSQINGCAHCIDIHTRDLIKSGMSVEKIVLCLFWREPSYFILRI

SEQ ID NO: 6855 - protein, 161 aa, Enterobacter cloacae
DGDSGDSQRISLMKEIDVGFTHVAFVVRDLDKSIDFYGRYAGMEVVHRREPDLPEARKVAWLSDLTRPFALVLVQVDAVTDTPLGNFGHLGVACSSIEEIDNKIAMARMEGILRKEPVQTGEPVGYYVFFADPDGNTLELSYGQKVGIEAFRHYDTVPASQ

SEQ ID NO: 6856 - protein, 157 aa, Enterobacter cloacae
AQPKPGLRDLDCKCILADLKYTSAPGQPLAKPDVGVNVKTYQITLPWPPSNNRYYRHNRGRTHISADGVAYRYAVASVIRSARLNIRTAAPLKIRIECHMPDRRRRDLDNLQKAAFDALTKARFWLDDCQVVDYRVVKMPVVKGGKLELTITELENA

SEQ ID NO: 6857 - protein, 297 aa, Enterobacter cloacae
RGASGGSWAKVLTTDQKREAVMLMCDATGLSQRRACRLTGLSLSTCRYEAHRPAADAHLSGRITELALERRRFGYRRIWQLLRREGLHVNHKRVYRLYHLSGLGVKRRRRRKGLATERLPLLRPAAPNLTWSMDFVMDALSTGRRIKCLTCVDDFTKECLTVTVAFGISGVQVTRILDSIALFRGYPATIRTDQGPEFTCRALDQWAFEHGVELRLIQPGKPTQNGFIESFNGRFRDECLNEHWFSDIVHARKIINDWRQDYNECRPHSTLNYQTPSEFAAGWRKGHSENEDSDVTN

SEQ ID NO: 6858 - protein, 152 aa, Enterobacter cloacae
AKYGSAFPGMGRHPEGGLSVAISNPRKPAEELQVVGVDFSGQADVWNVKLFRWVDNKEDSASYRKNVEQLVPAIIYVLPLRYRDRVVKYDSFAYRMARLEKEVSEAKQALMLDAPKKVKLKELGEGIFEMFRVDPDVTAPLLAMVTTMLGAM

SEQ ID NO: 6859 - protein, 329 aa, Enterobacter cloacae
RRKPVCVNRTDFQVQKRSVIAELSMSNTAEIINFPHRTEQPGGRMADLSNGYTKVANEIQQLKPRLRMSGREWQCFEAVIWLTYGWNKKQDRVTNTVIAELTGLSDSHVSDALKSLAERKIIFSQKQGVMKTVGINTDLSAWILDKPKTGKVFPKSGKVLPKTGKTFPETVDTQDYNKNNIKRSSSRNSDESRNQKTQKFLSRHPEAADGIYTPAGKSWGSADDLKAARWIYDRLLTVNASLSEPNWAEWANTIRLMRVQDKRTHYEICDLFQWANRDEFWKDNILSPSSLRKQWDQLTTKRLRATGTAKPSRSGIDLLNTDWIDGVLE

SEQ ID NO: 6860 - protein, 88 aa, Enterobacter cloacae
IYCICIQLFIAEGKMKIELTIDRMKKLPVGAIPALESELLKRLSKQFDGCQITIKRASNDGLTVFGGDKKEVEHIVQETWESADEWFY

SEQ ID NO: 6861 - protein, 97 aa, Enterobacter cloacae; identical to SEQ ID NO: 5897

SEQ ID NO: 6862 - protein, 260 aa, Enterobacter cloacae
YWPKNKPEAQFQLMNLLSLLPVGCDIFVVGENRSGVRSAEQMLEAWAPLTKIDSARRCGLYHGRLEKQTTFDADAFWDEYQLEGLTIKTLPGVFSRDALDTGSKLLLSTLTPHTKGKVLDVGCGAGVLSTVLASHSPKVRLTLCDVSAPAVEASRATLAANGIEGDVIASNVFSDVTGRFDMIMSNPPFHDGMETSLEAAQTLIRGATRHLNSGGELRIVANAFLAYPKVLDETFGFHEVIAQTGRFKVYRTVMTRQAKK

SEQ ID NO: 6863 - protein, 313 aa, Enterobacter cloacae
YRKPFSQLKEVMPTMTQVAKKILVTCALPYANGSIHLGHMLEHIQADVWVRYQRMRGHEVNFICADDAHGTPIMLKAQQLGISPEQMIAEMSQEHQTDFAGFDISYDNYHSTHSDENRELSELIYTRLKENGFIKNRTISQLYDPEKGMFLPDRFVKGTCPKCKSPDQYGDNCEVCGATYSPTELIEPKSVVSGATPVMRDSEHFFFDLPSFSEMLKAWTRSGALQEQVANKMQEWFESGLQQWDISRDAPYFGFEIPNAPGKYFYVWLDAPIGYMGSFKNLCDKRGDTVSFDEYWKKDSDAELYHFIGKDIV

SEQ ID NO: 6864 - protein, 366 aa, Enterobacter cloacae
MKSMNKNFTAIFVMGIVLAGTMSQAEAANTVWDDQQITNIVNDHQDQITQNNADSINRDSATDNRLTQVNDDLQSTKLGVLVVDKMANDAHQKALLAGALADTASLKSETALQGVATNGTAIINLQHVDNIQDSRLTALENAPKPINGADGAKGDKGDTGATGAKGDKGDTGATGAKGDKGDTGVTGAKGEKGDAGATGMKGDKGDTGAQGIAGRNGRDGADGHNGKDGVTTTVTQRQLDTATQAKVAKNSMAVTAATQDLQATRQSLQAMNTNTSQQFKSLRDEVDNNKKQANAGISGAMAMAGLPQVQTNQRVMSSAGGATYNGESALAVGASVNFNSHVIAKVSFSDDTANNMGASVGIGMGF

SEQ ID NO: 6865 - protein, 466 aa, Enterobacter cloacae
RSGGCRSDMMTDKVRIDTVDAHKSNETYLARQAEFESNVRSYPRKLPLAITKAEGVWITDADNKEYLDCLAGAGTLALGHNHPDVLKSIQNVITSGLPLHTLDLTTPLKDAFSEYLLSLLPGQGKEYCLQFTGPSGADAVEAALKLAKKVTGRSGIISFSGGYHGMTHGALSVTGNLSPKEAVDGMMPEVQFMPYPHEYRCPLGIGGEAGVKALTYYFENLINDVESGVRKPAAVILEAVQGEGGVNPAPVEWLQRIRKVTQEHGILLILDEVQAGFARTGKFFAFEHAGIEPDIIVMSKAVGGGLPLAVLGIKKQFDAWAPGHHTGTFRGNQLAMATGLTTLKILKDQNIAGKVAAQGEWLKGQLKEMAKRYPVIGHVRGLGMMIGIEIVKPHEAADHMGCFPGDGELSALIQKKCFEAGLILERGGRNGIVLRLLPSLLISDDELKVFLDKFEQALLAAGVSPA

SEQ ID NO: 6866 - protein, 494 aa, Enterobacter cloacae
PELLITMSDSNPILFSSAQSIEAYQQAIEQSTQAVMQWLKQPEMYQGKTVAELRDRIKLDFNPKGLGNEAAIERAVEFFLKDSLSVHHPQCVAHLHCPSLVVSQAAEVLINATNQSMDSWDQSPSATIIEIKLIEWLRTRVGYQAGDAGVFTSGGTQSNLMGLMLARDAFFARQGHSVQQDGLTGDLRKIRVLCSENAHFSVQKNMALMGLGYQSVVQVKTDEFSRMDLTDLAAKIEQCNANGEQILAIVATAGTTDAGAIDPLRAIAELAAKQNIWVHVDAAWGGALLMSEQYRHYLDGIELVDSVTLDFHKQFFQTISCGAFLLKEARHYELMRYQAAYLNSEFDEEAGVPNLVSKSLQTTRRFDALKLWMSLEALGQEQYAAIIDHGVTLAQQVAAYVKEQSALELVMQPQLASVLFRFRPQAQMDDAGIALLNQKIGDALLESGRANVGVTEHNGITCLKLTLLNPTVTLEDVKILLSLVERTAQEVMAK

SEQ ID NO: 6867 - protein, 132 aa, Enterobacter cloacae
TVCHPFADLHTKSISNDMTGEKMAKRKLLLLGVLVSLAGAAHAAPQASTAPSGIKAYEEQEFIADFTKFKIGDTAPAQYQTPEYTIKQYQLRNLPAPDAGTHWTYMGENYVLIGDADGKIYKAYNGDIFYHR

SEQ ID NO: 6868 - protein, 163 aa, Enterobacter cloacae
LAMPMAKSTKPITEIFSITADTILIRPWQESDRPFLRTLFLHARREAWPWLDSSAWQLEDFDAATLDEEIWVAEQDGHRLGFASVWTNDNFLHNLFVDPQYQRLGVGHLLLEQVQKTFTNTGALKCLVKNERAIAFYHRHGWHIEATGDSPDGEYYLMHYRLG

SEQ ID NO: 6869 - protein, 749 aa, Enterobacter cloacae
SQPGMGTSFRSERNEALMSSYTTDNYGAAAPQQHEVDLVRLLVEMIDHRTMILCVTFLFTLCAGLYAWVTPPVYQADAMVQIESKQDNSLLKGLSQLGTDVSPDVAPEILLLKSRMILGETVDKLGLTQQAKQRVLPVVGRLWQRLQGRGQGKITLGELQIPQVEGKAQELTLTVQEAGKYHLKGENIKAEGRVGKTLVTQGIVLLVTSIEATPGTQFSLKSLTRLETINALKKSLTVTESEKQSGIVTLTLTGEDPDNIARVLNAIADNYLQQNIARQEAQDSRSLDFLQEQLPKIRADLDQAEARLNAYRAQRDSVDLSLEAKSVLDQVVNVENQLNELTFREAEISQLFKKSHPTYRALHEKRQTLERERDRLNNRVSAMPSTQQEILRLSRDVESGRTIYLQLLTRQQELNISRSSAVGNVRIIDEAVTHPDPIKPRKALIIILGALFGLMLAMGTVLVRQAFKRGITLSEQLEAQGLPVLATLPRSQWLWSKTHLRRKNPFSRRWKHKTSDVPFLPVDRPADMFVEAVRGLRTSLYFAMMEAENRIVMISGPTQDCGKTLVATNLAAVAGQSGQRVLFIDADMRQGYVHNIFGLENRYGLSCLLEGKCDFTEVIQHAEKAGIDVITCGPEPLRPLELLLSERFLDIMSWVNEQYDIVIIDTPPVLAVTDASLVARAAGTTLMVARFDKTSVKEMENTVKRLQHVGVKVSGTILNDIVKSAALFYSSGYSQCDYGYASRKKGDRR

SEQ ID NO: 6870 - protein, 168 aa, Enterobacter cloacae
CQRREVRCLPGHRFFTHGRSETMQPDLLDSHVLHQFRTRSPLTHCMTNDVVQTFTANVLLALGASPAMVIEAEEAEQFAALADALLINVGTLTAPRAQSMRRAIESAVAAGTPWVLDPVAVGALAFRTRFCQQILSLKPAAIRGNASEILALAGMSAGGRGVDSTDTA

SEQ ID NO: 6871 - protein, 163 aa, Enterobacter cloacae
PYRNGSLHQIVAAIMFKSILVVCTGNICRSPIGERLLRQHLPDRHIASAGIYGLEGCPADDSAQDVAWRHGISLDGHVARRLTRNLMQGSDLILVMEPEHLRFIAAMAPESRGKSLLFGQWLEPQDIPDPYRKSREAFEYVFGLLGKASQEWARRLGQKGMKH

SEQ ID NO: 6872 - protein, 379 aa, Enterobacter cloacae
GLIHKNKGVGMSSQSQAKSPEALRAMVAGTLANFQHPTLKHNLTTLKALHHVAWLDDTLHIELQMPFVWTSAFDALKEQTSSELLRITGAKAIDWKLSHSIATLKRVKNQPGVNGVKNIIAVSSGKGGVGKSSTAVNLALALAAEGAKVGILDADIYGPSIPNMLGAENQRPTSPDGTHMAPIVAHGLATNSIGYLVTDDNAMVWRGPMASKALLQMLQETMWPDLDYLVLDMPPGTGDIQLTLAQNIPVTGAVVVTTPQDIALIDAKKGIVMFEKVKVPVLGIVENMSMHICSNCGHHEPIFGTGGAEKLAAQYHTQLLGQMPLHISLREDLDSGKPTVVSRPDSEFAQMYRQLAGRVAAQLYWQGEVIPGEIAFRAV

SEQ ID NO: 6873 - protein, 400 aa, Enterobacter cloacae
NGKNHFGTYSIINTIKRYFYSMKNTTVFSILFLIITPLSGCVFSPGQHLDLAGKQVMTTENANDRLEKRIDVYPLTPSLIEKLRPSALKSQANPKLDEQVKNWEYRIGVGDILTVTVWDHPELTTPAGQYRSASDTGNWVNADGTLFYPYVGKLQVAGKTVARVREEITARLNNVIESPQVDVSVASFRSQKAYVTGEVVKSGQQAITNIPLTVMDAVNAAGGLSADADWRNVVLTHNGKDMRLSLYALMQHGDLTQNKLLYPGDILFVPRNDALKVFVMGEVVKQSTLKMDRSGMTLAEALGNAGGLNQNMADATGIFVIRSLPKSERSEKIANIYQLNAQDASAMVLGTEFQLEPYDIVYVTTAPLSRWNRVISQLVPTISGVHDLTETVRYIRSWPQ

SEQ ID NO: 6874 - protein, 279 aa, Enterobacter cloacae
AITDAQMKDSISNYILSWVEENNFTILHIGDLVADIGYSRRTIETWFKEKYRLSLGEYILRRRLSRAAIMLRMTSIPVTDIAYLFHYQSSQGFSRAFKKMMGLTPSEYRCARGWNFDILQPSFLLSEHETPELEVCYLDETFIYTHEFIEHDHLFDTSVHDITKKIKKLLTENRHDIDKIILMPRRPELGKSRSYLVEVLISYALQSDTVTNKKSCIVRGRYARMPFSGSWEIYSAFNKIAFVKAMVNQRLTLRDGIYLMKINGYSDECVDFDVFIPIL

SEQ ID NO: 6875 - protein, 253 aa, Enterobacter cloacae
MDAMNSRQQIILQMVIDQGRVSVVDLAKATGVSEVTIRQDLNLLEKQSYLRRAHGYAVPLDSDDVETRMMNNYALKRELAEFAASLVNNGETVFIENGSSNALLARTLADQKDVTIITVSSYIAHLLKDTRCEVILLGGIYQKKSESMVGPLTRQYVQQVHFSKAFIGIDGWQPDTGFTGRDMMRSDVVNAVLAKECEAIVLTDSSKFGAVHPYTMGPASRFSRVITDERLRDEYRQQLEQDGLTVDIVKKTA

SEQ ID NO: 6876 - protein, 80 aa, Enterobacter cloacae
  UNSURE (53)
QVALDNLRATLAAAGCTFDDLIDVKTFHTDPENQFPAIMEAKKLAFPHPPYPXWTAIGVNWLAGFDFEIKVIARIPTPAN

SEQ ID NO: 6877 - protein, 333 aa, Enterobacter cloacae
DQGTPMEQRRFSGKGHWYHETQSNHSQTDVLPLVPEAANVDDRFLLDLALPDDILASCAGWLAPARTLCHLLFPLDTPVSRLHTLSAYDRLSTALTVAQACGVQRLCNHYAALLAPLPGPDSSRESNRRLAEITQYARQLASSPDVIDDKAQNQLDEVGLTTYDIVLINQIIGFVGFQARVVAVFQALLGHPVRWLPGHHIQPHTLPVSFSRWTATLPAVELKYASALQLEALSRWQAEPALEALTPVLCHEPMLLNLTGEILLNHPLSEGPASSMISAALALLVASPDRFSATQLTPLTGSGLSPEKAINLLTRDAFYGWLNRLRVALGKEE

SEQ ID NO: 6878 - protein, 270 aa, Enterobacter cloacae
AMNIRIKAMGFLSGKRILVTGVASKLSIAYGIAQAMHREGAELAFTYQNDKLKGRVEEFAAQLGSSIVLECDVAQDESIDGMFAELAKAWPKFDGFVHSIGFAPGDQLDGDYVNAVTRDGFKIAHDISSYSFVAMAKSCRAMLNPGAALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFNIAAMNELEIK

SEQ ID NO: 6879 - protein, 646 aa, Enterobacter cloacae
NIMFQDNPLLAQLKQQLHSQTPRAEGVVKATEKGFGFLEVDGQKSYFIPPPQMKKVMHGDRISAVIHTEKERESAEPEALIEPFLTRFVGKVHKKDDRLSVVPDHPLLKDAIPCRAARGVEHDFVEGDWAVAEMRRHPLKGDRGFYAELTQYITFGDDHFVPWWVTLARHNLEKEAPDGVATEMQDEGLERRDLTALDFVTIDSASTEDMDDALYAEETADGKLHLTVAIADPTAWIVEGSKLDEMAKVRSFTNYLPGFNIPMLPRELSDDLCSLRAHEVRPVLACRMTIAADGTIEEDIEFFAATIESKAKLAYDDVSDWLENTGNWKPESDNIAAQIRLLHRVCLSRSEWRQTHALVFKDRPDYRFVLGEKGEVLNIVAEPRRIANRIVEEAMISANICAARVLRDKLGFGIYNVHTGFDPANTEALAALLKTHDVHVDPEEVLTLQGFCKLRRELDAQPSGFLDSRIRRFQSFAEISTEPGPHFGLGLEAYATWTSPIRKYGDMVNHRLLKAIIKGESVARPQDGTTLQMAERRRLNRMAERDVGDWLYARFLNDKAGTDTRFPAEIIDISRGGMRVRLVDNGAVAFIPAPFLHAVRDELVCSQENGTVQIKGETVYKVTDVIDVTIAEVRMETRSIIARPVA

SEQ ID NO: 6880 - protein, 674 aa, Enterobacter cloacae
FVRYSAAAGENVMDDLEQNLLFRYMGTHSPWWRLTADSNALHLAASESADIIQVVALDDEQAALIRQLTVITSSIAMTLPLYGVDVPVHLVGRKINKNEWAGTASAWNDTPSVARDLAQGLSFAEQVVSEANSVIVILDQNGNIQRFNRLSEEYTGLKEQEVIGQNVFKLFMSRSEAAASKRNITGFFRNGSSYEVERWIKTRKGQRLFLFRNKFVHSGSGKNEIFLICSGTDITEERRAQERLRVLANTDTITGLPNRNAIHELISDAITARGDTQVGVVYLDLDNFKKVNDAYGHMFGDQLLQAVALAILSCLDEGQTLARLGGDEFIVMATDTSQGALEAMASRILTRLRQPFRIGLIEVYTGCSLGIALAPQHGNDRESVIRNADTAMYTAKENGRGKFCVFSPEMNQRVFEYLWLDTNLRKALDNDQLLIHYQPKMTWRGEVRSLEALVRWQSPERGLIPPMEFISYAEESGLIVPLGRWVMLDVVRQVAKWRDKGINMRVAVNVSARQLADQTIFSDLKQALKDLNFEYCPIDVELTESCLIENEELALSVIQQFSRLGAQIHLDDFGTGYSSLSQLARFPIDAIKLDQSFVRDIHKQSISQSLVRAIVAVAQALNLQVIAEGVESAKEDAFLTKNGVNERQGYLFAKPMPAAAFERWLKRYQTRNVR

SEQ ID NO: 6881 - protein, 80 aa, Enterobacter cloacae
IDNSGESIMTFTSKKLAAAVVAITVAMSLSACSNWSKRDRNTAIGAGAGALGGAVLTDDSTLGTLGGAAVGGIIGHQVGK

SEQ ID NO: 6882 - protein, 116 aa, Enterobacter cloacae
CITEKGGIMRDANSRLVYSTDTGRIEEPKEKAERPKGDGIVRIQRQTSGRKGKGVCLVTGIDLDDADLVKLAAELKKKCGCGGAVKDGIIEIQGDKRDLIKTLLEAKGMKVKLAGG

SEQ ID NO: 6883 - protein, 289 aa, Enterobacter cloacae
GGGRLFFIPAVKTFDSVHLPRGQVECTPFICSAPLRAHRRKGLVMTSVTSSTSRVVTDSPVVVALDYNNRDAALAFVDGIDPRDCRLKVGKEMFTLFGPQIVRDLHQRGFDVFLDLKFHDIPNTTAHAVAAAAELGVWMVNVHASGGARMMTAAREALVPFGNDAPLLIAVTVLTSMDESDLRDLGVTLSPAEHAERLARLTQQCGLDGVFCSAQEAVRFKSELGRDFKLVTPGIRPAGSESGDQRRIMTPEQALSAGVDYMVIGRPVTQSAHPAETLKAINASLKKGA

SEQ ID NO: 6884 - protein, 468 aa, Enterobacter cloacae
NCARVDNGYAILRLYLCAVRRKMKNITLAEKLIMLSGAALFALIIAVNSFCVNDNPGFRVPMTTYLIVMIALFFLDTIIFIFIQMLYASDRSRFSLFILSLAFLSGLVYFIETIIVIQLPEHAGFTQAAKTNDTAVFYFFRQLSFIVLLALAVRVEKITRRSTLRFRNKISMTLALMMTLVMFPMLAHYLSSYHPAWTLTIAAYEDEHHYPVWDIRYLNVLILLWSALLCYMISVTRLASGIWNSIIVVCLSAIVYNFFLLLLDTYNLSLWYISRAVEVLSKLFVICTLMFHVFNLLKIFGDRVDRDPLTQIYNRKYFYEALPRVRSLRTEKGTSIMMLDIDNFKSINDNWGHLVGDRVILAVVDIIKDSIRDNDIFARLGGEEFGLLLPDTDGKQAMAVAERIRQNVQQRTGPGYHYALPVKVTLSIGVCSAIQNNVNGNDIMRDVDEALYEAKHNGKNRIVTRQAE

SEQ ID NO: 6885 - protein, 304 aa, Enterobacter cloacae
SKTARNALFYKRNSTMTVINQTTCTLFTDAERFTQLAAYYEAERRTVWMMLRATPRPCFNHALIEEIMNLSWLVRQSGFVVDFWVTGSLVPDIYNTGGDLQFFVECIKNNRREALRAYARACVDCVHAASRGFDTGAVTLAMVEGSALGGGFEAALAHHFILAQRDARLGFPEIAFNLFPGMGGYSLVARRAGMKMAEALIYKGETHTAEWYEQHGLVDLLFEPLQSYVSVRTFIDTLQPKLNGVRAMLRARTRVLPLPRSELMDITEDWVDAAFCLEPKDIAYMERLVMLQNRHQATGLRKAS

SEQ ID NO: 6886 - protein, 440 aa, Enterobacter cloacae
NSLLNLFLRTRNDAMSKSENLYSAARELIPGGVNSPVRAFTGVGGTPLFIERADGAYLYDVDGKAYVDYVGSWGPMVLGHNHPAIRNAVIEAAQRGLSFGAPTEMEVKMAELVTELVPTMDMVRMVNSGTEATMSAIRLARGFTGRDKIIKFEGCYHGHADCLLVKAGSGALTLGQPNSPGVPADFAKHTLTCTYNDLDTVRAAFEQYPQEIACIIVEPVAGNMNCIPPQPDFLPGLRALCDEFGALLIIDEVMTGFRVALAGAQSYYGVEPDLTCLGKIIGGGMPVGAFGGRKDVMDALAPTGPVYQAGTLSGNPIAMAAGFACLTEVAQPGIHQTLTDRTTQLANGLLEAAEDAGIPLVVNHVGGMFGIFFTEAKTVTCYQDVVKCDVERFKRFFHLMLEEGVYLAPSAFEAGFMSVAHSEEDINNTIDAARKVFAKL

SEQ ID NO: 6887 - protein, 195 aa, Enterobacter cloacae
MLYQSFPQAERAVPAQAAYMTLWTMQQVVQRGTGRQLGAKYPGLHLAGKTGTTNNNVDTWFAGIDGREVVITWVGRDNNQPTKLYGASGAMSIYQRYLANQSPVPLNLVAPEDIVDMGVDSSGNFICGGGVRTLPVWTTNPDALCQQSQPEEPTGNPFDQSSQPQQPQQQQPQQQEEKKDSDGVAGWIKDMFGGN

SEQ ID NO: 6888 - protein, 777 aa, Enterobacter cloacae
TLNSCRAAYRLLCRQRFAYYSAVIIIILVYVIIHLFHQRSIMALSNTAQPINTSLRKLAVVVATAVAGMSAYAQAAETPKKEETITVTAAPAAQESAWGPAPTIAAKRTATATKTDTPIEKTPQSISVVTREEMDMKQPGTVKQALAYTPSVFATRGASTTYDVVSIRGFTTSSTVNTNQYLDGMKLQGDNYSEASMDPYFLERVELLRGPTSVLYGKSHPGGVVSMVSKRPTTEPLKEIQFKMGTDNLWQTGFDFSDAIDDDGVWSYRLTGLGRSENAQQEMVKSTRYAIAPSFSWRPDDKTDFTFLSNFQSDPDAGYYGWLPREGTVVPYYDANGKAHKLPTDFNEGDEDNKISRRQKMVGYSFAHEFNDTFTVRQNLRYTKINTLYRSVYGNGYIAPAQISRAYVRSDEDLNSFTVDTQLQSKFATGAVDHTLLTGVDYLRMRNDIDADYGTADPISMNNPQHGNANVNVNFPYAMLNRQEQTGLYAQDQAEWDKWVLTLGGRYDFAKTSAFNRNNGTTAEINDQAFTWRGGINYLFDNGITPYFSYSESFEPLSGTTQGGKPFDPARGKQYEAGVKYVPKDLPVVVTAAVYQLTKNNNLTADPANPTSGFSVQGGEIRSRGFELEAKAAVSANVNVTAAYSYTDAEYTHDTWYEGRRPAEVPRNMASLWADYTFHETALSGLTVGAGARYIGNTVTYYSSASPKAYESFNVAGYALADATVKYDLARFGLPGSSVGVNVNNIFDREYVSSCYSEYACYWGAGRQVVATATFRF

SEQ ID NO: 6889 - protein, 713 aa, Enterobacter cloacae
ARDANPDGDSALAGNAVRPRAALPARASGMVLRRDAVGHAFCPRAGQCTGRQGMSTRMARFPMLLLAIIFLAALALTGFNLTTALPREQWAAAFAAPDIDNIQQMLFHYSLLPRLAISLLVGAGLGLVGVLFQQVLRNPLAEPTTLGVATGAQLGITITTLWTLPGALTSQFAALAGACVVGALVFGVAWGKRLSPVTLILAGLVVSLYCGAINQLLVLFHHDQLQSMFMWSTGTLTQTDWSIVQRLWPQLFGGVVLTLLLLRPLTLMGLDDGVARNLGLALSLARLAALTLAIVLSALLVNAVGIIGFIGLFAPLLAKMLGARRLLARLMLAPLIGALILWLSDQLILWLTRVWMEVSTGSVTALIGAPLLLWLLPRLRSISAPAMDAGDKVHAERQSVVWFSLAGLAVLVIASFAALSLGRDATGWHWATGDLLHELMQWRWPRIFSALIAGVMLAVAGCIIQRLTGNPMASPEVLGISSGAAFGVVLMLFLVPGNAFGWLMPAGSIGAAVTLMIILIASGRGGFSPHRMLLAGMALSTAFTMLLMMLQASGDPRMAQILTWISGSTYNATGSQVVHTGIVMIVLLAIVPLCRRWMTILPLGGDTARAVGLALTPTRIALLLLAACLTATATMTIGPLSFVGLMAPHIARMMGFRRTLPHIAISALTGGAILVFADWCGRMVLFPYQIPAGLLSTFIGAPYFIYLLRKQSR

SEQ ID NO: 6890 - protein, 275 aa, Enterobacter cloacae
NPCGHLYDETEQVMNENTPSFEQQQFTRAKRRVSIRRLLNRDKTPLAILLAAAVVGTLAGLVGVAFEKAVNAVLNWRIGTVASFADREWLVWVWAFGLSALFAMVGYFLVRKFAPEAGGSGIPEIEGALEELRPVRWWRVLPVKFIGGMGTLGAGMVLGREGPTVQLGGNVGRMVGDLFRMRSAEARHTLLATGAAAGLSAAFNAPLAGILFIIEEMRAQFRYNLISIKAVFNGVIMSSIVFRVFNGEGAVIEVGKLTNAPVILHYDAADATYPH

SEQ ID NO: 6891 - protein, 324 aa, Enterobacter cloacae
RNAGTYLRYSYGHPASPGRGCTRELCLLMLDSTFISRRRLLTAMALSPLLLKMGPARAAAIDPHRIVALEWLPVELMMALGVTPYGVADIPNYTLWVNEPKLPDSVIDIGLRTEPNLELLTQMKPSYLFWSAGYGPSEETMAKIAPGRGFSFSDGKKPLTMAKNSIHEMAQFLNREAEAKKHLDEFDALIDSLKPRFAHRGDRPLLMVTLLDARHMLVFGNNCLFQEVLDSFGIRNAWEGEMTFWGSTAVGIDRLAAFRDVDVLCFDHGNEREMQTLMATPLWQAMPFVREQRFLRAPAVWFYGATLSAMHFARVLDNALGGKA

SEQ ID NO: 6892 - protein, 310 aa, Enterobacter cloacae
IRLQLLQRVCMLLGSRTPGCCHGDLPLLTSLWARFAVPFLFKLADMQDNKTQSDSTFTLNNLSFRVPGRTLLHPLSLTFPAGKVTGLIGHNGSGKSTLLKMLGRHQPPSEGDILLDDQPLASWSSKAFARKVAYLPQQLPQAEGMTVRELVAIGRYPWHGALGRFGVADREKVEEAIALVGLKPLAHRLVDSLSGGERQRAWIAMLVAQDSRCLLLDEPTSALDIAHQVDVLALVHRLSQQRGLTVIAVLHDINMAARYCDYLVALRGGEMIAQGTPAELMRSETLEHIYGIPMGILPHPAGAAPVSFVY

SEQ ID NO: 6893 - protein, 832 aa, Enterobacter cloacae
IIAGGMKKISTGADNGGTDMSQDPFQEREAEKYANPIPSREFIIEHLTKREKPANREELAVELNIEGEEQIEALRRRLRAMERDGQLVFTRRQCYALPERLDLLKGTVIGHRDGFGFLRVEGRKDDLYLSSEQMKMCIHGDQILAQPLGADRKGRREARVVRVLVPKTSQIVGRYFTDAGVGFVVPDDSRLSFDILIPPEEVMGARMGFVVVVELTQRPTRRTKAVGKIVEVLGDNMGTGMAVDMALRTHEIPYVWPKAVEDQIENLREEVPEESKAGRVDLRDLPLVTIDGEDARDFDDAVYCEKKRGGGWRLWVAIADVSYYVRPHTPLDNEARSRGTSVYFPSQVVPMLPEVLSNGLCSLNPQVDRLCMVCEMTISSKGRLTGYKFYEAVMSSHARLTYTKVWHMLQGDQDLREQYAPLVKHIEELHNLYKTLDQAREERGGISFESEEAKFIFNAERRIERIEQTQRNDAHKLIEECMILANISAARFVEKAKEPALFRIHDKPTTEAVTSFRSVLAELGLELPGGNKPEPRDYAELLESISDRPDAEMLQTMLLRSMKQAIYDPENRGHFGLALQSYAHFTSPIRRYPDLSLHRAIKYLLAHEQGHKGNTTETGGYHYSMEEMLQLGQHCSMTERRADEATRDVADWLKCDFMLDQVGNIFKGVIASVTGFGFFVRLDELFIDGLVHVSSLDNDYYRFDQVGQRLIGESGGQTYRLGDRVEVKVEAVNMDDRKIDFSLISSERAPRNVGKTEREKAKKGGNGKAGGKRRQAGKRVNFEPDSAFRGEKKQKPKAAKKDARKAKKPSTKTQKIAAATKAKRAAKKQQAE

SEQ ID NO: 6894 - protein, 264 aa, Enterobacter cloacae
FPLTLTLSPTGEGKYLLREPSMSEMIYGIHAVQALLERAPERFQEVFILKGREDKRLMPLIHALEAQGVVIQLANRQYLDEKSEGAVHQGIIARVKPGRQYQENDLPDLIAELDNPFFLILDGVTDPHNLGACLRSADAAGVHAVIVPRDRSAQLNATAKKVACGAAENVPLIRVTNLARTMRLLQEENIWIVGTAGEADHTLYQSKMTGRMALVMGAEGEGMRRLTREHCDELISIPMAGSVSSLNVSVATGICLFEAVRQRG

SEQ ID NO: 6895 - protein, 463 aa, Enterobacter cloacae
PQLAYFRVKKCCISEKAMVESIFKQTVILKKMGNNVVVLGTQWGDEGKGKIVDLLTERAKYVVRYQGGHNAGHTLVINGEKTVLHLIPSGILRENVTSIIGNGVVLSPAALMKEMKGLEDRGIPVRERLLLSEACPLILDYHVALDVAREKARGAKAIGTTGRGIGPAYEDKVARRGLRVGDLFDKATFAEKLKEVMEYHNFQLVNFYKAEAVDYQKVLDDVMAIADILTGMVVDVSDLLDQARKRGDFVMFEGAQGTLLDIDHGTYPYVTSSNTTAGGVATGSGLGPRYVDYVLGIIKAYSTRVGAGPFPTELFDETGEFLCKQGNEFGATTGRRRRTGWLDAVAVRRAVQINSLSGFCLTKLDVLDGLKEVKICVGYRMPDGREVTTTPLAADDWEGIEPIYETMPGWSETTFGVKERSGLPKAALDYIKRIEELTEVPIDIISTGPDRTETMILRDPFDA

SEQ ID NO: 6896 - protein, 166 aa, Enterobacter cloacae
LSGWFIIINEYLCGLTAFSLFPEVDVQLTSFTDYGLRALIYMASLPDGKMTSISEVTEVYGVSRNHMVKIINQLSRAGYVAAVRGKNGGIRLGKPAQSIRIGDVVRELEPLSLVNCSSAFCHITPACRLKQALSKAVQSFLKELDNYTLADLVEENQPLYKLLLVE

SEQ ID NO: 6897 - protein, 564 aa, Enterobacter cloacae
PPSHAACMPSVHTYLYCQLKEGDSMHWQTHTVFNQPAPLSNSNLFLSDCALRDAVAREGAEWDVDLLASIGQQLGTAESLELGRLANVNPPELLRYDATGERLDDVRFHPAWHLLMQGLCANRVHNLAWEEEARKGSFVARAARFVLHAQVEAGTLCPVTMTFAATPLLLQSLPKPFHDWLTPLMSDRYDPHLAPGAQKRGLLIGMGMTEKQGGSDVLSNTTKAEKCSDGSYRLVGHKWFFSVPQSDAHLVLAQAKGGLSCFFVPRFLPDGQRNAVRLERLKDKLGNRSNASSEAEFFDAYGWLLGEEGEGVRQILKMGGLTRFDCALGSHGLMRRALSVALYHAHQRQTFGKNLIDQPLMRDVLSRMALVLEGHTALLFRLARAWDNRTDPQEAAWARLFTPAAKYSVCKAGIPFVAEAMEVLGGAGYCEESELPRLYREMPVNSIWEGSGNIMCLDVLRVLAKQSGILDLLADDFAQVKGQDRHFDRSWRQLQQKLRKPQEAQGREIARQLFLLGAGSQMLRHATPPVAQAWCRMMLDTRGGTLMSEQVQNDLLLRATGRVG

SEQ ID NO: 6898 - protein, 61 aa, Enterobacter cloacae
PARISSARREDGRLGPMLYPRAWRRMIATMSQLPDNILRRFGGGLVVAGIVIYYMLRKTIG

SEQ ID NO: 6899 - protein, 460 aa, Enterobacter cloacae
RRYITQYQPVKNAEGQVIGIIFVGVDITHSWNVMREKILNRRLGKSGHFFVLDRSSGKTRGQYLFHASEEGKLPNWDTATQQQLLSDKAGTLERVSADGRTLKVAYTPLPGWNWTIVGEVDKAVLLSSVTTLRDRFLMAGVVLSALFAGLFVILIRRMLTRPLRAVIALARQYAAGDLRASLPVTRQDEVGQLIDAINGIGGGLQKIVLQVREAASEIHLGTNALASDTGEISEQINKQASSVEETSASMEQLAATVQQNAANMEQTQQLVGETSRAVHQGGETVTHAVSTMDDIRDASKRIEDITRVIESIAFQTNILALNAAVEAARAGEHGKGFAVVAQEVRALAARSANAVKEIEQLIGDTLNKVSEGHALSEQTRLAMDAIIVHIDNISQLVTEINHASREQSAGIGQVNLAMTHIGEASHINADRISRSEQTAQTLREKGSHLTRLVSLFQLKA

SEQ ID NO: 6900 - protein, 448 aa, Enterobacter cloacae
GQTKVAPVFRIVNRLLHGAQQHGLQHFRVRTIADGFQQLGVIAWLRLITARQLQAEFSQHGAERGYGFRGWLVVNTEQRRLFGFLNETCRRDVCQDHTLFNQLVRIVTLGLLDTLDTTLSVEDKLRFFALKGDPAALFARLIQRFVEVVQLFDVFDQRRVLFAQILIALQHMPDLGIGQARMGTHHCFVELIARQTSLAGDGHFADHTQAVHLRVEGTQAVGEHFWQHRYNLRREVDRCTAAARFVIQRRVWTYVVAHIRDSHPQTPATTTFFLTVHGIIEVTGVFTINGDQRQIAQIHAACFGLFRHFFTQVFDLVFNRFRPDVRNFMGAQRHIDGHAGAHVIAQHFNDFTHRFCATSWALGEFNHHHKAHACAHYLFRRDENVEAQTAVVRHHKAYARIGKVTANDLAGFRHQHADHARFAAAFTVCTQRLRQDLVAVNTHLHLFG

SEQ ID NO: 6901 - protein, 136 aa, Enterobacter cloacae
DFCRRSAADGHDKAPPRAHGASVRGCQAHSQSASARPSSEFAGHLHPLRPAASRKHQRTQPHCWHLNGYRACPSDAQGARHCVARRVRNAGQKSRTTRPSPARAPDAHRSAARRKTICAPPAGNCHHCISLLWWYY

SEQ ID NO: 6902 - protein, 436 aa, Enterobacter cloacae
IIYSYPVFVRIVMQQDAHKRALIAGSIGNFIEWYEFAVYGFLATVIARNFFQLEGEAELTSLILTWASFAIAFFFRPLGAVVFGRIGDRIGRKPTLIIVLVLMTLATAAIGIVPVYASIGIAAPLIVTLLRILQGLFAGGEYGGAVSLMTEFAPRGKRGLYGAWQSFTVALGLLAGAGIVALLSALLSPEALHAWGWRIPFFLALPMGAVALWLRVSMEETPSFVQQREKPVVTQATTAATFKTILMGIGRVMVWSAAGYTYLVIMPTYLQSALHTGFNQALLIAVISNIGFALTIIPSGMLSDRIGRRTVMIISTVLLLILALPLLKILQAETSTLAVKAIVVLIAGGLVGMLAGPGPAMLSEMFPTRVRYTGLGLAYSLSNAIFSGCTGLIITGLIKETGNLDIPAYYVMATAVVSIFALMTLRKDDHLRSLEE

SEQ ID NO: 6903 - protein, 243 aa, Enterobacter cloacae
TSDRHARRYMSGSFFLSGVSAMAEGPLNESEMAWLEETLISYGHDDASVIDVSELDGMLTAVLSGPVVVEPDTWLVAVWGGEKYIPRWKNDREMNRFIDLCFKHMNDIAERLSEYPDQFEPLFGYNDVDGQSYTVVEEWCYGYMRGVALTDWSSLPEALEADLAVIALHGTEENSEKLDALTEEEYMASIESIQPAALRLYDYWVANPQQPEAKKPIVNGSKLGRNDPCPCGSGKKFKSCCLH

SEQ ID NO: 6904 - protein, 87 aa, Enterobacter cloacae
SAFYLREVTMSIHGHDVLNMMIESGERYTEESLVEAIHARFGEAARFHTCSASEMTAAELVAFLAARGKFIPAADGFSTHESKICRH

SEQ ID NO: 6905 - protein, 310 aa, Enterobacter cloacae
NFHLRDVMSLPPLYALRAFEVAARLNSFSKAAETLNITPGAVSRHVRTLELWFDCELFKRQGPRVEVTEAGRVLAGQLNESFTSIEWACRAFRSENHLLRLKAPSTLTMRWLLDVLRSFRNNHAKPQVEIASVWMDIDTVDFNLEPYDCAILLGNGRFGDTTESQLLFHEWLIPVCTPSLIEPARQRLPQCDLIHPSPDRRDWRRWLRRTGLFPGLDMSSGMVFDTLEQGSIAAMNGHGIAIADLHLTLDALKSGLLALAVQGSYCDRGWLLPRLAKKFTQKREHSASSGLAAKPYPGRSGAGYRLSGIR

SEQ ID NO: 6906 - protein, 113 aa, Enterobacter cloacae
TMKRIIIAGTILLLAGCSINRQAEISSTDAPNGIVRLDYGQAMLQNAWSDEYVNNGTATKACQHMGYATASAYGQPIKTCTLISGSLCLNESVTIQYKCQGYAVTSSSQNPWY

SEQ ID NO: 6907 - protein, 430 aa, Enterobacter cloacae
SVRNNAMTSDGFSLKRCILDAIFSGMIALIIFGPIAGVILDGYSFTFGGQRLAWIVGTVMVGRFLLSAFSATAAGRRLQTRFESDNAGVYVRPPAYKSRMRWIIPLIVTLAICFPFVATKYLLTVAILGLIYVLLGLGLNIVVGLAGLLDLGYVAFYAIGAYGLALGYQYLGLGFWSMLPLAALMAAGAGALLGFPVLRMHGDYLAIVTLGFGEIIRLVLNNWLTFTGGPNGVSAPAPTFFGLEFGRRAKEGGVPFHEFFGLTYNPNMKFIFIYAVLFLVVMLVLYIKHRLTRMPIGRAWEALREDEIACRSMGLNHVLVKLSAFTLGASTAGIAGVFFATYQGFVNPTSFTFFESALILAIVVLGGMGSTVGVVLAAFVLTVTPELLRSFAEYRVLLFGMLMVVMMIWRPRGLIRINRSGFTVRKGVAP

SEQ ID NO: 6908 - protein, 428 aa, Enterobacter cloacae
FDETGLFPYSAPQNESRYGSVVEESVKNRTLGSIFIVAGTTIGAGMLAMPLAAAGVGFGITVVLLGGLWALMCYTALLLLEVYQHVPADTGLGSLAARYLGRYGQWIAGFSMMFLMYALTAAYISGAGELIASSINDGFGASLSPETGAIVFTLIGGGVVCAGTSLVDLFNRFLFSAKILFLVVMLVLLAPHVHKINLLSLPLEKGLALSAIPVIFTSFGFHGSVPSIVSYMNGDIRKLRRVFVIGSAIPLIAYLFWQLVTLGSIDSNTFIGLMAEHSGLNGFLVALRNVVASSHVELAVHLFADLALATSFLGVALGLFDYMADLFQRRNTVAGRLQTGAMTFLPPLAFALFYPRGFVMALGYAGVALSVLALLLPSLLAWKSRQQHPQQGYRVAGGTPMLCVVFGCGVAIILVQILIAAGMLPEVG

SEQ ID NO: 6909 - protein, 331 aa, Enterobacter cloacae
RSAITGRNLLSAGRSDCRRNPLFRCATMSTFFLQQLINGLTLGSVYGLIAIGYTMVYGIIGMINFAHGEVYMISAYLSAIGLALLAFFGLHSFPLLILGTLVFTIVVTGVYGWTIERIAYKPLRNSTRLAPLISAIGMSLILQNYVQLSQGPRQQGVPTMLDGVLRFHLGEGFVQITYTKVFILIASFAGMLVLTWIINRTRLGRMCRAVQQDRKMASILGINTDRIISLVFVIGAAMAGLAGVLITMNYGTFDFYVGFVIGIKAFTAAELGGIGSLPGAMLGGLILGVAEAQFSGMVNSDYKDVFSFGLLVLILIFRPQGLLGRPVVAKV

SEQ ID NO: 6910 - protein, 254 aa, Enterobacter cloacae
KSYCRVSGHRRKRGKSVSEPMLQFQDVDVFYGVIQALKQVSLEVNKGETVALIGANGAGKSTLLMSVFGQPRIRNGQILFCGEDISHKSTHYVATGGIAQAPEGRRIFPDMSVEENLLMGTIPVGNQHAAEDMQSMFDLFPRLKERRNQRAMTLSGGEQQMLAIARALMSRPKLLLLDEPSLGLAPIVVKQIFQTLRELARNGMTIFLVEQNAHHALKLSDRGYVMVNGQIRLSGSGEALLKDPEVRKAYLGGV

SEQ ID NO: 6911 - protein, 184 aa, Enterobacter cloacae
ITNYSVAHREPELINRSCTMLKTEMIDKLNAQMNLELFSSLLYQQMSAWCSYHSFEGAAAFLRRHAQEEMTHMQRLFDYLTDTGSLPRIDNVASPFAEYGSLDELFRATYEHEQLITQKINELAHAAMTSQDYPTFNFLQWYVAEQHEEEKLFKSVLDKLSLAGKSGEGLYFIDKELSTLDTQN

SEQ ID NO: 6912 - protein, 426 aa, Enterobacter cloacae
CSARFAVRGILAVLSMRLLLKCILFSLLFLDLRCHQAFGFIPGAKTSLLRNIIMSLKFTKTPLSLVLAGCLVTAFSAQADIVIGVAGPFTGPNATYGDQYWHGATQAAEDINAAGGINGEKIKLVQGDDACEPKQAVAVANRLVDQDKVKAVVGHFCSSSTMPASEVYSDAGILSITPGSTNPLITERGMSDIFRMCGRDDQQGQVASDFILDKLKAKRVVIIHDKDTYGQGLADATKAALAKRGVKEVMYEGLSRGEKDFNALVTKIGAQKPDVVFFGGCHPEAGPLVRQMREQGVQAKFFSGDCIVNEEMVTAAGGAQYTNGIYMTFGKDPRLIPDGKAVIEKFRTGKFEPEGYTLYAYASVQAIAAAFKATQGTDSAKASEWLKANPVDTVMGKKAWDSKGDLKVSDYVVYQWDDKGKYKEVP

SEQ ID NO: 6913 - protein, 295 aa, Enterobacter cloacae
RSGAMNATILRVEHLMMHFGGIKALNDVNLEVQRGSITALIGPNGAGKTTVFNCLTGFYRASGGNILFNARNKTTNVIQVLGQKFQPGDWLNPAQLGQRLFYKMFGGTHLVNRAGLARTFQNIRLFREMSVVENLLVAQHMRVNRNLLAGVLNTPAYRRAENDALDRAFYWLEVVDLVDCANRLAGEMSYGQQRRLEIARAMCTGPEMICLDEPAAGLNPVETHKLSEIIRFLRDHHDITVLLIEHDMGMVMGISDDIIVLDHGDVIARGKPAEIQHNEKVIAAYLGTDESEVNL

SEQ ID NO: 6914 - protein, 294 aa, Enterobacter cloacae
ALIPLYCPLLCGNKRPLPMLMITSFSNPRVAQAFVDYMATQGIILTIQQHTQTDVWLADESQAGRVNAELARFLENPGDPRYLAASWQSGQTGSGLHYQRFPFLATLRERAGPFTLLLMVACIIVFIIMSVVGDQSVMIALAWPYDPSLQFDVWRYFTHALMHFSVMHILFNLLWWWYLGGAVEKRLGSGKLIVITLISALLSGYVQHKFSGPWFGGLSGVVYALMGYAWLRGERDPDSGIYLQRGLITFALIWLIAGWFDLFGMSIANGAHVTGLAVGLAMALADTLHARKRT

SEQ ID NO: 6915 - protein, 80 aa, Enterobacter cloacae
SFAMGHTPGAFHLTNDTLGAFMRDNDFDTPVMVMCYHGNSSKGAAQYLLQQGYEAVYSVDGGFDAWHRHFPAEVEYAFER

SEQ ID NO: 6916 - protein, 300 aa, Enterobacter cloacae
YGLLPDGLICLVCLSPMVRTLPAWRSGWRWRWPIRSMRESEHNSQGYFMKQTQRHDAIIELVKKQGYVSTEELVEQFAVSPQTIRRDLNDLADQNRILRHHGGAALPSSSVNTSWHDRKATQTAEKERIARKVASQIPNGATLFIDIGTTPEAVAHALLNHENLRVVTNNLNVANTLMQKDDFRIILAGGELRSRDGGIIGEATLDFISQFRLDFGILGISGIDTDGSLLEFDYHEVRTKRAIIENSRHVMLVVDHSKFGRNAMVNMGSISMVDAVYTDVMPPAGVMQVIKDNNLQLELC

SEQ ID NO: 6917 - protein, 810 aa, Enterobacter cloacae
RQMCFLSTGCRFPMSQPTFNKAQFQAALTRQWQRFGLHAANEMTPHQWWQAVSGALAEQLDAQPVAKPVKGQRHVNYISMEFLIGRLTGNNLLNLGWYQEVGDVLKEHDINLTDLLEEEVDPALGNGGLGRLAACFLDSMATVGQSAIGYGLNYQYGLFRQSFADGHQMEAPDDWHRNTYPWFRHNAQLDVQVGIGGKVTKQGLWEPAFTITGEAWDLPVLGYRNGVAQPLRLWQAKHAHPFNLTKFNDGDFLRAEQQGIDAEKLTKVLYPNDNHLAGKKLRLMQQYFQCACSVADILRRHHLAGRKLAQLPDFEVIQLNDTHPTIAIPELLRVLIDEHQLSWDDAWAITSRTFAYTNHTLMPEALECWDEKLVKTLLPRHMQIINKINDQFKTLVEKTWPGDKAVWAKLAVVHDKQVRMANMCVVSGFAVNGVAALHSDLVVKDLFPEYHQLWPTKFHNVTNGITPRRWIKQCNPLLAGLLDKTLKKEWANDLDQLINLEKLADNAKFREQYRAIKLENKVRLAEFVKMRTGIEINPNAIFDIQIKRLHEYKRQHLNLLHILALYKEIRENPQADRVPRVFLFGAKAAPGYYLAKNIILAINKVAAAINNDPKVGDKLKVVFLPDYCVSAAEMLIPAADISEQISTAGKEASGTGNMKLALNGALTVGTLDGANVEIAEKVGEENIFIFGHTVEEVKAIKAKGYDPVKWRKKDKVLDAVLKELESGKYSDGDKHAFDQMLHSMDKQGGDPYLVMADFSAYVEAQKQVDVLYRDQDAWTRACILNTARCGMFSSDRSIRDYQARIWQAKR

SEQ ID NO: 6918 - protein, 696 aa, Enterobacter cloacae
GSAMESKRLDSAAQAAGISLSYINAHGKPQSIGADTKRRLLDAMHKTDAKASGAPVPNVKVFTAGKKMPLAVEGRGEFSWLLTTEEGHQHKGHATGGKTLNLPAKLPEGYHTLTLTRDDQRFHCRVIVAPKRCYEPQALLEGKKLWGACVQLYTLRSDSNWGIGDFGDLKKMLASVGERGGAFIGLNPIHALYPANPESASPYSPSSRRWLNVIYIDVNALDDFKNSKEAQAWWKLETTQQMLKQARDADWVDYASVTALKMAALRLAWKGFAKRDDEQMAAFRQFVMQEGESLYWQAAFDALHAYQVQEDEMRWGWPVWPEAYQSVDTPEVKAFCETHADEVDFYLWLQWLAYSQFAACWQVSQGYNMPIGLYRDLAVGVAEGGAETWCDRELYCLKASVGAPPDILGPLGQNWGLPPMDPHVMAARAYEPFIDLLRANMQNCGALRIDHVMSVLRLWWIPYGETADHGAYVQYPVDDLLSILALESKRHQCMVIGEDLGTVPVEIVSKLRDSGVYSYKVLYFENDHEKTFRAPKAYPEQSMAVATTHDLPTLRGYWESGDLTLGKTLGLYPDEEVLRGLYQDRELAKQGLLDALHKHGCLPKRAGHKASLMSMTPMLNRGLQRYIADSNSALLGLQPEDWIDMAEPVNIPGTSYQYKNWRRKLSTTLEAMFADDGVNRLIKDLDKRRRAVGNKR

SEQ ID NO: 6919 - protein, 88 aa, Enterobacter cloacae
LSRQSRPAHPAARCGGTTDRYCGASRPALPSDGRRQMTDGTGRTDSSGHSQSPTGPPLPWNPGSRLPDVPDRRYPAPGQPLLPADRSG

SEQ ID NO: 6920 - protein, 919 aa, Enterobacter cloacae
LRSAKKINSLVPHSEVKTMLIPSKLSRPVRLDHTVVRERLLAKLSGAHNFRLALVTSPAGYGKTTLISQWAAGKSDLGWYSLDEGDNQQERFASYLIAAIQQATNGHCVTSEVMVQKRQYASLSSLFSQLFIELAEWHRPLYVVIDDYHLITNPVIHESMRFFLRHQPENLTLVVLSRNLPQLGIANLRVRDQLLEIGSQQLAFTHQEAKQFFDCRLTSPIEASESSRLCDDVAGWATALQLIALSARQNNSPTHQSARRLAGINASHLSDYLVDEVLDSVDLSTRHFLLKSSLLRSMNDALIVRVTGIENGQLQLEEIERQGLFLTRMDDHGEWFSYHPLFGSFLRQRCQWELAAELPDIHRAAAESWMAQGFPSEAIHHALAAGDAGMLRDILLNHAWGLFNHSELTLLEESLKALPWESLLENPRLVLLQAWLMQSQHRYSEVNTLLARAEQEMESEMDTTLHGEFNALRAQVAINDGDPDEAERLAMVALDELPLANFYSRIVATSVHGEVLHCKGDLTRSLSLMQQTEQMARRHDVWHYALWSLIQQSEILFAQGFLQAAWENQEKAFQLIREQHLEQLPMHEFLLRIRAQLLWAWSRLDEAESCARQGLNVLSSFQPQQQLQCLALLVQCSLARGDLDNARNHLNRLENLLGNGQYHSDWVSNADKVRVIYWQMTGDKKSAANWLRHTPKPEFANNHFLQSQWRNIARVQILLGDFEPAEIVLEELNENARSLRLMSDLNRNLLLLNQLYWQAGRKNDAQRVLLEALQLANRTGFISHFVIEGEVMAQQLRQLIQLNTLPELDQHRAQRILREINQHHRHKFAHFDENFVERLLNHPEVPELIRTSPLTQREWQVLGLIYSGYSNEQIAGELAVAATTIKTHIRNLYQKLGVAHRQDAVQHAQQLLKMMGYGV

SEQ ID NO: 6921 - protein, 62 aa, Enterobacter cloacae
ITRSTRIFQPRVKISHVNDPGFWLFKEYFNLTIGETIKSWSALETIISVCGLVGVLLLNMVV

SEQ ID NO: 6922 - protein, 350 aa, Enterobacter cloacae
KKEHRMKYVNLGRSGLQVSRLCLGCMSYGEPERLPQPWSLDEKASRPLIRQALEAGINFFDTANIYSGGSSEEITGKALREMARRDEIVVATKTFFPWRNSPNTGFLSRKAIFQSIDDSLMRLGMDYVDLFQIHRFDHSTPVEETMEALHDLVKSGKVRYIGASSMEAWRFAKMQHTAELNGWTRFITMQPQYNLLYREEEREMLPLCEDQGVGVIPWSPMARGRLTRDWSVTSRRTQNDAFALKMYENAALLDKPVIDVVASIAEKHDVPRAHVAIAWLLSKTVITAPIIGATKPEHLSTAISALDFSLSDAEIMELEAHYLPHPVDGIIPPLPDTPPSLTPPSAIQDC

SEQ ID NO: 6923 - protein, 340 aa, Enterobacter cloacae
VDGLVKKIQQRISPGRSMVYIISVSIHSGLNAQGKRFCMQISRADVADLIYFMAIARHRSFSRAAIELGVSASALSHALKGLETRLGVRLLNRTTKSVTPTAAGEELVQSVLQPFDTIEGALESLNRYRNTPTGRIRINAAVEAANLLLAPVMPAFMDRYPDIEIDIVASNRMVDVTDAGFDAGIRYGGTVPEDMVARRLSADIRWVIAASPDYLERYGTPEYPDDLLHHRCISNRLGDDRIYRWELERDGETYQITVPGSVTVNQAETGLVAVLGGAGLMYFPEPLVAPYVKDGRLRLVLTEWSPLEEGFHIYYSSRRQLPTGLRLLIEFIQEARPLGL

SEQ ID NO: 6924 - protein, 179 aa, Enterobacter cloacae
RVRPDMKPADKPVLCVVSSHPIKGASGVPTGFFLAELTHPLKVVEDAGLKTTIASIRGGQPPVDGFDLSDPVNAWFWNETDFQQRLATTPALSELNGSDYSAVFFAGGHGTMWDFRDSQDAQRIIREVYESDGIVAAVCHGPAALVDSKLSSGEYLVKGKNVAAFTNKESSPAGRKEQR

SEQ ID NO: 6925 - protein, 61 aa, Enterobacter cloacae
VVSMSGKGYPKAFKIEAVKQVVERGYSVSSVTTLLDITTHGLYARIKKIAVGFHCPQCIRQ

SEQ ID NO: 6926 - protein, 175 aa, Enterobacter cloacae
KQWRAYSSRACARNEIGKGHRNIALVIDNETDDASKRMVEGYRNVLQNYSFPFNRQLVLTANENVERALLTLINSLSKFSSIVVKRDAYAAEAMRLFREFNIAVPQEVSLLSLEDSPLATQLYPQLTCISWPMESLLHQCVQRIKSIVEGRPLRETELPPIIGKLTPRQSVLEMS

SEQ ID NO: 6927 - protein, 355 aa, Enterobacter cloacae
TRCALLFLKIMRSGRRSGRNIHLTEPCMNYTHLGRTGLKVSRLCLGTMNFGDVTDEKTSARILDEALEAGINFIDTADVYGTEQSPDIQQGSGLSEEIIGRWIQQGGRRDRIVLATKVYQPMGPGPNDRRLSAYHIRKACEDSLRRLKTDHIDVYQMHHIDRYTPWEEIWQAMELLVQQGKVLYIGSSNFAGWDIATAQSVATARHSLGLVAEQSLYNLTARTVELEVIPACRHFGLGLIPWSPLAGGLLGGVLKKMESGRRARPAFSRLIEQYRPQLEAYEGLCEDLDETPSDVALAWLLQNPVVTAPLIGPRTVEQLREALHATTITLSDDTMSCLDEIWPGPGGEAPQAYAW

SEQ ID NO: 6928 - protein, 150 aa, Enterobacter cloacae
KRESPVVSVCKVEIQNFRSIRLLTWLPSPGLNCLIGPGDSGKTTILDAIDLCLGARRNVSFSDTDFFGLDVTQPISITLALGSLPDALRTMETYGNFLYPGVKAVSGDIEKCCYAGNRITTLNNLFDCFNFKRFRITLTAHGHHSLSHLK

SEQ ID NO: 6929 - protein, 302 aa, Enterobacter cloacae
EHIMNNALYNQIRIFQSIAREGNISAAARKLEITPPSVSNALKLLEDHIGHPLFVRTTRRIELTETGQLLLEQTAAAVESLEHSLESIRDQNQEPSGIVRITLSRFAYLLILKPAMAKFCQQYPGIQLEISVYDGTVNVIEERFDLGIRFGDILEGGVVARPLMKPFREGLYASSAYISEHGMPEVPADLSQHKLIGYRFITNNRILPLILNDRGEQLTVEMPGQLISNDIDVMADGIRNGLGIGRLFEPILQLQPDRERFIPVMESYWKTYPPVYLYYPKNAGKTKRVKALIDFLISATGR

SEQ ID NO: 6930 - protein, 429 aa, Enterobacter cloacae
AVSTKSGPDPGEKRPRLMPGNDQINESFLRYREFQFMSKMMHDQHSASVPASRDRRNFLIAGAGLALAATTLGRSGAVMAKPAGQDTSSAPSGAVPVQKETLTTRKLGSLEVSSMGLGCLPMVGYYGGGPRDRKAMVSLIRAAFEQGITFFDTAEVYGPHLSEEFVGEALAPVRDRVVIATKFGFGVEEGKPTSLNSHPDHIRRAVEGSLKRLKTDHIDLLYQHRPDPNVPIEDVAETVKALIREGKVKHWGLSEASAGTIRRAHAVLPVTAVQSEYAMWWREPETRIFPTLEELGIGFVPYCPTARSFLAGAVNPSQRFDSTDRRHNLPRFQPDALAKNMVLLEFAQSWARRKNTTPVQFALAWVMAQRPWIVPIPGTTQYPHLIENSGAPQVRLTDSELREIDAALARIPLQGGRADPFTESQFDKS

SEQ ID NO: 6931 - protein, 324 aa, Enterobacter cloacae
VKSPSVFLPGINHMNGLNHNALTRSAVPIPPCERSLQTVEAQPYFSVSEASLVLEGAVFDRNNNLLFVDAATGRVFKLTPERQLSIVLKENTFGASGLAVHKDGRIFIASVGDMQRGSVRAIEPDGTREQMIVDPEGGFLANDLVFDNQGGFYFTDSRGNSADPQGGVFYVSPNVGSIHAILPGLAVGNGLAIDPDGTLIWATEHAKNRLHRVRLSDATTIAPFGSVVTYQFTGPAPDGARVDSEGNVYVAISGQGRIMVFNRNGLPIGQIVLPDRDKGRNLKSTSLAIRPGHHELFIVTNSGTEPGGAMIFRSGAFAPAPLPF

SEQ ID NO: 6932 - protein, 186 aa, Enterobacter cloacae
RLSGKPAWCKATCPREKGDKIESTCQIVIRCALFGRVKFPMKNIPFWQSKTFDDMTDAEWESLCDGCGQCCLHKLMDEDSDEIYFTNVACKQLNIKTCQCRNYERRFEYEPDCIKLTRENLPTFEWLPHTCAYRLLAEGKDLPTWHPLLTGSKAAMHGERISVRHIAVKESEVRDWEDHIMNHPNR

SEQ ID NO: 6933 - protein, 297 aa, Enterobacter cloacae
DKTSVYAKMAAERGIKPFVNFIKMKRRSLFSVSAALSASARLWYDECNLLKLCNGNLTMVIKAQSPAGFAEEYIIESIWNNRFPAGSILPAERELSELIGVTRTTLREVLQRLARDGWLTIQHGKPTKVNNFWETSGLNILETLARLDHESVPQLIDNLLSVRTNIATIFIRTAFRQHPEDALKVLATANEVEDHADAFATLDYNVFRGLAFASGNPVYGLILNGMKGLYTRIGRHYFANPEARSLALGFYHKLSKLCTEGLHDQVYETVRRYGHDSGEIWHRMQKTLPGDLAIQGR

SEQ ID NO: 6934 - protein, 444 aa, Enterobacter cloacae
LDDCSFAHNGVAMRVVILGSGVVGVTSAWYLSQAGHEVTVIDRESGPALETSAANAGQISPGYAAPWAAPGVPLKAIKWMFQRHAPLAISLDGTQFQLKWMWQMLRNCDTRHYMENKGRMVRLAEYSRDCLKALRASTGIEYEGRQGGTLQLFRTAQQYENATRDIAVLEDAGVPYQLLEASQLAQVEPALAEVAHKLTGGLRLPNDETGDCQLFTQRLARMCEQAGVKFRFNTSVDKLLSEGEKIYGVKCGEEVIKADAYVMAFGSYSTAMLKGILDIPVYPLKGYSLTIPVKEDSGAPVSTILDETYKIAITRFDNRIRVGGMAEIVGFNTELLKPRRETLEMVVGDLFPRGGFIEQATFWTGLRPMTPDGTPIVGRTPYKNLWTNTGHGTLGWTMACGSGQLLSDLISGRTPAIPFDDLSAARYQSGFTPSRPQHLHGAHN

SEQ ID NO: 6935 - protein, 359 aa, Enterobacter cloacae
GVAMSRPILAQLDLQALKDNLQIVRRAAPGSRVWSVVKANAYGHGIDRIWSALGATDGFALLNLEEAILLRERGWKGPILLLEGFFHAQDLPLLDKYRLTTSVHSNWQIKAIQDAKLHAPLDIYLKVNSGMNRLGFQPERVHTVWQQLRALKNVGEMTLMAHFADAEKPDGIADAMVRIEQAAEGLDCPRSLSNSAATLWHPEAHYNWVRPGIVLYGASPSGQWQDIANSGLKPVMTLRSEIIGVQTLKAGDTVGYGSRYRAAGEQRIGIVAGGYADGYPRIAPSGTPVWVDGVRTGTVGTVSMDMLAIDLTPCPQAGIGSPVELWGNEVKIDDVAAAAGTVGYELMCALAPRVPVVTV

SEQ ID NO: 6936 - protein, 210 aa, Enterobacter cloacae
PAIRIDDVKLRWFAFLIVLLAGCSSKHDYQNPPWNPEVPVKRAMQWMPISEQAGKAWGVSPRLITAIIAVESGGNPTLVSKSNAVGLMQLKASTAGREVYRYMGWKGQPSTSELKNPERNISMGTAYLSILEHGILKGIDDPEVMQYALVVSYVNGAGALLRTFSSDRKEAIEEINDMDKDEFFEHVVKNHPSAQAPRYIWKVQKAMDAM

SEQ ID NO: 6937 - protein, 256 aa, Enterobacter cloacae
PRDSLSSIEEPSGVSSYSEQFLKQNPLAVLGVLRDLKKGEVPLRINWSTSQFISKILDVTAEHLIVDLGSQSDENRAALQAENLSVMAETQGAKVEFVLPRLTAIAYQDLPAFIAPLPANLWFVQRREFFRISAPLHPAYFCKAKMPDKKEIRFRLFDLSLGGMGALMDTPKPEGLVEGMRFSQIELDMGGWGRFWFDAQLIAISERKVVDSKNETITTPRLSFRFLNVGPGAERELQRIIFSLEREARERANKVR

SEQ ID NO: 6938 - protein, 312 aa, Enterobacter cloacae
ILIQQGIAMPQFHLIAPSGYCINQEAAQRGVQRLLEMGHQVENQTIIPRRMQRFAGTEAQRLSDINSLATLEGENTIVLAVRGGYGASRLLESIDWAGLAARQQQDPLLICGHSDFTAIQLGLLALHNVITFSGPMLAGNFGAPELDAFTQDHFWRALQNPTFTIEWQGNGPHWECEGQLWGGNLAMLVSLIGTPWLPQITDGILVLEDINEHPFRVERMLLQLSHAGILDRQSAIVLGSFSGSAPNDYDAGYSLETMIDFIRSRLDIPVIAGLDFGHEQQTVTLPLGARAHLVHDNSGSRLTISGHPVLKA

SEQ ID NO: 6939 - protein, 183 aa, Enterobacter cloacae
ACSREMIMLRFLNQCSRGRGAWLLMALTAFALEMVALWFQHVMGLKPCVLCIYERCALFGIMGAGLVGAIAPKSPLRYAAIAIWLYSAGKGIALAWEHTQMQLHPSPFMTCDFAARFPSWLPLDKWLPQVFVASGDCSVRQWEFLTLEMPQWLVGIFVAYFVVALLVLIAQPFKPKKRDLFGR

SEQ ID NO: 6940 - protein, 583 aa, Enterobacter cloacae
GGSKTTLGATAIISLFILGSILVTFSILLSSFSSRLGIPILVIFLAIGMLAGIDGIGGIPFDNYPFAYMVSNLALAVILLDGGMRTQASSFRVALGPALSLATVGVLITSGLTGMMAAWLFNLDIMEGLLIGAIVGSTDAAAVFSLLGGKGLNERVGSTLEIESGSNDPMAVFLTITLIEMIQQHETGLSWMFAWHILQQFGLGIIIGLGGGYLLQQTINRITLPSGLYPLLALSGGILIFAVTTALDGSGILAVYLCGFLLGNRPIRNRHAILQNFDGLAWLAQIAMFLVLGLLVTPSDLLPIAVPALLLSAWMIFFARPLSVFAGLLPFRGFNLRERIFISWVGLRGAVPIILAVFPMMAGLDNARLFFNVAFFVVLVSLLFQGTSLGWAAKKAKVVVPPIGWPVSRVGLDIHPENPWEQFVYQLSADKWCVGASLRDLHMPAETRIAALFRDNALLHPTGSTRLRENDILCVIGRERDLPALGKLFSQSPPVALDQRFFGDFILEASARFADVALIYGLEGGLENRDNQQTLGEIIQQLLGAAPVVGDQVEFAGMIWTVAEKEDNAVRKVGVRPMEEEAE

SEQ ID NO: 6941 - protein, 526 aa, Enterobacter cloacae
KEALQSERATNNEGALMATLDSMSRDSTRLSDGPDWTFELLDVYLAEIDRVAKLYRLDTYPHQIEVITSEQMMDAYSSVGMPINYPHWSFGKKFIETERLYKHGQQGLAYEIVINSNPCIAYLMEENTITMQALVMAHACYGHNSFFKNNYLFRSWTDASSIVDYLIFARNYITDCEERYGVDEVEKLLDSCHALMNYGVDRYKRPQKISLQEEKARQKSREEYLQSQVNMLWRTLPKREEEKTVAEARRYPSEPQENLLYFMEKNAPLLEPWQREILRIVRKVSQYFYPQKQTQVMNEGWATFWHYTILNHLYDEGKVSERFMMEFLHSHTNVVFQPAYNSPWYSGINPYALGFAMFQDIKRICQSPTEEDKYWFPDIAGSDWLETLHFAMRDFKDESFISQFMSPKIMRDFRFFTVLDDDRNNFLEISAIHNEEGYREIRSRLSSQYNLSNLEPNIQVWNVDLRGDRSLTLRYIPHNRAPLDKGRKEVLKHVHRLWGFDVLLEQQNEDGSVELLERCPARLNTL

SEQ ID NO: 6942 - protein, 539 aa, Enterobacter cloacae
CLVLFDGERTSVVEISFGRALWRNFLGQSPDWYKLTLLVFLVVNPVIFLLDPFVAGWMLVAEFIFTLAMALKCYPLLPGGLLALEAVVIGMTSAEHVKNEIASNLEVLLLLIFMVAGIYFMKQLLLFIFTRLLLSIPSKTLLSLAFCLAAAFVSAFLDALTVVAVVISVAVGFYGIYHRVASSRPGDNLQDDSHVEAHNRDVLEQFRAFLRSLMMHAGVGTALGGVMTMVGEPQNLIIAKAAEWHFGEFFLRMAPVSVPVLVCGLATCVLVEKFNLFGYGATLPDQVRQELHKFDEQSRKQRTRQETLRLIAQGFIGVWLIAALAFHLAEVGLIGLSVIILATSLGGVTDEHAIGKAFTEALPFTALLAVFFAVVAVIIDQHLFAPIIAFVLQATPDSQLTLFYLFNGLLSSISDNVFVGTVYINEAKAAMEQGIVSSEQFELLAVAINTGTNLPFRGNPERSGGIPLPADLGAGTTHTTFLWKNGLDGAAVYAGAYPGWFTVHQNYSRSLYAMVIASRYTCGALKFVYTALSKHVPGK

SEQ ID NO: 6943 - protein, 124 aa, Enterobacter cloacae
RCSICLTVCCPLYPITSLSGRYTSMRPKPRWSKGLSAVNSSSCWRWRSTPEPTSPSVATPNGQAAFLFLLTSALAPLIRLSYGRMVWMALPYTLVLTLVGLLCIKITLVPCTQWLLQAGILAAH

SEQ ID NO: 6944 - protein, 61 aa, Enterobacter cloacae
NSFTLRCLSMFQGNDYVAIFEPVLTRSRSVVVDGPDRLCAGNGRAVVSACDGAETLRTVYL

SEQ ID NO: 6945 - protein, 194 aa, Enterobacter cloacae
IMTDYLLLFVGTVLVNNFVLVKFLGLCPFMGVSKKLETAMGMGLATTFVMTMASICAWLIDTWILIPLDMLYLRTLAFILVIAVVVQFTEMVVRKTSPALYRLLGIFLPLITTNCAVLGVALLNINLGHNFLQSALYGFSAAVGFSFVMVLFASIRERLAAADIPAPFRGNAIALVTAGLMSLAFMGFSGLVKL

SEQ ID NO: 6946 - protein, 701 aa, Enterobacter cloacae
NYARLKRLPKTGSGTFRPFRFAIFLWNNMLKLFSAFRKEKIWDFDGGIHPPEMKSQSNGTPLRQIPLATRYVMPLKQHIGAEGELCVKEGDSVLRGQPLTFGRGRMLPIHAPTSGKVVAVAPHTVAHPSALSELSVIIEADGEDRWIERDGWSDYRSHSREALIERIHQFGVAGLGGAGFPTGAKLHGGGDKIETLIINAAECEPYITADDRLMQDCAAQVVEGIRILAHILQPREVLIGIEDNKPQAISMLRAVLADSHDIALRVIPTKYPSGGAKQLTQILTGKQVPHGGRSSDIGVLMQNVGTAYAVKRAVIDGEPLTERVVTLTGESVSRPGNIWARLGTPVRHLLEQAGFCPGNDQLVIMGGPLMGFTLPWLDVPVVKITNCLLAPSLTEMGETQEEKGCIRCSACADACPADLLPQQLYWYSKGQLHDKAQAHNLADCIECGACAWVCPSNIPLVQYFRQEKAEIYAISMEEKRAAEAKARFEARQARLEREKQARQERHKQAAVQPAAKDQDAINAALARVREKKATAAQTVVIAPGEKPDNSEAIAAREARKAEARARQAEKAQNAKPEADIDPRKAAVEAAIARAKARKAGQQTVVVEQEATDPRKAAVEAAIARAKARKAAQLQPAEESEAPVDPRKAAVEAAIARAKARKAAQQDELPAAANDDPRKAAVAAAIARVQAKKAAQQAVNED

SEQ ID NO: 6947 - protein, 350 aa, Enterobacter cloacae
MVFRIASSPYTHNQRQTSRIMMLVCLAALPGIAVQCWFFGWGTLFQLVLGCASAVAAEAAILKLRKMEVTRILSDNSALLTGLLLAISIPPFAPWWMVVLGTVFAVIIAKQLYGGLGHNPFNPAMIGYVVLLISFPVQMTSWLPPHEIAATVPGFMDALHVIFTGHTALGADMNALRMGVDGISQATPLDTFKTSLRAGQSVEQVMKSSIYSGVLAGAGWQWVNLAYLLGGAFLLQQKAIRWHIPVSFLVTLAVCSTLGWVISPESLASPQLHLLSGATMLGAFFILTDPVTASTTNRGRLIFGALAGLLVWLIRSFGGYPDGVAFAVLLANITVPLIDYYTRPRVYGHR

SEQ ID NO: 6948 - protein, 231 aa, Enterobacter cloacae
GVTMSQVKEVIVQGLWKNNSALVQLLGLCPLLAVTSTATNALGLGLATTLVLTLTNFSISVLRRWTPSEIRIPIYVMIIASVVSVVQMLINAYAFGLYQSLGIFIPLIVTNCIVVGRAEAFAVKNNPAISALDGFSIGMGATAAMFVLGSLREILGNGTLFDGADALLGGWAKSLRIEVFHTDTPFLLAMLPPGAFIGLGMMLALKYLIDEKRKRRAAERSVQEGIPEKAV

SEQ ID NO: 6949 - protein, 515 aa, Enterobacter cloacae
TPPLIWDVKKEVYVSTANNKPTDESVSLNAFKQPKAFYLIFSIELWERFGYYGLQGIMAVYLVKQLGMSEADSITLFSSFSALVYGLVAIGGWLGDKVLGTKRVIMLGAVVLAIGYGLVAWSGHDAGVVYMGMATIAVGNGLFKANPSSLLSTCYSKDDPRLDGAFTMYYMSINIGSFFSMLATPWLAAKFGWSVAFALSFVGMLITVVNFLFCRSWVKDYGSKPDFEPVHMGKLLATIVGIVILAAVATWLLHNQGVARAVLGVVALGIVIIFAKEAFAMQGAARRKMIVAFILMLEAIIFFVLYSQMPTSLNFFAIRNVEHSILGIAFEPEQYQALNPFWIMIGSPILAAIYNKMGDRLPMPHKFAIGMVLCSGAFLVLPLGTKFATDAGIVSVNWLILSYALQSIGELMISGLGLAMVAQLVPQRLMGFIMGSWFLTTAGAAIIAGKIANLMAVPDNVTDPLVSLNVYGTVFMQIGIATAVIAVLMLLTAPKLNRMTQDDDKSAKAIKTANA

SEQ ID NO: 6950 - protein, 212 aa, Enterobacter cloacae
HSWNLSKKELPMKLFYKPGACSLASHITLRESGKDFTLDGVDLMKKRLENGDDFFAINPKGQVPALLLDDGTLLTEGVAIMQFLADNVPDRQLLAPTGSIARYKTLEWLNYIATELHKGFTPLFRPDTPEEYKPTVRALLEKKLQYVNDALKDDQWICGSRFTIADAYLFTVLRWARAVKLNMEGLDHVASYMTRVAERPAVAAALKAEGLN

SEQ ID NO: 6951 - protein, 114 aa, Enterobacter cloacae
FFAKKTPNFVALPEWTVYVFINPFIIRTHYLYGYYPFIWKLINMTVQDYLLKFRKINSLESLEKLFDHLNYTLSDNQDIINMYRAADHRRAELVSGGRLFNVGEVPKSVWRYVV

SEQ ID NO: 6952 - protein, 259 aa, Enterobacter cloacae
FSARWQACWSGLFAALAAIRTAWHLPCCWLTSPFRSSTTTRVHACTVIAKGRAMLKTMQKHGVTLAIFAAALTGLTALVNELTKTTIAEQAMKQQKALFDQVIPSDLYDNDLQKSCFVVQAPQLGKGPHRVYIARKGDNPVGAVMEATAPDGYSGAIQLLVGSDFSGTVLGTRVTEHHETPGLGDKIETRLSDWILHFAGKMIHGEDDPAFAVKKDGGEFDQFTGATITPRAVVNAVKRAGLYAETLPAQINHLSTCEE

SEQ ID NO: 6953 - protein, 155 aa, Enterobacter cloacae
HFAQTMGERMTALPGERIGGWLIAPLAWLLVALLSASLALLLYTTALVTPHAIQTLMSQSALNIATWFVSFVFAIAMWYYTLWLTIAFFKRRKSVPKHYIIWLLVSVLLAVKAFAFSPVSDALAVRQLLFPLLATALLVPYFKRSTRVKKTFVNP

SEQ ID NO: 6954 - protein, 198 aa, Enterobacter cloacae
WSGEVVMSAIWIAIASISVLGLVFGIILGYASRRFAVEDDPVVEKIDELLPQSQCGQCGYPGCRPYAEAVGVQGEKINRCAPGGEAVMLKIAALLNVDPQPVDGDEQAQEPVRALAVIDEANCIGCTKCIQACPVDAIVGATRAMHTVVADLCTGCNLCVAPCPTQCIELRPVETTTENWKWDLQTIPVRNIPVEQHA

SEQ ID NO: 6955 - protein, 223 aa, Enterobacter cloacae
TQRTGRDPRESSMNKEKRIAILTRLRDENPHPTTELNFNSPFELLIAVLLSAQATDVSVNKATALLYPVANTPQAMLELGVEGVKSYIKTIGLFNSKAENVIKTCRILLEKHGGEVPEDRAALEALPGVGRKTANVVLNTAFGWPTIAVDTHIFRVSNRTRFAPGKNVEEVEEKLLKVVPAEFKVDCHHWLILHGRYTCIARKPRCGSCIIEDLCEYKEKVYP

SEQ ID NO: 6956 - protein, 456 aa, Enterobacter cloacae
RTPRWRFILWSFRIRRKVVYRQRCSRLYMENLMASSNLIKQLQERGLVAQVTDEEALAERLAQGPIALYCGFDPTADSLHLGHLVPLLCLKRFQMAGHKPVALVGGATGLIGDPSFKAAERKLNTEDTVQEWVDKIRKQVAPFLDFDCGENSAIAANNYDWFGGMNVLTFLRDIGKHFSVNQMINKEAVKQRLNRDDQGISFTEFSYNLLQGYDFACLNKLHGVSLQIGGSDQWGNITSGIDLTRRLHQNQVFGLTVPLITKADGTKFGKTEGGAVWLDPKKTSPYKFYQFWINTADADVYRFLKFFTFMDIEEINALEEEDKNSGKAPRAQYVLADEVTKLVHGEEGLAAAKRITASLFNGTLSDLSEADFEQLAQDGVPMVEMEKGADLMQALVDSELQPSRGQARKTIASNAITINGEKQADPEYTFTENDRLYGRYTLLRRGKKNYCLVCWK

SEQ ID NO: 6957 - protein, 308 aa, Enterobacter cloacae
LKVCRGVGNHAPFVLTGFGKYNMKNILAIQSHVVFGHAGNSAAEFPMRRLGVNVWPLNTVQFSNHTQYGKWTGCVMPPSHLTEVVQGVADIDQLKRCDAVLSGYLGSAEQGEHILGIVRQVKAANPAAKYFCDPVMGHPEKGCIVAPGVAEFHVRHALPASDIIAPNLIELEILSEHPVNSVEEAVSASRELIAQGPEIVLVKHLARAGLSQDRFEMLLVTKDEAWHISRPLVDFGARQPVGVGDVTSGLLLVKLLQGASLRDALEHVTAAVYEIMIATKTMQEYELQVVAAQDRIAKPEHYFSATQL

SEQ ID NO: 6958 - protein, 377 aa, Enterobacter cloacae
GKRMKSGRYIGVMSGTSLDGVDVVLAAIDENMVAQQASLTWPIPVSLKEEILNICQGQQLTLSQLGQLDVRLGALFADAVLALMQQERLHPQDIVAIGCHGQTVWHEPVGEAPHTMQIGDNNQIVAKTGVTVVGDFRRRDMALGGQGAPLVPAFHQALLAHPVKRMMVLNIGGNPNLSMLIPGQPVRGYDTGPGNMLMDAWIWRQSGKAYDKDAQWASQGKVILPLLQTLLSDPFFALPAPKSTGREYFNYGWLERQLARFPGLAPQDVQATLTELTAVSISEQVLLSGGCERLLVCGGGSRNPLVMARLAALLPGTEVTTTDEAGISGDDMEALAFAWLAWRTVAGLPGNLPSVTGAREASVLGAIFPANPRHNQS

SEQ ID NO: 6959 - protein, 119 aa, Enterobacter cloacae
ALQDQDSLRNLPMKKLLLIAVPFLMTGCSVYNQFVERMQTDTLEYRCDEKPLTVKLNNPRQEASFVYDNKLLTLKQGMSASGARYSDGIYVFWSKGDSATVYKRDRIVLNNCQLQNPKR

SEQ ID NO: 6960 - protein, 228 aa, Enterobacter cloacae
RHPISLSANAMSDNDELQQIAHLRREYTKGGLRRQDLPAEPLVLFERWLKQACETKLVDPTAMVVATVDENGQPYQRIVLLKHYDEKGLVFYTNLGSRKAHHLENNPRISLLFPWHMLERQVMVTGKAERLSTLEVVKYFHSRPRDSQIGAWVSKQSSRISARGVLESKFLELKQKFQQGEVPLPSFWGGFRIPIEQMEFWQGGEHRLHDRFLYQRDNGGWKIDRLAP

SEQ ID NO: 6961 - protein, 385 aa, Enterobacter cloacae
CEVTKNAVVRCYFNSQGTLLMCALSTRPVINKRTARGKTMSENIRVGLIGYGYASKTFHAPLVAGTPGMELAAITSSDETKVRADWPAVPVVTEPKHLFNDPNIDLIVIPTPNDTHFPLAKAALDASKHVVVDKPFTVTLSQARELDALARSLGRLLSVFHNRRWDSDFLTVKALLNEGTLGEIAFFESHFDRYRPQVRDRWREQAGPGSGIWYDLAPHLLDQAVHLFGLPVSMTVDLAQLRPGAQTTDYFHAILSYPQRRIVLHGTMLAAAESARYIIHGARGSYVKFGLDPQEERLKNGERLPQEDWGYDMRDGVVTRAEGEALVEETVLTLPGNYPAYYAAIRDALNGSGENPVPASQAIQIMELIELGIESAKHRATLCLA

SEQ ID NO: 6962 - protein, 257 aa, Enterobacter cloacae
FKRIAVGQLAEEKDGIMISLKNVSKWYGHFQVLTDCSTEVKKGDVVVVCGPSGSGKSTLIKTVNGLEPVQQGEIVVNGTKVNDRKTNLAQLRSHVGMVFQHFELFPHLSIIENLTLAQVKVLKRDKKAAREKGLKLLERVGLSAHADKFPAQLSGGQQQRVAIARALCMDPVAMLFDEPTSALDPEMINEVLDVMVELAHEGMTMMVVTHEMGFARKVPNRVIFMDEGKIVEDSPKEEFFANPKSERAKDFLAKILH

SEQ ID NO: 6963 - protein, 177 aa, Enterobacter cloacae
TAILNCTATLARIVIMGGAMGLGNWTPAAEFNIFVDPEAAEIVFQSGLPIVMAGLDVTHRAQIMVQDIERFRTVGNPVATTVAELLDFFMEYHKAEKWGFHGAPLHDPCTIAWLLKPEMFTTVERWVGVETQGKYTQGMTVVDYYSLTGNKPNTTVMVDIDREAFVDLLAERLAYYM

SEQ ID NO: 6964 - protein, 168 aa, Enterobacter cloacae
YFFTTEKNEMTIPAHIWLIDDNGSPLIGECLMPSRLGSTELKSFDHSVWIPTDHNTGKLTGTRLHVPIRFKKEIDRLTPYLFRAVCEGRILKEALIKMYKINDAGIELEYFNIKLENVKITQISPVLFPVGIASKHMEEVEIRYESIEWKYTEGNIMYKDSWNERVTA

SEQ ID NO: 6965 - protein, 344 aa, Enterobacter cloacae
LMIRLYPEQLRAQLNEGLRAAYLLLGNDPLLLQESLDAVRHAAAAQGFDEHHTFQIDNSTDWNAIFSLCQAMSLFASRQTIQILLPENGPNAAINEQLAMLVSLLHGDLLLIVRGNKLTKAQENAAWFTRLTPSAVLVSCQTPEQAHLPKWVAARAKQHNLQLDEAASQLLCYCYEGNLLALAQALDRLALLWPDGKLTLPRVEQAVNDAAHFTPFHWVDALLSAKSKRALHILQQLRLEGSEPVILLRTLQRELLLLNNLKRQSAHTPLRALFDKHRVWQNRRAMTTEAINRLSQEQLRQAVQLLMRAELTLKQDYGQSVWAELESLSLLLCHKALADVFIDG

SEQ ID NO: 6966 - protein, 637 aa, Enterobacter cloacae
FKQRMKLQNSFRDYTAESALFVRRALVAFTGILLLTGVLIANLYNLQIVRYTDYQTRSNENRIKLVPIAPSRGIIYDRNGTPLALNRTIYQIEMMPEKVDNVQDTLNALRSVVDLTDDDIAAFKKERARSHRFTSIPVKTNLTEVQVARFAVNQYRFPGVEVKGYKRRYYPYGSALTHVIGYVSKINDKDVERLDKDGKLANYAATHDIGKLGIERYYEDVLHGQTGYEEVEVNNRGRVIRQLKEVPPQAGHDVYLTLDLKLQQYIETLLAGSRAAVIVTDPRTGGILAMVSMPSYDPNLFVDGISSKDYSGLLNDPNTPLVNRATQGVYPPASTVKPYVAVSALSAGVITRNTSLFDPGWWQLPGSEKRYRDWKKWGHGHLNVTKSLEESADTFFYQVAYDMGIDRLSEWMSKFGYGHYTGIDLAEERSGNMPTREWKLKRFKKPWYQGDTIPVGIGQGYWTATPLQMNKAMMILINDGVVKVPHLLQSTVEDGKKVPWIQPHEPPVGDIHSGYWEIAKDGMYGVANRPNGTAHKYFAGAPYKVAAKSGTAQVFGLKANETYNAHKIAERLRDHKLMTAFAPYDNPQVAVAMILENGGAGPAVGTIMRQILDHIMLGDNNTELPAENPAAAAAEDQ

SEQ ID NO: 6967 - protein, 175 aa, Enterobacter cloacae
WPGLVSSCRSIPTGKCCPKAYKNKGIAMRKQWLGICIAASLLAACTSDDGQQQATVAPPQPAVCNGPIVEISGADPVYEPLNASVNQDYQRDGKSYKIVQDPSRFSQAGFAAIYDAEPGSNLTASGETFDPMQITAAHPTLPVPSYARITNLANGRMIVVRITLHHVARSLRPSN

SEQ ID NO: 6968 - protein, 275 aa, Enterobacter cloacae
VVVPHSAQKLSFSPIFEGSAATLFFLEFTMSIDWNWGIFLQQAPFGNTTYLGWLWSGFQVTVALSITAWIIAFLVGSLFGILRTVPNRFLSSIGTLYVELFRNVPLIVQFFTWYLVIPELLPEDLGMWFKAELDPNVQFFVSSMLCLGLFTAARVCEQVRAAIQSLPRGQKNAALAMGLTLPQAYRYVLLPNAYRVIVPPMTSEMMNLVKNSAIASTIGLVDMAAQAGKLLDYSAHAWESFTAITLAYVLINAFIMLVMNLVERKVRLPGNLGGK

SEQ ID NO: 6969 - protein, 224 aa, Enterobacter cloacae
MYDFDWSSIVPSMPYLLDGLAITLKITVIAIIVGIVWGTLLAVMRLSSFKPLAWFATAYVNVFRSIPLVMVLLWFYLIVPGFLQNVLGLSPKTDIRLISAMVAFSMFEAAYYSEIIRAGIQSISRGQSSAALALGMTHWQSMKLIILPQAFRAMVPLLLTQGIVLFQDTSLVYVLSLADFFRTASTIGERDGTQVEMILFAGGVYFVISLSASLLVSWLKKRTV

SEQ ID NO: 6970 - protein, 202 aa, Enterobacter cloacae
IAESGRWLSAGGNVRQLATILLSLAVLVTAGCGWHLRNTTAVPAQMKTMIFDSSDPNGPLSRAIRNQLRLNDVELIEKGTLRQDVPSLRVLKSTLAKDTASIFQDGRTAEYQMVLTVSAAVLMPGKDIYPISTKVYRSFFDNPQTALAKDAEEQIIIKEMYDKAAEQLIRKLPTIAASTKKGADVIETPDARTPDMPTSLGN

SEQ ID NO: 6971 - protein, 250 aa, Enterobacter cloacae
NRITVSLSGRSWRVSLCCSAIRLWQTYLSMGDMHSLQAMYGGTFDPVHYGHLKPVEILANLIGLQRVIIMPNNVPPHRPQPEATSEQRKAMLALAIADKPLFTLDERELRRDTPSWTSQTLREWRAEQGPMKPLAFIIGQDSLLNFPSWYQYETILENSHLLVCRRPGYPLTMRDAQHQQWLDAHLTDNIEDLHSLPAGKIYLAETPWFDISATLIRERLQQGLDCDDLLPSPVLAYILAHGLYQKSTDV

SEQ ID NO: 6972 - protein, 83 aa, Enterobacter cloacae
DNWEIVGTAQSKEAYGCMLRKGDEDFKKLIDDTIAQAQTSGEAAKWFDKWFKNPIPPKNLNMNFELSDDMKALFKSPNDKALN

SEQ ID NO: 6973 - protein, 193 aa, Enterobacter cloacae
ISFSIRRHIAALTLSQIMLRMENAMAQPIILDCDPGHDDAIALVLALASPELDVKAVTSSAGNQTPDKTLRNVLRMLTLLKRTDIPVAGGAVKPLMRELIIADNVHGESGLDGPALPEPDFAPQNCTAVELMAKVLRESAEPVTLVATGPQTNVALLLNSHPELHSNTRPYRHHGRGNGAGELDASSRVQHLR

SEQ ID NO: 6974 - protein, 903 aa, Enterobacter cloacae
IPAKCICVKGCFDAGVWAMLCGSELPHPLATFVAVLNTGPLAAMQEQYRPEEIESKVQQHWDEKRTFEVTEDESKEKYYCLSMLPYPSGRLHMGHVRNYTIGDVIARYQRMLGKNVLQPIGWDAFGLPAEGAAVKNNTAPAPWTYDNIAYMKNQLKMLGFGYDWSRELATCTPEYYRWEQKFFTELYKKGLVYKKTSAVNWCPNDQTVLANEQVIDGCCWRCDTKVERKEIPQWFIKITAYADELLNDLDNLDHWPDTVKTMQRNWIGRSEGVEITFNVENYDQTLTVYTTRPDTFMGATYLAVAAGHPLAQNAAENNPELATFIDECRNTKVAEADMATMEKKGVDTGFKAIHPLTGEAIPVWAANFVLMEYGTGAVMAVPGHDQRDYEFATKYGLTIKPVILAADGSEPDLSEQALTEKGTLFNSGEFSGLSFEEGFNAIADKLASLGVGERKVNYRLRDWGVSRQRYWGAPIPMVTLEDGTVMPTPEDQLPVILPEDVVMDGITSPIKADPEWAKTTVNGQPALRETDTFDTFMESSWYYARYTCPQYKEGMLDSDAANYWLPVDIYIGGIEHAIMHLLYFRFFHKLMRDAGLVNSDEPAKQLLCQGMVLADAFYYVGANGERNWVSPVDAIVERDEKGRIVKAKDAEGHELVYTGMSKMSKSKNNGIDPQVMVERYGADTVRLFMMFASPADMTLEWQESGVEGANRFLKRVWKLVYEHTSQGDAPALNVAALTEDQQALRRDVHKTIAKVTDDIGRRQTFNTAIAAIMELMNKLAKAPQDGEQDRALMREALLAVVRMLNPFTPHVSFTLWQELKGEGDIDNAPWPVADESAMVENTTLVVVQVNGKVRGKITVAVDATEEQVRERAGQEHLVAKYLEGVTVRKVIYVPGKLLNLVVG

SEQ ID NO: 6975 - protein, 134 aa, Enterobacter cloacae
HLSRDWRQFRYTDWPRIHSCTISFTQGENLQGKALQDFVIDKIDDLKGQDIIAIDVKGKSSITDCMIICTGTSTRHVVSIADHVVQESRAAGLLPLGVEGEATADWVVVDLGDVIVHVMQEESRRLYELEKLWG

SEQ ID NO: 6976 - protein, 156 aa, Enterobacter cloacae
CVKLQLVAVGTKMPDWVQTGFTEYLRRFPKDMPFELVEIPAGKRGKNADIKRILDKEGELMLAAAGKNRIVTLDIPGKPWDTPQLAHELERWKQDGRDVSLLIGGPEGLSPACKAAAEQSWSLSALTLPHPLVRVLVAESLYRAWSITTNHPYHRE

SEQ ID NO: 6977 - protein, 382 aa, Enterobacter cloacae
KPGSRCGGGPIIMTDNPNKKSLWDKIHIDPAMLLILLALLVYSALVIWSASGQDIGMMERKIGQIAMGLVIMVVMAQIPPRVYEGWAPYLYIFCIILLVAVDAFGAISKGAQRWLDLGIVRFQPSEIAKIAVPLMVARFINRDVCPPSLKNTAIALVLIFLPTLLVAAQPDLGTSILIALSGLFVLFLSGLSWRLIGIAVVLVAAFIPILWFFLMHDYQRQRVMMLLDPETDPLGAGYHIIQSKIAIGSGGLRGKGWLHGTQSQLEFLPERHTDFIFAVLAEELGLVGILVLLALYVLLIMRGLWIAARAQTTFGRVMAGGLMLILFVYVFVNIGMVSGILPVVGVPLPLVSYGGSALIVLMAGFGIVMSIHTHRKMLSKSV

SEQ ID NO: 6978 - protein, 174 aa, Enterobacter cloacae
GLLLETVTYPGGKMMNKVAQFYRELVATLTERLRNGERDIDALVEQARARVTQTGELTRTEVEEVTRAVRRDLEEFARSYEESQDEIADSVFMRVIKESLWQELADITDKTQLEWREVFQDLNHHGVYHSGEVVGLGNLVCEKCHHHIAVYTPEVLSLCPKCGHDQFQRRPFEP

SEQ ID NO: 6979 - protein, 147 aa, Enterobacter cloacae
LYAQNTCCSETEAEPGMNTFFKLTALAGLFAITGHAFAVDDITRVDQIPVLKEETQHATVSERVTSRFTRSHYRQFDLDQAFSAKIFDRYLNLLDYSHNVLLASDVEQFAKRKSEVGDELRSGKLDLFYDLYNLSQNRRFDRLFTSE

SEQ ID NO: 6980 - protein, 117 aa, Enterobacter cloacae
KFGRKPPDVTGQNGPAVVCIHRVTQLLRQPVPGGEIPEQQLHQQRRIAKQRYPAADERRPETSPGKPQKHKEQGEQACQHNPRQRHPQSGEKSGEDPVQGLSGQHPLPVQSGHYSCS

SEQ ID NO: 6981 - protein, 280 aa, Enterobacter cloacae
TLINTHRNHIMKKTLTLIAAATLSALSFASWADTLTVGASNTPHAEILEQAKPILAKQGIDLEIKPFQDYILPNTALAGHDIDANYFQHIPYLNSVLKDHAGDKDYDFVSAGAIHIEPIGIYSKKYKSLKDLPEGGKIIMRDAVSEEGRILSIFEKEGVIKLKPGIDKVTARISDIVENPKKLQFTPNVEASLLPQMYNNDEGAAVVINANYAIDAGLDPVHDPIAVESGENNPYANIITVHRGDEKKKDIVALVNVLHSKEIQDWIRTKYKGAVIPVNN

SEQ ID NO: 6982 - protein, 75 aa, Enterobacter cloacae
GNGVMAMGNVTKDEALYQEMCRVVGKVVLEMRDLGQEPKHIVIAGVLRTALANQRVKRSELTTKAMETVVKALAG

SEQ ID NO: 6983 - protein, 343 aa, Enterobacter cloacae
RIRMIVLSNISKVFDNGKLALTAVDNVNLTIEQGQIYGIIGYSGAGKSTLIRLLNGLEKPSAGSVTINGQDISAAKGEALRQARLKISMVFQHFNLLWSRTVKENIAFSMQIAGVPKAQIQARVAELVELVGLKGRENAYPSQLSGGQKQRVGIARALANHPDVLLCDEATSALDPQTTDQILDLLLDINRRFNLTIVLITHEMHVVRKICDRVAVMENGKVVEEGDVLSVFTHPQQPITRQFVRQVSQYAEEETFNTELANDLEGTVIRLTFTGHSTHRPIVGELTLRYGLPFNILHGKMTQTAHGVFGQLWVHVVASDEQLNNILADLKQSDIEGEVIKHG

SEQ ID NO: 6984 - protein, 220 aa, Enterobacter cloacae
RTLSAPEVGSALGCNPGDALHDCAFPAWRRLFLGIALGLALFLTARGGLFHNRTVYSVMSIVVNVFRSIPFIILIVLLIPFTKTVVGTILGANAALPALIVGAAPFYARLVEIALREVDKGVIEATRSMGARLSTLVFRVLLPESSPALVSGMTVTLIALVSYSAMAGVIGAGGLGNLAYLEGFQRNHGDVTLVATVTILIIVFIIQFCGDAITSLLDKR

SEQ ID NO: 6985 - protein, 287 aa, Enterobacter cloacae
RGKTKTTGWRMTMAAKMKGFKKRAQVLGLVAWGLVSAQAQADRLADIKAAGVVKVATFDANPPFGSIDAKTHEIVGYDVDFAKALAKSLGVKLELVATNPANRIPLLQSGKADLIVADITITPERAQVIDFSTPYFVTGQQFLVPAKSPDKLDDYSRARIGAVKGTTGEQALHQRFPQSRVLSYDDIPLALTALRNGNVQAITQDSTILAGLLAQAPDKADFKILPDLLSKEEIGVGVKKGETALLKAVNDELVNLEKNGQAAKIYDVWFGPGSPAPQPRNFKIEAR

SEQ ID NO: 6986 - protein, 302 aa, Enterobacter cloacae
DAVRPGNCRSNRLYRRWTHSGNRVPGAIFQPTVASACEAVPAKSAGSAASGATVMPALDWQGVLAGQPLHWILSGFLTTLWVTLAGIMLASLLALFFMLLRLSGGRLGTSFVSGWVSLFRNTPLLVQLLFWYFAAWNGLPQELRDAVNADHSWSILPGDVWWFTPEFLCSAWGLGVFTSAFLIEEVESGLRSVPAGQREAALAQGFSSWRLFRYILLPQGLANAWQPVVGQYLNLMKLSSLASGIGFAELTYQVRQIESYNAHALEAFTVGTVLYLLTGMVTGSVLVRLGPHSGRKNHDPRI

SEQ ID NO: 6987 - protein, 275 aa, Enterobacter cloacae
KPGNMLSGLFSHSAANAADFSRLEQASVEFRHVDKRYGDHPVLTDINLTIMPGEVVAILGPSGSGKSTLIRLINQLESLSGGEILVDHKPTGQLSGSRLRQLRSRVGFVFQQFNLYAHLTASQNITLALEHVHGWKPMPAQERALALLEKVGMLEKAHRYPAELSGGQQQRVAIARALASSPQIILFDEPTSALDPEMIGEVLLVMKALAHSGITMIVVTHEMQFAREIADRIVFIDGGHILETASPAQFFNQPSHPRARRFLQKVLDPLRQEQL

SEQ ID NO: 6988 - protein, 244 aa, Enterobacter cloacae
RGACWCASAPIQGGKIMIPGFNVIVENLDYLLWGRAIAGEPGGVLLSLLMAAGAAALALPGGIVLACVAWRYPGVVRSALFAWAELIRGIPLIFVIFWMWYLLPLITGRDLPGATTVTLALAWFTAAAVMHSVLAGLRALPSGQNEAALSQGFSTQQTLWRVLLPQALRNILPSLVGIFISLLKDTSLAFIVNVPELTTVAGQVNNRVQIYPAAIFIFTGVIYYLLCCSLELLAKRWRVSRPAL

SEQ ID NO: 6989 - protein, 292 aa, Enterobacter cloacae
LRGGAPPERDFHILPNLKTKTVMKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPGCRSVFTTGAGTNRIKRG

SEQ ID NO: 6990 - protein, 533 aa, Enterobacter cloacae
LSAICISGHTHPAKSVNFAALYADLAILTSGQLYVLLSFHLKIQGLFLSVLKPGETFFIEKISWFYHPVITSSQDMTMTLYHSVTELIGRTPLIQLHKLDTGPCSLFLKLENQNPGGSIKDRVALSMINEAERTGQLRPGGTIIEATAGNTGLGLALIAAQKGYSLILVVPDKMSREKIFHLRALGAQVVLTRSDVNKGHPAYYQDYARRLANELPGAFYIDQFSNAANPLAHRTTTAPELFEQLDGQIDAIVVGVGSGGTLGGLQAWFAEHSPQTEFVLADPAGSVLADQVETGRYHDAGSWLVEGIGEDFIPPLAHIEGVNRAWRITDREAFTTARDLLKTEGILAGSSTGTLLATALKYCQAQTTPKRVVTFACDSGNKYLSKMFNDDWMRQQGLISRPQAGDLSDYIALRHDEGATVTAAPDDTLSTVLARMRLYEISQLPVLDNNKVVGIIDEWDLLRHIGGDADRFSLPVTAAMTRQVEYLDKQAPESALYAIFDRGLVAIIYDGNRFLGLITRSDVLTAWRNRLTK

SEQ ID NO: 6991 - protein, 385 aa, Enterobacter cloacae
KEQKMKNLATLSVHSGEYHDPHGAVMPPIYATSTFAQPAPGEHTGYEYSRSGNPTRHALETAIAELEGGTRGYAFASGLAAISTVLELLDQDSHIVAIDDVYGGTYRLIENVRKRSTGLQVSWVKPDDVAGLEAAIRPDTRMIWVETPTNPLLKLADLEAIADIARRHNAISVADNTFASPVIHRPLEAGFDIVVHSATKYLNGHSDVVAGLAVVGANKDLAERLGYLQNAIGGVLDPFSSFLTLRGIRTLSLRVEKHSANALAIAQWLEQHPQVDSVFYPGLASHPQYALARRQMALPGGMISVVIKGDAQRATEVIRHLTLFTLAESLGGVESLVSQPYSMTHASIPLAQRLANGIVPQLIRLSVGIEDAKDLIADLKQALKK

SEQ ID NO: 6992 - protein, 284 aa, Enterobacter cloacae
GREAHQGKGGFEKMGIGASLKQLGPQGMQISDDVKGTSPDRLTGTDVMAAIGTTSSRARFGLAAFFGKAGISKTDEQLAVQALARYAMDVAPKNVRKAAGGQFGWCMQMLAQFAFADYSRSAATSATCHSCCGTGRTTREQITRKVSYPWGKAPYWACRSRAVRPSDWEQWTEVTEVVPAVCDVCEGKGTISARCRCGGKGEVLDRKATKERGAPVFKTCERCSGNGFSAISSATVHRAILKRLPDLHQSSWSRNWKPFYEMLVDTLRQGERHAAVEFEKATTY

SEQ ID NO: 6993 - protein, 120 aa, Enterobacter cloacae
VLMPAAIPRACRKRGCSGTTTDRSGYCEHHRNEGWQQHQRGQSRHQRGYGSKWDRLRQIVLDRDKHLCQECLRNGRYTPAETVDHIKPKAHGGTDDLSNLESICRGCHKAKTARERLNRN

SEQ ID NO: 6994 - protein, 589 aa, Enterobacter cloacae
PAGRVYESEGLMAKVAEGIRYAERVVAGEIIACEYVRLACQRFLDDLAHGEERGIFFSEPRAQHILNFYNFVPHVKGALAGQPIELMDWHVFILINIFGFVIPLVNEETGETVLRNDGSGRPVMVRRFRTADVEVARKNAKSTLCSGVGLYMAGADGEGGAEVYSAATTRDQARIVFEDAKNMVKKAKATLGRIFEFNKLAIYQEQAASKFEPLSSDANNLDGLNIHCAIVDELHAHKTRDVWDVLETATGARLQSLLFGITTAGFNKEGICYELRDYAIKVLRGLVKDDTFFAIIYTLDEGDDPFDEKVWQKANPGLGICKRWDDLRRLAKKAKEQVSARINFFTKHMNIWVTAESAWMDMMKWEKCEFIAPQHELKTYPSWVGVDLSNKIDICAAAKVWRAPDGHVHADFKFWLPEGRLEKCSRQMAELYRKWAGMDKLILTDGDVIDHAQIKEELQLWVAGESLKEIGFDPWSATQFSLALAEEGLPLVEVPQTVRNFSEAMKEVEALVYGGRFHHSDHPVMNWMMSNVTVKPDRNENIFPNKSTPEAKIDGPAALFTAMSRVLVNGGNDQQDLSGFFNNPIMVGF

SEQ ID NO: 6995 - protein, 291 aa, Enterobacter cloacae
NRPLRSTFLMSKKQLPVAPAGRPCARVTCETLPSALDRWDGGIKAAATDDNSISVFDVIGQDYWGEGVTAKRIAGALRAMNGADVTVNINSPGGDMFEGLAIYNLLREYEGRVTVKVLGIAASAASVIAMAGDDIQIGRGAFLMIHNCWVYAMGNRHDFAELSQSLEPFDNAMADIYAARSGLDMAAVQKLMDAESYIGGSDAVAKGLADSLLSADAVSDGDESPAAALRKLDALLAKTNTPRSERRKLIKALSGGMPGAVTTNDGTPGAAEDIKPETLNSLENALAALVK

SEQ ID NO: 6996 - protein, 406 aa, Enterobacter cloacae
GPFMSEVNEILKKVTASIEDATSKFNAKAEEALTEAKKNGQLSAQTKDVVDKMATELNALKEAEKTLKASLGELEQHVAQMPLNNAAKVTETVGQVVINSEALKAFAASVEGNKRVSVPVHAALLSTDVADGVVEPQRLPGIDTAPKQRLFIRDLIAPGRTSSPAIFWVQQTGFTNAAKVVAEGTAKPYSDIEFATKITPVTTIAHMFKASKQILDDFAQLQSTVDAEMRYGLKYVEEQEILFGDGTGVHLHGIVPQASAFDPAFSVESQNGIDDLRLAMLQAQLARFPASGHVLHFIDWAKIELTKDSLGRYILANPASLTGPTLWGLPVVATEAAAFQGKFLTGAFNAAAQLFDREDANVVISTENADDFEKNMISIRCEERLALAVKRPEAFVYGSFSTGAGS

SEQ ID NO: 6997 - protein, 221 aa, Enterobacter cloacae
MNRETKQMLTLSKFQQATGTSAELAGKWFPVVLAAMQKYDISTPLRQAHFLAQVGHESSGFVRVEESLNYRYGALLAMFGNRISQEDAFRYGRVDSGQNPHPADQKMIGSIIYANRNGNGDRNSGDGYRYRGRGLIQVTGKANYAALVKQLGVDIVKSPELLTQPQYAAESAAAWWSNHGLNAIADSDDVSRITRIINGGTNGLEDRKARLTKAKGVLCSG

SEQ ID NO: 6998 - protein, 315 aa, Enterobacter cloacae
IMGQKIITLSGAATDVLYALFFRGALQSGDLPAKSGAAELRELGFAETRHTATEYQKENYFTFLTAEGQAFAIEHLANTRFGVKQYCSAINIGVELDTTDAQKAIDDLDDKIRNSDAFKVLKDGWSFEKNGTLVINNGQVFITDAKISDGVLSTNYNVKLNDADKGKPHEAGMTLGVEEGKQQATFKADRFKVHEAAQSASNNEETAFNGGLAFGGFPGAISHDGANPADGNNATAEPISSIASATGTATKARLTDEMQELVLKAVRESDLFTSLQTAIAAKAASTAGLQQAVNDAVSNAIRNALKPGGLLYGKC

SEQ ID NO: 6999 - protein, 161 aa, Enterobacter cloacae
EFSIMSGPPKTPTHLRLVRGNPSKRPINENEPKPPSGVPPTPKHFDKQGKYWFKRMADELDAIGVMSQLDARALELLVEAYTEYRHHCDTLEVEGYTYRTETQNGDVLIKAHPAAIMKADAWKRLRAMLGEFGMTPASRTKVNAKGPDAVDPLAEFMKARD

SEQ ID NO: 7000 - protein, 441 aa, Enterobacter cloacae
SHHGRFLMKKNKRPGRVKSALLNWLGVPISLTTGTFWEEWFGTSSSGKVVTADKAIQLSAVWACVRLLSESISTLPLKIYVRQPDGSRKAATDHPAYSILCRRPNSEMTPSRFMLMVVASICLRGNAFIEKKFIANRLVSLVPLLPQNMVVKRLTTGALEYKYTENGNERVIPVKNIMHIRGFGLDGVCGMMPMKTGRDVIGSAMAVEESAAKIFEQGLQSSGFLSSDKALDDTQREKLRGYMAAFTGSKNAGKIMVLEGGLTYQGVTMNPEDAQMLESRAFSIEEICRWFRVPPFMVGHTTKQSSWASSLEGMNLQFLTHTLRPLLVNIEQEIGRCLLDSDDEVFAEFSVEGLLRADSAGRAAYYTSALQNGWMSRNDVRRLENMPPIEGGDIYTVQLNLTQLKNLESSNPAVQALALRELHNHIFPDISFEQSPLKQAA

SEQ ID NO: 7001 - protein, 156 aa, Enterobacter cloacae
IISIFFNSLRVCRDLILMLNLILSQLFNERGIAMSWRVISSVICPNTGIVYSSILGLKFLKLIIWYESDVYLYPGDRIYPTKNGVFINGVFKPISIYNISPYNEMLWSEIKNKMACPYNRNQQEEICTYAVHCNARKCPHGFTTNPLIVSTAKSRH

SEQ ID NO: 7002 - protein, 444 aa, Enterobacter cloacae
KTCSEAPVSVRLMKKLFVQFYLLLFVCFLVMTMLVGLVYKFTAERAGRQSLDDLMKSSLYLMRSELREIPPHDWARTLKELDLNLSFDLRIEPMKDFDLAPPAMQRLRDGDIVALDEKYTFIQRIPRSHYVLAVGPVPYLYYLHQMRLLDLALLGFIAISLAFPVFIWMRPHWQDMLKLESAAQRFGEGHLTERIHFDSGSSFDRLGIAFNQMADNINALIASKKQLIDGIAHELRTPLVRLRYRLEMSENLTGAESQALNRDIGQLEALIEELLTYARLDRPQTELHLSTPDLPVWLQTHINDVQSVNPQRKLLTAITPGAYGALDMRLMERVLDNLMNNAMRYSETTLRIGLDLQGSQAILCVEDDGPGIEPAEREKVFEPFVRLDPSRDRATGGCGLGLAIVRSIAQAMGGSVRCEASELGGARFVFSWPIYHNIPLPVPA

SEQ ID NO: 7003 - protein, 472 aa, Enterobacter cloacae
LFWIWTFHNRKPMEKKLGLSALTALVLSSMLGAGVFSLPQNMAAVASPAALLIGWGITGVGILLLAFAMLLLTRIRPDLDGGIFTYAREGFGELIGFCSAWGYWLCAVIANVSYLVIVFSALSFFTDTPELRLFGDGNTWQSIVGASVLLWIVHWLILRGVQTAASINLVATLAKLVPLGLFVVLAFLAFRLDVFTLDFSGIALGVPVWEQVKNTMLITLWVFIGVEGAVVVSARARNKRDVGRATLLAVLAALGVYLLVTLLSLGVVARPELAEMRNPSMAGLMVKMLGPWGDVIIAAGLIVSVCGAYLSWTIMAAEVPFLAATHKAFPRLFARQNKNSAPSASLWLTNISVQVCLVLIWLTGSDYNTLLTIASEMILVPYFLVGAYLLKIATRPAHYAVGVGACIYGLWLLYASGPMHLLLSVVLYAPGLLVFIYARRTHQLDNALKRREMALIGLLLVAAVPATWMLMG

SEQ ID NO: 7004 - protein, 244 aa, Enterobacter cloacae
TEKEITMGHTQQRPILITGAGRRIGLAHHFLNLRHPVIVSYRTEYPSIEGLRNAGAVCIQADFSTDEGILAFADKVKSTTHGLRAVIHNASTWLPEKAGHSLSETLACMMQIHVNAPYLLNHALQDLLRGHGHAAGDIIHFTDYVVERGSDKHIAYAASKAALDNMTRSFARKLAPEVKVNAIAPAMILFNEGDDAEYRQQALNKSLMKIAPGEKEVIDLIDYLLTSCYVTGRTFAVDGGRPLR

SEQ ID NO: 7005 - protein, 254 aa, Enterobacter cloacae
DCAVYVDVFCDDRRCMNKIVYVEDEPEVGQLIAAYLGKHDMEVVVEPRGDRAEDVVTRENPDLVLLDIMLPGKDGMTLCRDLRTKWDGPIVLLTSLDSDMNHILSLEMGANDYILKTTPPAVLLARLRLHLRQRASGAEREASAPSLTPHKAMRFGTLSIDPVNRQVMLSGELIALSTADFDLLWELATHAGQIMDRDALLKNLRGVSYDGMDRSVDVAISRLRKKLLDNATEPYRIKTVRNKGYLFAPHAWET

SEQ ID NO: 7006 - protein, 329 aa, Enterobacter cloacae
QQHQYMVCARRRIIFMKLKNTLLASALLSATALSANAATELTPEQAAALKPFDHTVIVGRYNSIGDAVAAASKAADKNGAASFYVVDQSDQGNSGNQRVTIALYKDNAPKADEQKNRVINGIVELPKDQAVQLEPYDTVTVQGFYRSQPEVNDAITKAAREKGAYAFYIVRQVDANQGGNQRITAFIYKQDAKKRVVQSPDAIPADSDAGRAALAKGGEEAKKVEIPGVATSAAPSAEVGRFFETQSTKGGRYTVTLPDGTKIEELNKATAAQMVPFDSIKFTGNYGNMTEISYQVAKRAAKKGAKYYHITRQWQERGNNLTISADLYK

SEQ ID NO: 7007 - protein, 313 aa, Enterobacter cloacae
LRAAMTTYDLIERLNTTFREIEQALLTLTGQLQDCRLLAARVFSLPEVAKGAEHDPLNTIEVTQHVGKAALEMTLQHYRRLFIQQQSENRSSKAAVRLPGVICLQTDAATREGIEAQITHINTLKAAFEKIVTVESGLAPAARFEWVHRQLPGLITLNAYRTLTVLRHPATLRFGWANKHIIKNFARDEILAQLEKSLKSPRTVAPWSREQWIERLEQEYHSIASLPADTRLKIKRPVKVQPIARVWYAGQQKQVQYACPTPLIALYDADQGAVVPDIGELLNYDAENVQHRYKPQAQPLQLIIPRLHLYVAQ

SEQ ID NO: 7008 - protein, 404 aa, Enterobacter cloacae
YAELIPHMNQGLIMQKLINSVQNYAWGSKTALTDLYGIANPDNLPMAELWMGAHPKSSSKIEDASGQVRSLRDVIDADKAALLGDKVANRFGELPFLFKVLCADQPLSIQVHPNKKASELGFAKENAAGIPLDAVERNYKDPNHKPELVFALTPFLAMNAFREFSEIISLLQPVAGAHNAIAHFLENPNAEALSELFASLLNMQGEEKSHALAVLKAALNSQQGEPWDTIRVISAFYPDDSGLFSPLLLNVVKLNPGEAMFLFAETPHAYLNGVALEVMANSDNVLRAGLTPKYIDIPELVANVKFVAKPAAELLTQPVKNGAELDFPIPVDDFAFSLHDLSADETAIAQESAAILFCVEGEATLHKDSDRLVLKPGESAFVAANESPVRVSGTGRLARVFNKL

SEQ ID NO: 7009 - protein, 535 aa, Enterobacter cloacae
  UNSURE (527)
PPGFILGIIAMKKSVVAVGVIVALGVIWTGASWYTGKQLESRLAEMMTQANSEIKRSAPEAGLELSYQNYQRGVFTSHMQVVVKPVAGNQNAWLKPGQSVVLDEVVSHGPFPLAQLKKFNLIPSMASARTVLVNNEVTKPIFDMAKNESPFEINTRISYAGDTHSDIDLKALNYEQGTDKVAFSGGNFQLDADRDGKNVSLTGDAASGLVNSVNEYNQKVQLTFNNLKASGNSRMTDFDERIGDQKLSLDKIAIAIEGKEMAVLEGMDLDGKSDVSKDGKSINTQLDYSLKSLKVQNQDLGTGKLSLKIGNIDGQAWHEFSQKYSKESQALLTDAALQQNPQAYQQQAMTVLFNNLPILLKGEPVITVAPLSWKNGKGETNFNLSLFLKDPAATTGEPQTLAQEVDRSVKSLDSKLTIPMDMATEFMTHIAKLEGYGEEDAGKLANQQVKGLAAMGHMFRITKVEDNTISTSLQYANGQVTLNGDKMPLETVCQYVWYGRTLGMPEPAETAAPPAVPQQYTKNPSHXGFFIAGWR

SEQ ID NO: 7010 - protein, 114 aa, Enterobacter cloacae
GKRMGLVIKATLGALVVLLIGVLAKTKNYYIAGLIPLFPTFALIAHYIVASERGIEALRATIVFGMWSIIPYFIYLLSLWYFTGFLRLPLALGGAVVCWSLSAWVLIFFWSRFH

SEQ ID NO: 7011 - protein, 465 aa, Enterobacter cloacae
VMTMHRREKDSMGAIDVPADKLWGAQTQRSLEHFRISTEKMPVSLIQALALTKRAAAKVNQDLGLLDADKATAIINAADEVLAGKHPDEFPLAIWQTGSGTQSNMNMNEVLANRASELLGGLRGMERKIHPNDDVNKSQSSNDVFPTAMHVAAVIAIREQLIPQLNVLKSTLNEKAQAFRDIVKIGRTHLQDATPLTLGQEISGWVAMLEHNLKHIDNSLPHLAELALGGTAVGTGLNTHPEYAVRVAEELAKITGQPFVTAPNKFEALATCDALVHTHGALKGLAASLMKIANDVRWLASGPRCGIGEISIPENEPGSSIMPGKVNPTQCEAMTMLCCQVMGNDVAVNMGGASGNFELNVYRPMVIHNVLQSIRLLADGMESFNEHCAVGIEPNRERISQLLNESLMLVTALNTHIGYDKAAEIAKKAHKEGLTLKASALALGYLTDAEFDAWVRPEAMVGSLR

SEQ ID NO: 7012 - protein, 571 aa, Enterobacter cloacae
LAFKPGSGTSALNKQTEAVSERTMSNKPFHYQDPFPLSQDQTEYYLLTRDYVTVSEFEGQEILKVDPQGLTLLAQQAFHDASFMLRPAHQQQVADILSDPEASENDKYVALQFLRNSDIAAKGILPTCQDTGTAIITGKKGQRVWTGGGDEATLARGVYNTYTEDNLRYSQNAALDMYKEVNTGTNLPAQIDLYSVDGDEYKFLCIAKGGGSANKTYLYQETKALLTPGKLKNYLVEKMRTLGTAACPPYHIAFVIGGTSAESTLKTVKLASTKYYDGLPTEGNEHGQAFRDVQLEQELLAEAQNLGLGAQFGGKYFAHDIRVIRLPRHGASCPVGMGVSCSADRNIKAKINRDGIWIEKLENNPGKYIPEELRKAGEGEAVRVDLNRPMKEILAQLSQYPVSTRLSLNGTIIVGRDIAHAKLKERLDNGEGLPQYIKDHPIYYAGPAKTPDGYASGSLGPTTAGRMDSYVDQLQANGGSMIMLAKGNRSQQVTDACHKHGGFYLGSIGGPAAVLAQGSIKSLECVEYPELGMEAIWKIEVEDFPAFILVDDKGNDFFKQIQSSQCSACVK

SEQ ID NO: 7013 - protein, 312 aa, Enterobacter cloacae
EFKMVKVYAPASSANMSVGFDVLGAAVTPVDGSLLGDTVTVEAAERFSLNNIGRFASKLPSEPRENIVYQCWERFCQEIGKNVPVAMTLEKSMPIGSGLGSSACSVVAALVAMNEHCGKPLNNSRLLALMGELEGRISGSIHYDNVAPCFLGGMQLMIEENGIISQQVPGFDEWLWVLAYPGIKVSTAEARAILPAQYRRQDCIAHGRHLAGFIHACYTRQPQLAAKLMKDIIAEPYRTKLLPGFNEARQASMDIGAQACGISGSGPTLFALCDKPDTAQRVADWLSKHYLQNQEGFVHICRLDTAGARVLG

SEQ ID NO: 7014 - protein, 429 aa, Enterobacter cloacae
RMKLYNLKDHNEQVSFAQAVTQGLGKNQGLFFPHDLPEFQLTEIDELLKQDFVTRSTKILSAFIGDEIPQELLEERVRAAFAFPAPVKQVEPDVGCLELFHGPTLAFKDFGGRFMAQMLTHISGDKPVTILTATSGDTGAAVAHAFYGLKNVRVVILYPKGKISPLQEKLFCTLGGNIETVAIDGDFDACQALVKQAFDDEELKAALGLNSANSINISRLLAQICYYFEAVAQLPQDARNQLVVSVPSGNFGDLTAGLLAKSLGLPVKRFIAATNANDTVPRFLKDGKWAPNATQATLSNAMDVSQPNNWPRVEELFRRKVWRLGDLGYAAVTDETTKATMRELKAVGYTSEPHAAIAYRALRDQLQPGEYGLFLGTAHPAKFKESVEAILGETLPLPKELAERADLPLLSHELPADFAALRKLMMTRA

SEQ ID NO: 7015 - protein, 322 aa, Enterobacter cloacae
KRNTIMTDKLTSLRQFTTVVADTGDIAAMKLYQPQDATTNPSLILNAAQLPEYRKLIDEAVTWAKAQSNDRAQQVVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVYLISPFVGRILDWYKANTDKKEYAASEDPGVISVTEIYEYYKQHGYETVVMGASFRNVGEIIELAGCDRLTIAPALLKELAESEGAIERKLSYTGEVKARPERITESEFLWQHNQDPMAVDKLADGIRKFAIDQEKLEKMIGDLL

SEQ ID NO: 7016 - protein, 178 aa, Enterobacter cloacae
PERDFCRVAATPYRAYNGSERRPGKRSATRLFYGEIKEKNSRKKAEIPNKCGHLAFRIAENNIPRSHHVLSLHRPTLGKKNKESPMSTLKPALIALSLMLVAPMAVQAAEITLVPAVKLQIGDRDNNGHYWDGGRWRDHDWWKAHYDWRDNHWRPHDEHRDRDDHHRHDDRRPDRKHY

SEQ ID NO: 7017 - protein, 449 aa, Enterobacter cloacae
STTHAQWFAMSHNTRPLNRQDYKTLTLAALGGALEFYDFIIFVFFAAVVGALFFPADIPEWLRQVQTFGIFAAGYLARPLGGIVMAHFGDLVGRKKMFTLSILLMAVPTLAIGLLPTYESMGIIAPLLLLLMRILQGAAIGGEVPGAWVFVAEHVPVRRIGIACGTLTAGLTIGILFGSVVATIINTSMTQQAVHDWGWRIPFLLGGAFGLVAMYLRRWLQETPIFLEMQQRKALAQELPVKTVVVRHKKAVVVSMLLTWLLSAGIVVVILMSPVWLQKQYGFAPAVTLQANSIATIMLCFGCLAAGLAADRFGASVTFIVGSLLLAASSWAFYHLAGTHPEQLFLLYGVVGLCVGVVGAVPYVMVRAFPPEVRFTGISFSYNVSYAIFGGLTPIVVTVLMGLSPLAPAWYVLALSLMGLVLGMWLRQSEGRRARDAGTTEGSVFFTNR

SEQ ID NO: 7018 - protein, 821 aa, Enterobacter cloacae
NMRVLKFGGTSVANAERFLRVADILESNARQGQVATVLSAPAKITNHLVAMIEKTIGGQDALPNISDAERIFADLLQGLADAQPGFPLAQLKSTVELEFAQIKHVLHGISLLGQCPDSINAALICRGEKLSIAIMAGVLEARGHHVTVIDPVEKLLAVGHYLESTVDIAESTRRIAASKIPSDHMILMAGFTAGNEKGELVVLGRNGSDYSAAVLAACLRADCCEIWTDVDGVYTCDPRQVPDARLLKSMSYQEAMELSYFGAKVLHPRTISPIAQFQIPCLIKNTGNPQAPGTLIGASADEDDLPVKGISNLNNMAMFSVSGPGMKGMVGMAARVFAAMSRNGISVVLITQSSSEYSISFCVPQGDCLRARRALEEEFYLELKEELLEPLSIQERLAIISVVGDGMRTLRGISAKFFAALARANINIVAIAQGSSERSISVVVDNDDATTGVRVVHQMLFNTDQVIELFLVGVGGVGGALLEQVKRQQEWLKKKHIDLRVCGIANSKALLTNVHGLNLENWQAELEEAKEPFNLGRLIRLVKEYHLLNPVIVDCTSSQAVADQYADFLREGFHVVTPNKKANTSSMDYYHQLRLAASKSRRKFLYDTNVGAGLPVIENLQNLLNAGDELKRFSGILSGSLSFIFGKLDEGMSLSEATRAARELGYTEPDPRDDLSGMDVARKLLILVRETGRELELSDIVIEPVLPAEFDDSGDVSAFMANLPQLDDAFAARVAKARDEGKVLRYVGNIEEDGVCRVKIAEVDGNDPLYKVKNGENALAFYSHYYQPLPLVLRGYGAGNDVTAAGVFADLLRTLSWKLGV

SEQ ID NO: 7019 - protein, 249 aa, Enterobacter cloacae
VCYRPGKTGKNDRRPAVIILRDRVPGHASFPRLCLNFLSACIIPFNQYFLNGMDMNTLRIGLVSISDRASSGVYQDKGIPALEAWLGSALTTPFEIQTRLIPDEQPIIEQTLCELVDEMSCHLVLTTGGTGPARRDVTPDATLAIADREMPGFGEQMRQISLHFVPTAILSRQVGVIRKQALILNLPGQPKSIKETLEGVKAEDGSVIVHGIFASVPYCIQLLDGPYVETDGNVVAAFRPKSARRETIS

SEQ ID NO: 7020 - protein, 499 aa, Enterobacter cloacae
VTACTISGSAYIFTLASTRGTLVPDFFFFINEVLWGSIMIYLLSGAGIWFTWRSGLIQFRYIRKFGRSLKNSVTPQPGGLTSFQALCTSLAARVGSGNLAGVALAIGAGGPGAVFWMWVTAIIGMATSFAECSLAQLYKEKDGKGQFRGGPAWYMARGLGMRWMGVLFSIFLLIAYGLIFNTVQANSVAHALRFAFNCPEWLTGGALALLTLLTIVTGLKGVARLMQWLVPLMALLWVSTSLMVCAIHIDEVPNVIVTIFQSAFGWREAASGALGYTLSQALTAGFQRGMFSNEAGMGSTPNAAAAAASWPPHPAAQGIVQMIGVFTDTIVICSASAMIMLLAGAAEQPSGSTAGIHWVQQALVSLVGGWGAGLVALVVGLFAFSSIAVNYMYAENNLIFLKVNSCLTRNVLRAGVLGMVFVGSLLGMPLVWQIADVIMALMAITNLTAILLLSPVVALIARDYLRQRKLGVQPVFDASRYPEIESQIAPGTWDDLPRQ

SEQ ID NO: 7021 - protein, 279 aa, Enterobacter cloacae
QLSINSGRFFVKVALNFLQGLDMLILISPAKTLDYQSPLATERYTQPELLDYSQQLIHEARKLSAPQIASLMSISDKLADLNATRFHEWQPDFTPANARQALLAFKGDVYTGLQAETFSEADFDFAQQHLRMLSGLYGVLRPLDLMQPYRLEMGIRLENAKGKDLYQFWGDVITDKLNAALQAQGDNVVINLASDEYFKSVKPKKLDADIIKPVFLDEKNGKFKVISFYAKKARGLMSRFIIQNRLTKPEQLTGFNSEGYFFDEASSGKNELVFKRHEQ

SEQ ID NO: 7022 - protein, 187 aa, Enterobacter cloacae
HPYCLFNVSCARRLGLGMTTNLLILHNIGMFPMDGIILPMGIFYGGIAQIFAGLLEYKKGNTFGLTAFTSYGSFWLTLVAILLMPKMGLAEAANAHFLGVYLGLWGVFTLFMFFGTLKANRALQFVFLSLTVLFALLAIGHLADNEGIVHVAGWVGLVCGASAIYLAMGEVLNEQFDRTILPIGEKH

SEQ ID NO: 7023 - protein, 301 aa, Enterobacter cloacae
TTLFAAALAVVGFCKTASAVTYPLPTDGSRLVGENQVVTVPEGNTQPLEYFAAQYQLGLSNMLEANPGVDPYLPKAGTVLNIPQQLILPDTVHEGIVINSAEMRLYYYPKGTNTVIVLPIGIGQLGKDTPLNWTTKVERKKAGPTWTPTAKMHAEYIAAGEPLPTVVPAGPDNPMGLYALYIGRLYAIHGTNANFGIGLRVSHGCVRLRNEDIKFLFDNVPVGTRVQFINEPVKATSEPDGSRYIEVHNPLSTSEDQINNNEIVPIKLTSAVQSVTSQADVDTTIVDQAIQNRSGMPVRLN

SEQ ID NO: 7024 - protein, 336 aa, Enterobacter cloacae
  UNSURE (328)
SMNVTLIDTLVTRSRGLSPWTGFYFLQSLLINFALGYPFSLLYAVGFTCILHLLWRSAPRMQKVLIGICSLVAAAYFPFGQAYGAPNFNTLLALHSTNMEESTEILTIFPWYNYVVGLFIFALGVIAVRRKPVGKKAWGKIESLCLAFSVVTFFVAPVQNMAWGGVFKLKDTGYPVFRFVKDVVVNNEEVLDEQARMAELSTMKDTWNVLAVKPKYHTYVVVIGESARRDALGAFGGHWDNTPFASAVNGTLFTDYVAASGSTQKSLGLTLNRVVDGKPQFQDNFVTLANRAGFQTWWFSNQGQIGEYDTAIASIKKRADEVHFLFFXHDAPNPRY

SEQ ID NO: 7025 - protein, 369 aa, Enterobacter cloacae
MNIPGLQALKRDRFFHLLLITGVGLSVFVPFTPHTWPAAIDWRTIITLSGLMMLTKGVELSGYFDVLGRKMVRRFATERKLALFMVFSAALLSTFLTNDVALFIVVPLTLTLRKLCEIPVTRLIIFEALAVNAGSLLTPIGNPQNILLWGRSGLSFTAFTGQMAPLALAIVASLLAVGWFAFPNKSLQYHSGTTGPQWQPRLVWSCLGLYIVFLIALELNQALAGALLVACGFLFLARRVLVSVDWTLLLVFMAMFIDVHLLIQLPVLQNVLHSVGGLSQPGLWLTAIGLSQVISNVPSTILLLNYVPPTVLLAWAVNVGGFGLLPGSLANLIALRMANDRRIWWRFHLWSIPMLLWSAAVGFGLFLLI

SEQ ID NO: 7026 - protein, 516 aa, Enterobacter cloacae
ERGECRSTLMIHRRLHPLMIMMLLVGCAVGPDYQQPAPPATTHWNDKGDSAVKSQTSSAATNPRWWKTFGSPQLDSLIERAIAGNLTLQQTVLRIAGAREQINQAGGAFFPSVNGNVQATRQQLGLEGELKSHGVYDQLNNVDPELRGALGPLTQPINLYQGSFDAQWEIDLWGKVRRQVEAAEAQQRAAIEQRNDVLVSLEAEVARAWLQLRGAQSIIATLNTQIESAQQTLDLTESRQRGGLSPQMDVENARAQLGNLEAQLPQYQAQERQAMNGLAILLGKPPGALDAELQSVQPMPALPDIVQTGIPSTLARRRPDVREAEANLHAATAQIGVSVAELFPSFTLSGQFGLRNSESNWLTDWSSHFYSFGPQVSIPIFQGGRLVSSVKVARAQQGAAVLDYRQTVLTALGDVENALVSYRTDQQREAGLAKTIDALQNAFDLASDSYRQGIASFIDVLDAQRQLAQAEQQRAQAQVQSALDLVALYKALGGGWEPYQQVRLPDYSVFGDAPRG

SEQ ID NO: 7027 - protein, 241 aa, Enterobacter cloacae
GRTMAAKYITIAREIKKRIISQQYAANEPLPDQFALAAEFSTSRMTIQQAMRQLIVEGLVYTRQGQGTFIRKNFLQLSQWDLSGSDYFGATKTWEHLGTVSSQVVHFELRFPNEKEQASLMINPDTPIYDFIRLRLLNGEPMSLDATVMPLNLVPGLNKTHLESSVFRYVQETLGLKIMGSYRVVRALKPSALDMQHLVCEPTDSVLEVEQVIYLEDGTPLEYAHCHYRYDHGGIVIVNNG

SEQ ID NO: 7028 - protein, 160 aa, Enterobacter cloacae
GSTMNRRAGKPTTKKTTQLVNVEEHVEGFRQVREAHRRELIDDYVELISDLIREVGEARQVDMAARLGVSQPTVAKMLKRLASVGLIEMIPWRGVFLTAEGEKLAQESRERHQIVENFLLVLGVSPEIARRDAEGMEHHVSEETLVKFREFTLKYGPSAE

SEQ ID NO: 7029 - protein, 529 aa, Enterobacter cloacae
TEGHRGMTDHSHDNWKPASNPWAVAIVVTLAVFMEILDTTIVNVALPHVAGSLSASYDESTWVLTSYLVANGIVLPISAFLSRLFGRKQFFLICIVMFTICSFLCGIATELWQIILFRVMQGFFGGGLQPTQQSVLLDYFKPEDRGKAFGLSSIAIIVAPVLGPTLGGWITDNYSWRWVFFINIPVGIVTVLAIYQLLEDPPWEKKSEEKLTVDWTGIGLIALGLGCLQVMLDRGEDDDWFYSNFIRTFAVLTLVGIIGAIYWLMYARKPVVDLHCMKDRNFAISSLLMAGMAMILYGSSVVIPQLAQQDLGYTATWSGLVLSPGAVLIVLTIPLVLKLMPVVQTRWIIAFGFTCLAVSFFWSRTLTPDIDFETLVLFRSAQSIGLGFLFVPLTTIAFISIPRRLNADAAALFTMFRNVAGSIGISLSTAAITERSQAHSAHLAYHASPFNEQFQLAIRESAQAIQNFTTQVGDPTGIATGRMYQTMIEQSRFLAYIDVFTILSAVALLLIPFCLLLSPVKSEGSAGAH

SEQ ID NO: 7030 - protein, 465 aa, Enterobacter cloacae
LVIKGATMNKSLPANFLWGNSVSSMQTEGAWNEGGKGMSVYDIREAGENISDWKVATDSYHRYREDFDLMQDLGMNCYRFQISWSRICPQGDGEFNDEGIAFYDRFIDDLLARGIEPMVCLYHFDMPLALAQEYNGFIDRRVVDAFIRYGKKMIDCFADRVKYWLTFNEQNIFHMPEAFRISGYMKGEQTLRELYELQHHAMVAHMTLTEYLHQTKPGKLMGGMLAHQLIYPATCKPRDIFCAQQYDEFLNQNLLRVFAGQGYSPAVMAVVEQEGFGDIYRADDLALFARTKNDFMAFSYYASKTLDSDAIPEGTPVNYYLLHGEKNNPYLKATEWNWQIDPLGFRTIITRYANDWRMPVFPIENGIGVIESWDGVNPVEDTYRIDYHRAHIEAMKAAIFEDGAEVMGYLGWGLIDILSSQGDMRKRYGVVYVNRENHDLKDLKRVPKKSYAWLKQVIHTNGREM

SEQ ID NO: 7031 - protein, 445 aa, Enterobacter cloacae
WEHSAMSETKITPHMQSFVDKFVEFSARLANQVHLRSLRDAFATVMPIFILAGLAVLVNNVVFPWIFAGDTLTHFKVWGEAIINGTLNIAALLLAPMIAWSLARNKDFDNPVSAVVIAVSSFIIMMPMRLQITPVGSEATVNATQVLTFANIGSTGIFAGVLIGLLSTEVFIAISRLKALHISLGENVPPAVSKSFTALIPTILTLSLFAVLAAILANVLHTDLIHLITTFIQQPLRLINTSLPGTIFIYSFGNFLFTLGIHQSVVNSVVLEPFLLINTNENMLAFANGQPIPHIINNIFVPTFGMVGGTGSTISLLIAIFIFSRQKSAKQVARLSLAPGLFNINEPVIFGLPIVFNLPLMIPFVLLPAIGIYFAWLCTTLGFMSRCVVMIPWTTPPILSAWLATAGDWRAVVVQLAIIVFGVFFYLPFLKVAERVALKNSGTEH

SEQ ID NO: 7032 - protein, 365 aa, Enterobacter cloacae
TMAEDQNPPADEQDQNNNERKRPGKKPLIILGIVVIVMVIVALVWWFLTRNEETTDDAFTDGDVVTIAPKTAGYVTELRVRDNQRVKKGDVLVVIDPRDTTAQRDQAQAQLGLALAQLHQAQAQLALSKVQYPAQRDEAKAQVLKAQADMANAQAEYRRQRGVDPRATTQQSIDAANAQLRSAQAGLASAQAQLEVAEQVQLQIRQQETNVEARERQVDQARAQLETANLNLSYTEVRAPFDGFVTKRNVQPGTLVQAGTALFSLVSPNVWVVANFKESQLERMKPGDKVTVSVDAWPDMELEGHIDSIQQGSGSRFSAFPSENATGNFVKIVQRVPVKIVIDKGLDPNKPLPLGLSVEPKVTVE

SEQ ID NO: 7033 - protein, 353 aa, Enterobacter cloacae
GVSCADASTSKNQNFATFIERLFRDNTMTKYRLSNETRLWRWQDGSTPCTTPLRQIIAVKDFNDVTSGTKGGWVEDEHALAQDGDCWVYDENSVVFAGARISGNARLTQPCIVSHRAHVGGNGWLDAAEVSHGAVISDNVTIQHSTVRGECRIAGDARVLHNSLVIAAKGLTPDREQILQIYDRATVSQSRIVHQAQIYGDAMVTWAFVEHRAEVFDRAILEGNALNNVWVCDCAKVYGNARLLAGLEDDAIPTVRYSSQVAENALVEGNCVIKHHVLIGGEAWLRGGPILIDDKVVIQGRARISGDVLIEHQVEITDDAVIEALEGESIHVRGAKVINGDTRITRTPLLGAL

SEQ ID NO: 7034 - protein, 417 aa, Enterobacter cloacae
KINTEGNTMGSELSRQLTQRFFRYLAITSQSDPKVKTLPSTPGQHDMARELAKELKTLGLDDIVIDEFATVTAVKKGNVPGAPRIGFITHIDTVDVGLSPDIHPQILTFTGDDLCLNKEKDIWLRVKEHPEILAYPDEEIIFSDGTSVLGADNKAAVTVVMTVLENLTAEHNHGDIVVAFVPDEEIGLCGAKALDLKRFDVDFAWTIDCCELGEIVYENFNAAAAEIRFTGVTAHPMSAKGVLVNPLLMATDFISHFDRQQTPECTEGREGYIWFNGIQAGQNEAILKANIRDFDKDGFAARKQHIADVAAQIAAQHPTANVEYRIEDTYSNISNAIGEDRRAIDLMFEAMESLGITPKPIPMRGGTDGAALSAKGLLTPNFFTGAHNFHSKFEFLPLSSFEASCRTALQLCLLAAR

SEQ ID NO: 7035 - protein, 281 aa, Enterobacter cloacae
DMSRRSFPLNAVETFIVTARHLNLTHAAKELCLTQGAVSRKIASLESWFGFPLFERHARGLRLSSQGSALLPELQSAFEHLLNVAEQARTHQTVIRLKAPTCAMRWLVPRLLQVEREQPELQIALTTTTDHNVNFKTESCDAAIVFGTHMSAGDLLFEEALTPVMSPLRAGSALEALTFLHPTRDKTDWTLWLAKQPGPPPAMLKNQHFETMDLAITAAIQGLGIAIADETLVEEDVRAGRLMRPFDTSIKTGASYRLVLRDAPGPENGLDAFRACLLSRG

SEQ ID NO: 7036 - protein, 507 aa, Enterobacter cloacae
WKKKVGMENPSAPVVETRQGALIGFTEGDTHVWCGIPYAAPPVGPWRWRSPRPPARWDGVRPATAFSASSWQSSESCQELGGGDPGQFSEDCLYLNVWSPVARAAPLPVMVWLHGGGFTLGAGGLPPYNGRALAKRGTVVVTINYRLGHLGFFAHPALEGEEERVVHNFALLDQIQALEWVRDNIAAFGGDPENITVFGESAGARSVLSLMASPLAGGLFHKAIVQSGYTLPDTPREQAMHKGEAIAAHFGLHNATAEQLRAIPPEAFWPLTSPLNIAPAPIVGDCVLPEAMLDVFFAARQHPVPVMIGSNSDEASVMSVFGVDLAGQIQKLRRERRFGLGLIKLLYPGVKGDEELGRQVCRDMAFTTMGYVVMQAQQRAGGLCWRYWFDYVAEAEHATYINGAWHGNEVPYVFDTLGQVEPSRQYVNERDLAFAAQVADYWVSFARDAGARDSLAGPTRWPACRKGRDVLLRIGVNKHAGFRLENRFMRARMSLFKRVMKHHVSLD

SEQ ID NO: 7037 - protein, 399 aa, Enterobacter cloacae
LCIHHEKGQRMTLKTPVQTRSKLPDVGTTIFTVIGQLSARHNAINLSQGAPNFSCDPKLISGVTRAMEAGYNQYASMTGLQPLRERIADKIATLYGTHYDPASEVLVTASASEGLYSAISGLVHPGDEVIYFEPSFDSYAPIVRLQGATPIAIKLTVPDFAVNWDEVRAAITPRTRMIIVNTPHNPSGQVFSAADLHQLAALTRHTDIIILSDEVYEHVVFDGEPHHGMATHPQLAERSVIISSFGKTYHVTGWRVGYCVAPAELMDEICKVHQFLMFSADTPMQYAFAEHMTDPQTWLSLAAFYQRKRDLLQSLLADSPFRLLPSAGSFFLLADYSGFSDERDSEMVKRLIVEYGVATIPLSAFYADGTDNKLIRLSFAKDEATLRAGAQALCRVTPR

SEQ ID NO: 7038 - protein, 581 aa, Enterobacter cloacae
PFLFRLCVLSCRHFAARETHSHDHKDVFSGMNRRRFLKGSLAMAALSGTSGLASLFSQAAYAADSDIADGQSRRFDFSVLQSMAHDLAKTAWGGAPRPLPETLATMTPQAYNAIRYDEKQSLWNNIEGRQLDAQFFHMGMGFRRRVRMFSLDQTTSQAREIHFRPELFSYGDTGVDTKQLEGQSDLGFAGFRVFKAPELARRDIVSFLGASYFRAVDDTYQYGLSARGLAVDTFTDTPEEFPDFTSFWFETVKPGDTTFTVYALLDSPSITGAYKFVIHCEKSQVIMDVENHLYARKDIKQLGIAPMTSMFSCGNNERRMCDTIHPQIHDSDRLAMWRGNGEWICRPLNNPQKLQFNAYLDKNPKGFGLLQLDRDFSHYQDVMGWYNKRPSLWVEPRNNWGKGSIALMEIPTTGETLDNVVCFWQPEKPVQAGDELDFKYRLYWSAQPPVRSPLANVYATRTGMGGFPEGWAPGENYPKVWARRFAIDFVGGDLKAAAPKGIEPVITLSSGEAKQVEILYVEPFDGYRILFDWYPTSDSTEPVDMRLFLRCQGDAISETWLYQYFPPAPDKRNYVDDRIMR

SEQ ID NO: 7039 - protein, 214 aa, Enterobacter cloacae
SLWVCAGWRLRLTRPALDAFVGRVSVSATRQLRGTMSSEIIPVNQEIELRAVEERYTTDLHNLVIKNKTWLQTAFDWAQHVGSEEDTRRNVQSNQMLHQRGYAKMFLIFMKDELVGVLSFNAIEPANKTGYIGYWLDEAHQGQGILSQALQAFMRYYVERGEIRRFVIKCRVDNQSSNRVAQRNGFTLEGCLRKAEMLNGRYDDVNLYARIFPL

SEQ ID NO: 7040 - protein, 200 aa, Enterobacter cloacae
GKIMTVDENYFTEKYGLTRTHSEVLLSADIVKPGKTLDLGCGNGRNSLYLAANGHDVTAWDKNPMSIDNIERIKAAEGIANLQTAIKDLNNLTFDGEYDFILSTVVLMFLEANTIPGLIANMQRCTKPGGYNLIVAAMDTEDYPCTVGFPFAFKPGELSNYYEGWELIKYNEEVGELHRTDANGNRIKLRFATMLARKPA

SEQ ID NO: 7041 - protein, 286 aa, Enterobacter cloacae
SVSLLRKMRRRYGQVPRPFVGLHHVKEFEMKLRALVVGMGLLCSFSSFAATELRYGLEAEYPPFESRNASGELEGFDVELGNAICKAAALKCSWVETSFDALIPGLVAKKFDAINSAMNITEQRRKSIDFTQPIYRIPSQLVGKAGSAVEATPEGLKGKTIGVLQGSIQETYAKEHWEKHGVTVVSYKDQNMAWGDLLNGRIDASLVMSAAGQAGFLSKPQGKGFGFIGKPVSDDTILGSGIGFGLRKGDEATKKQLDAAIDKVRADGTIAKLADKYFPGIDVSVK

SEQ ID NO: 7042 - protein, 335 aa, Enterobacter cloacae
PLKKMHNLNQRVLNLPAGYFGMVLGTIGMGFAWRYASTIWPVTRWPGEILVALAVAIWFLLSVAFLTRAVRFPHSVLAEMRHPVMSSFVSLFPATTLLVAIGFVPWYRPVALGLFSVGVVIQLAYAAWQSAGLWRGKHPEEATTPGLYLPTVANNFISAMACGALGFHDAGLVFLGAGVFSWLSLEPVILQRLRSAGELPAALRTSLGIQLAPALVACSAWFSVNGGEADTFAKMLFGYGLLQLLFMLRLMPWYLSQPFNASFWSFSFGVSALATTGLHLGQSSPSGFFHALAVPLFIFTNVIIAMLLVRTFILLMQGKLLVRADKALLMQSEEK

SEQ ID NO: 7043 - protein, 532 aa, Enterobacter cloacae
MMKSTFTMITLALAALTVSSTVAAKTLVYCSEGSPENFNPQLYTSGTSVDASAVPVYNRLVDFKPGTTELVPSLAESWEVSEDGKVYTFHLRKGVKFHSNKLFTPTRDFNADDVIFSFMRQKDVNHPYHNVSNGSYSNFESLEFGSLITAIDKVDDRTVRFTLAHPEAPFVADLAWYFASILSAEYADAMLKAGTPEKVDMQPIGTGPFKLSQYQKDSRILFTAFPDYWQGKSKLDRLVFTITPDASVRFAKVEKNECQVMPFPNPADLPRMKANKDINLMSKAGLNTGFLAFNTQKPPLNNVKVRQALAMAINKPAIIEAVFHGTGTAAKNLLPPGVWSADSELKDYDYDPEKAKALLKEAGFANGVSIDLWAMPVQRPYNPNAKRMAEMIQADWAKVGVQTKIVTYEWGEYLKRVKGGEHQAALMGWTTATGDPDNFFGPLFTCTSANGGSNSAKWCYKPFDNLIAEAKSITDREKRVALYKQAQQMMHDQMPAVMIAHSTIFEPVRKEVTGYEIDPFGKHLFWQVDLKE

SEQ ID NO: 7044 - protein, 275 aa, Enterobacter cloacae
LKKLKINYLLIGIVTLLLAVALWPSIPWFGKAENRIAAIQERGELRVSTLSSPLIYDDINGKTIGLDYELAQLFADYLGVKLKVTVRQNINQLFDDLDHDRADILAAGLVYNSERSKNYQPGPTYYSVSQQVVYRVGSLRPRSLADITDQQLTIAPGHVVIDDLRALKEKKYPNLSWTVDPKLGTTELLEQVKDKKLAYTIADSVAISLFQRVHPEIAVALDVTDEQPVTWFTQLDDDQTVSAAMLDFFNSINEDGTLASSTTGVEGAAHSVRWQ

SEQ ID NO: 7045 - protein, 258 aa, Enterobacter cloacae
PKRGSCQPSWVKTTRAFRIVEKTPRSALITSFEFEPVDGQPVADYQPGQYLGVWLKPEGFPHQEIRQYSLTRKPDGKGYRIAVKREEGGQVSNWLHNEASVGDVVHLAAPAGDFFMAVETNTPVTLISAGVGQTPMLAMLDTLAKANHSAQVNWFHAAENGDVHAFADEVKALGAGLPHFTAHTWYRSPTEADRAAARFDSEGLMNLGQHEGAFSAPGMQFYVCGPVAFMQYAAKQLVDLGVNKDNIHYECFGPHKVL

SEQ ID NO: 7046 - protein, 261 aa, Enterobacter cloacae
IAMGSGNNAHVDIDIAVAAKRTHFPLLQHAQQFDLQRRGHIANFIKEQRAPLCRLEQPFTAAHRAGKGAAGMAEELRLKQLFRQRATVDGNKGIFTAWAGVVDRLGQDLFPGPALAVDQHANVGLRHHPRLFQQAQHHRATRHDGFTPAVVAGWRRVLKSAVDRFIEGVFIHRFGEEAEYPLLRRGHRIRNRSVSGEDNHRHPGLLLLDLREQLQAIHFIHAQIADHQIDFLAAEHFQPLLPAFSGDHAVAFADQTHPQQL

SEQ ID NO: 7047 - protein, 494 aa, Enterobacter cloacae
RADSVTLSSNPDDESNVLKRWPAFPRSLRQLVMMAFLLILLPLLVLAWQAWQSLNALSAQAALTNRTTLIDARRSEAMTNAALEMERSYRQYCVLDDRTLERVYQNQRKRYSEMLDAHAGVLPDDKLYQALRQDLNDLARLQCKNSGPDAAAAARLEAFANANTEMVQSTRTVIFSRGQQLQQEIAERGQFFGWQALVLFLVSLGLVLLFTRMIIGPVKGIQRMINRLGEGKSLGDTVVFKGPRELRSVGQRIIWLSERLAWLESQRHQFLRHISHELKTPLASMREGTELLADEVAGPLSPEQKEIVAILDASSRNLQKLIEQLLDYNRKLADGAVVLESVEIEPLVDMVISAHSLPARAKMMHTQVDLNAPSCLAEPMLLMSVLDNLYSNAVHYGTESGTIYIRSNNNGSRVFIDVANTGSPIPDDEKTMIFEPFFQGSHQRKGAVKGSGLGLSIARDCIRRMQGELNIVSDERADVCFRIELPLEPEKSMK

SEQ ID NO: 7048 - protein, 115 aa, Enterobacter cloacae
GPTMKKIDAIIKPFKLDDVREALAEVGITGMTVTEVKGFGRQKGHTELYRGAEYMVDFLPKVKIEIVVSDEIVDTCVDTIIRTAQTGKIGDGKIFVFDVARVIRIRTGEEDDAAI

SEQ ID NO: 7049 - protein, 454 aa, Enterobacter cloacae
DAETRGCEAMTSRKPAHLLLVDDDPGLLKLLGMRLVSEGYSVVTAESGQEGLKVLSREKIDLVISDLRMDEMDGLQLFTEIQKQQPGMPVIILTAHGSIPDAVAATQQGVFSFLTKPVDKDALYKAIDSALEHAAPSGDDGWRESIVTRSPVMLRLLEQARMVAQSDVSVLINGQSGTGKEILAQAIHNASPRSKNAFIAINCGALPEQLLESELFGHARGAFTGAVSSREGLFQAAEGGTLFLDEIGDMPAPLQVKLLRVLQERKVRPLGSNRDIDINVRIISATHRDLPKVMARNEFREDLYYRLNVVNLKIPALAERAEDIPLLANHLLRQAADRHKPFVRAFSTDAMKRLMTASWPGNVRQLVNVIEQCVALTSSPVISDALVEQALEGENTALPTFAEARNQFELNYLRKLLQITKGNVTHAARMAGRNRTEFYKLLSRHELEANDFKE

SEQ ID NO: 7050 - protein, 1305 aa, Enterobacter cloacae
APRRFEDERLMMEILRGSPALSAFRITKLLARFQAADLPVSNIYAEYVHFADLNAPLNAEERVQLERLLKYGPSLSSHTPTGKLILATPRPGTISPWSSKATDIAHNCGLNQINRLERGVAYYVEASTLSDAQWQAVAAELHDRMMESVFDSLDDAQKLFSHHQPAPVQSVDLLGQGRQALIDANLRLGLALAEDEIDYLQDAFVKLNRNPNDIELYMFAQANSEHCRHKIFNADWIIDGEQQPKSLFKMIKNTMEQTPDHVLSAYKDNAAVMEGSEVGRFFADREAGRYDFHQEPAHILMKVETHNHPTAISPWPGAATGSGGEIRDEGATGRGAKPKAGLVGFSVSNLRIPGFEQPWEEDFGKPERIVTALDIMTEGPLGGAAFNNEFGRPALNGYFRTYEEKVDSHNGEELRGYHKPIMLAGGIGNIRADHVQKGEIVVGAKLIVLGGPAMNIGLGGGAASSMASGQSDADLDFASVQRDNPEMERRCQEVIDRCWQLGDANPILFIHDVGAGGLSNAMPELVSDGGRGGRFNLRDILSDEPGMSPLEIWCNESQERYVLAVAADQLPLFDELCRRERAPYAVIGEATEEQHLSLSDTHFDNQPIDLPLDVLLGKTPKMTRDVQTRKAAGKALDRQGITVAEAVNRVLHLPAVAEKTFLVTIGDRTVTGMVSRDQMVGPWQIPVANCAVTTASLDSYYGEAMALGERTPVALLDFAASARLAVGEALTNIAATQIGDIKRIKLSANWMAAAGHPGEDAGLYEAVKAVGEELCPALGLTIPVGKDSMSMKTRWQEGNEQREMTSPLSLVITAFARVEDVRHTVTPQLSTEDNALLLIDLGKGHNALGATALAQVYRQLGDKPADVRDVAQLKGFYDAIQALVAQRKLLAYHDRSDGGLLVTLAEMAFTGHCGVEANIATLGEDRLAALFNEELGAVIQVRAADRDAVEAILAQHGLADCVHYLGKAVQGDRFVIEADGHAVFSESRTTLRMWWAETTWQMQRLRDNPECADQEHNAKANDNDPGLNVKLSFDINEDIAAPYIATGARPKVAVLREQGVNSHVEMAAAFHRAGFDAIDVHMSDLLAGRTGLDDFQALVACGGFSYGDVLGAGEGWAKSILFNSRVRDEFETFFHRPQTLALGVCNGCQMMSNLRELIPGSEAWPRFVRNQSDRFEARFSLVEVTQSPSLLLQGMVGSQMPIAVSHGEGQVEMRDAAHLAQLESKGLVALRFVDNFGKVTETYPANPNGSANGITAVTSESGRVTIMMPHPERVFRTVSNSWHPENWGEDSPWMRIFRNARKQLG

SEQ ID NO: 7051 - protein, 256 aa, Enterobacter cloacae
AGKINEMNNNLVSMSHVFYRALRAVFSSKNVRLSLPCLLLAGCVTHAPKSAISHKQEDKWPQKQLADFLSTRCDDIWSLSGRDVESNPLFWLRGIDCAQRLAPAEARAQAAMLMDDTWQDAFKRGIVMADARITPVERRANVTRLDTYVINIPPQVRPVYQLWRDGQTLQLQLSEERFRYSKLQQSSDSELDALRQQQESLREQLETTTRKLENLTDIERQLSTRKPAGSYLPDGSKGNSATTPDSETPKQEDVKP

SEQ ID NO: 7052 - protein, 430 aa, Enterobacter cloacae
HKISNNQKRSKERLMESKVVVPAEGKKITLQNGKINVPHNPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLATEEFGGELIDGGPWQKIKNPNTGKEIIIKDVIADAFLQQILLRPAEYDVIACMNLNGDYISDALAAQVGGIGIAPGANIGDECALFEATHGTAPKYAGQDKVNPGSIILSAEMMLRHMEWFEAADLIVKGMEGAINAKTVTYDFERLMEGAKLLKCSEFGDAIIANM

SEQ ID NO: 7053 - protein, 99 aa, Enterobacter cloacae
QREPEGSRFLCTQDGNNAMTHDIPLKYYDIVDEYATETAKPVEEAERTPLAHYFQLLLTRLYNNEEISEEAQREMAVQAEIDEARIDDIANFLNQWGNE

SEQ ID NO: 7054 - protein, 344 aa, Enterobacter cloacae
RHIDGNIPAIGFISHVDTSPDFSGKHVNPQIVENYRGGDIALGIGDEVLSPVMFPVLHQLLGQTLITTDGKTLLGADDKAGIAEIMTALAVLKGKNIPHGDIRVAFTPDEEVGKGAKHFDVEAFNAQWAYTVDGGGVGELEYENFNAASVTIKIVGNNVHPGSAKGVMVNALSLAARIHAEVPAEESPEMTEGYEGFYHLTSIKGTVDSAQMHYIVRDFDRKAFEARKRKMMEIAKKVGKGLHPDCYIELIIEDSYYNMREKVMEHPHILDIAQQAMRDCDIEPVMKPIRGGTDGSQLSFMGLPCPNLFTGGYNYHGKHEFVTLEGMEKAVQVIVRIAELTAKR

SEQ ID NO: 7055 - protein, 93 aa, Enterobacter cloacae
FNDKNHTERKAMGILSWIIFGLIAGILAKWIMPGKDGGGFIVTIILGIVGAVVGGWISTLFGFGRVDGFNFGSFVVAVIGALVVLFIYRKIKS

SEQ ID NO: 7056 - protein, 222 aa, Enterobacter cloacae
AIMRQLITPENTMTKTSFRKHRVERFSSRQATRRTPEPQPTRVILFNKPYDVLPQFTDEAGRSTLKDFIPVQGVYAAGRLDRDSEGLLVLTNDGVLQARLTQPGKRTGKIYYVQVEGEPDDASLAKLRNGVTLNDGPTLPAGIERVNEPEWLWPRNPPIRERKSIPTSWLKITLYEGRNRQVRRMTAHVGFPTLRLIRYAMGSYTLDSLANGEWRDVTPKEN

SEQ ID NO: 7057 - protein, 428 aa, Enterobacter cloacae
TRQTCARHWLRKASAAGSLRRACRWMSLQNLTGRLQRVSMVGGRDRIRRLEVQCREYSMSDNSQKKVIVGMSGGVDSSVSAYLLQQQGYKVEGLFMKNWEEDDGEEYCTAAADLADAQAVCDKLGIELHTVNFAAEYWDNVFELFLEEYKAGRTPNPDILCNKEIKFKAFLEFAAEDLGADYIATGHYVRRADVNGKSQLLRGLDGNKDQSYFLYTLSHEQIAQSLFPVGELEKPEVRKIAEDLDLITAKKKDSTGICFIGERKFREFLGRYLPAQPGKIVTVDGDEIGQHQGLMYHTLGQRKGLGIGGTKEGSEDPWYVVDKDVENNILVVAQGHDHPRLMSVGLIAQQLHWVDREPLEGTLRCTVKTRYRQTDIPCTVTALDDDRIDVRFDEPVSAVTPGQSAVFYSGEICLGGGIIEQRLPLPAV

SEQ ID NO: 7058 - protein, 218 aa, Enterobacter cloacae
TVCTHKGDRVAKNYYDITLALAGICQSARLVQQLAHQGHCDADALHVSLNSVIDLNPGSTLGVFGGSETNLRLGLETLLGVLNASNRQGLNAELTRYTLSLMVLERKLNAAKGAMNTLGDRIAGLQRQLDHFDLQSETLLSAMAGIYVDVISPLGPRIQVTGSPAVLQSPQVQAKVRASLLAGIRAAVLWQQVGGGRLQLMFSRHRLTTQAKQILAHC

SEQ ID NO: 7059 - protein, 380 aa, Enterobacter cloacae
EPAEYINMDYQLTLNWPDFIERYWQKRPVVLKRGISNFIDPISPDELAGLAMENEVDSRLVSHQDGKWQVSHGPFESYDHLGENNWSLLVQAVNNWHEPTAALMRPFRALPDWRMDDLMISFSVPGGGVGPHLDQYDVFIIQGTGRRRWRVGEKVPMKQHCPHPDLLQVDPFEGIIDEELEPGDILYIPPGFPHEGYSLENSLNYSVGFRAPSGREMISGFADYVLQRELGSYRYSDPDVPAREHPADILPEELDKLRGMMLDLINEPEHFRQWFGEFISQSRHELDVAPPEPPYQADEIYDALQQGDKLVRLGGLRVLRIGEEVFVNGERLDSPHRPALESIASQMVLTADTFGDALDDPSFLAMLAALVNSGYWFFED

SEQ ID NO: 7060 - protein, 474 aa, Enterobacter cloacae
RLRQNKFLLIVNLPELRIMELSSLTAVSPVDGRYGDKVSALRGIFSEYGLLKFRVQVEVRWLQKLAAQTAIKEVPAFDAKANDYLDKIVAEFSEEDAARIKTIERTTNHDVKAVEYFLKEKVACVPALHAVSEFIHFACTSEDINNLSHALMLFTARKEVVLPYWRKIIDAVKALSVEYRDIPLLSRTHGQPATPSTMGKEMANVAYRMERQYRQLEQVEILGKINGAVGNYNAHIAAYPEVDWHQFSEEFVTSLGIQWNPYTTQIEPHDYIAELFDCIARFNTILIDFDRDVWGYIALNHFKQKTIAGEIGSSTMPHKVNPIDFENSEGNLGLANAVLQHMASKLPVSRWQRDLTDSTVLRNLGVGIGYALIAYQSTLKGVSKLEVNRDRLLDELDHNWEVLAEPIQTVMRRYGIEKPYEKLKELTRGKRVDAEGMKQFIDGLALPEEEKARLKEMTPANYIGRAITMVDELK

SEQ ID NO: 7061 - protein, 98 aa, Enterobacter cloacae
RRRLLAGLGGDEILVARLSHSDDDDTRTEINAIKTRLNGLIAGEYGLGNATILYPGASLGVVIVDPHSTDEDSALRTADLAMYQDKKGKSKTGFVALD

SEQ ID NO: 7062 - protein, 515 aa, Enterobacter cloacae
PVIRSLHLRTWRDSRKMKKAIAVAIISTLMVVLSLYAVNAIIAEQQKNRQREISHTLLSYSEELTQNIASTLKNTTVQGCDSASLNVYRKLKMRSLYFADVGFIEKGKITCTAFWGKLANPIALPPELHKTHNGFSLAQFSQKDFFIGNATIYNHLIIFTSRSAYDKFAPVTANYSLRSSTKDFGRTFFTVTPPSENFSRLQSLLFTLAVTECSTRWDLCVTVTHHDAGLASLSHVVMVLLCLFLYFIWVSLTLFSLRLYEDRRSLERTLVKAVKANTISVHFQPVIRVADKKIVGVEVLSRWQDNNHKEVSPELFIPLIKKIGLYNVYYQNMIKKSLAEIAALAAEHQLMISLNVGRTEIEDGKFLSVLRHACSENAIPLSLIKVELSENGVSTSAILEEFCEELKSAGVKISIDDFGVQNSNLARLTNLKYDEIKVDKSLVDGISEHYKQDILVIFSDALAKLNKTLVFEGVESETQFQFIAQRYPDALVQGWYFSKSLTRHDLARLLADSAR

SEQ ID NO: 7063 - protein, 160 aa, Enterobacter cloacae
GELMFKPHVTVACVVHAQGKFLVVEETINGKALWNQPAGHLEANETLLQAAKRELWEETGIRAEPQHFIRMHQWIAPDQTPFLRFLFAVELNETCATEPHDDDIDRCLWVTAEEILNAPNLRSPLVAESIRCWQSTARLPLDVIAEFNWPFTEGVNGGGA

SEQ ID NO: 7064 - protein, 239 aa, Enterobacter cloacae
IISVKLFIPFIKGEMMMRVLVVEDNALLRHHLKVQLQEMVHQVDDAEDAKEADYYLNEHLPDIAIVDLGLPDEDGLSLIRRWRSHDVSLPVLVLTAREGWQDKVEVLSAGADDYVTKPFHIEEVAARMQALLRRNSGLASQVISLPPFQVDLSRREFSINDEVIKLTAFEYTIMETLIRNNGKVVSKDSLMLQLYPDAELRESHTIDVLMGRLRKKIQAQYPHDVITTVRGQGYLFELR

SEQ ID NO: 7065 - protein, 487 aa, Enterobacter cloacae
MKGILRHILPLSLRVRFLLATAAVVLVLSLSYGMVALVGYSVSFDKTTFRLLRGESNLFYTLAKWENNRITVEMPENLNQQSPTLALIYDEKGKLLWAQRDVPWLKKRIRPEWLKTNGFHEIEADLNSTSSLLRDDRALQIKLNEIRAEDDDTEMTHSVAINLYPATLNMPQLTIVVIDTIPVELKRSYMVWNWFVYVLAANLLLVIPLLWVAAWWSLRPIESLAKEVRELEEHHREKLNPETTRELTSLVRNLNRLLKSERERYDKYRTTLTDLTHSLKTPLAVMQSTLRSMRSSKMSVDDAEPVILEQISRISQQIGYYLHRASMRSGSALLSRELHPVAPLLDNLTSALNKVYQRKGVNISLDISPEISFVGEKNDFMEVMGNLLDNACKYCLEFVEVSARVTDNELHIIVEDDGPGIPRNKREVVFDRGQRADTLRPGQGVGLSVAREIVDQYEGKIETGESLLGGARMEVIFGRQHPVSNDS

SEQ ID NO: 7066 - protein, 476 aa, Enterobacter cloacae
PRCQISQLLTFSSWLTLFTEHLKNKPYTGKVNTMTEIITRKEKISYGLGDMASHIGLDNVIIFLTFYYTDVVGLPAAFVGTMFLLARTADAIIDPAMGYIADRTRTRWGKFRPWMLWLALPFGASCLLTYAVPASLDLHGKMIFATVSYTLMMLMYTAINIPYCSMGAVITPDNDARISLQSYRFFLATLGGALSTFFMMPLAEFLGGDDKLLGYRWAMAIMATVAVVMFWICFANTRERIKAPATHNNYLAELRDLLRNDQWRIVAVLVLTNIGFGVIRLGAMMYFVTYYLGSASYFMWMLGAHILGKAAGSALAKRLTQNVSKVQMFGYCSVLAGVLSIALFFAPKSVLILVPMTFIVSTLYQATTTLMWVMMADVADYGEWKQGKRMDGVIFSTFLAVLKLGMAISGAIVGWTLGLSGYVANAPEQTNTAMYCIIALFTVVPGVLSLCAFATLRWYKLDDSTMQSIHLAKHPV

SEQ ID NO: 7067 - protein, 683 aa, Enterobacter cloacae
KDALSMSELIQHSNSIEWRFERQILRIEPWGENSLRVRATCSPAFEDALQALLPAAPCQAEIIAEAESLTLRNGNITATLNLKGQLAFYNQRGELLLEEMWRQRSTVGIGASEKSQDKYVSALKLDGREFKPLMGGKYQLTVRFESRPDERIYGMGQYQQPWLDLKGCTLELAQRNSQASVPFMQSSLGYGLLWNNPAIGEASFAKNQTEWRARVTGEMDYWITAADTVADITRQYVKATGTPPAAPAFISGLWQCKLRYRTQQEVLEVAREYRRRNLPLSVMVIDFFHWPNQGTWCFDPVDWPDPEGMVDELREMGIALMVSVWPTVEARSPLYPLMKAKGWLVSSERGVQVNLDFMGNTTFFDATHPEARKFVWDTVKKNYYDMGIKLFWLDEAEPEYRAYDFDNYRYHAGPVLEVGNRYPRDFAQGFYDGLQANGETDIVNLVRCAWAGSQRFGVLAWSGDVHSSFHAFRNQLAAGLNMGLAGIPWWTTDIGGFQGGNVNDPAFHELLIRWFQWAVFTPVLRMHGYREPQIQPPERYRDGIPQCNSGSPNELWSYGEENYAIMQRWLTVRETLRPYIDALYQQAHLHGDPLMRPLFWHYPQDKQSWACEDQYLFGEDLLVAPVMQAGQRERDVWLPTGNSWVALNGERYAGGEHIRVPAALETIPVFIREGSPLIQQLVD

SEQ ID NO: 7068 - protein, 136 aa, Enterobacter cloacae
IGWIKAGCYSVLAERRTAGGKRMIQCKRVYEQATSDDGYRVLVDRLWPRGIKKTDLACDEWCKSLTPSSELRKAFHSETIDFTAFSEAYRKELAQHQDEGKRLAALARQQTVTLLYGAKNREQNHARVLADWLRKL

SEQ ID NO: 7069 - protein, 92 aa, Enterobacter cloacae
SGEKRMGQLVTLHEWASGPNGFKYPLSNSALNKIAKTKQTYPPALKQGRRWVIDEDARFVGMVGSVDISSSLSDKARQLVEKAINGSSPQKT

SEQ ID NO: 7070 - protein, 170 aa, Enterobacter cloacae
SLPADAFARKVSRLTIFGKDPVMFDPTLLILLALAALGFVSHNTTVAISILVLIIVRVTPLNTFFPWIEKQGLTIGIIILTIGVMAPIASGTLPASTLLHSFVNWKSLVAIAVGVFVSWLGGRGVTLMSSQPSLVAGLLVGTVLGVALFRGVPVGPLIAAGLVSLFIGKS

SEQ ID NO: 7071 - protein, 237 aa, Enterobacter cloacae
PLPHPLSEESIKLILFMFYYDRSLNFQHNMQIQRSSAWESTCLMSDIILARVSETLSTEQSLDSLVRQLLEMLEIVTDMESTYLTKIDINARLQHILYARNSKQMQIPEGFSVPWDETLCKRAMDSDTLFSNEVPDRWPECEAAKALGITTYMSVPVHLADGSLYGTLCAASTAQKQFSERGEQVIRLFAGLIGQYIQKESLVLQLREANAALITHSYTDALTGLPNRRAIFENLTT

SEQ ID NO: 7072 - protein, 380 aa, Enterobacter cloacae
MAARPRKHNVKIPNLYCKLDKRTSKIYWQYRHPVTGSFIGFGTDDEAAKAAAIEMNRITAEQETQQSYALIDMAMKSSGKKDQDIRVSEWIKKYIEIQMERLRDGEIKNPTVKSRRLCSQILADRVPNLRLKDVDTRLIAKIIDEYKAEGKHRMGQLIRSVLNDVFKEAQHAGEVDPGYNPALAVKNPIAKVKRSRLSIEQWKLIFESAGSLPPCAQNSMLLALVTGQRIGDIVEMKFSDIWDNHLHVTQNKTGMKLAIPLNLRCDAIGLTLADVISKCRDRVVSPYLIHHVKHHAYGKAGSHVPEKTISRYFKEARDKANITWPKDCTALPPFHEQRSLSSRTYKAQGIDVKTLLGHKTEAMSVMYGDDRGLEWKKVVI

SEQ ID NO: 7073 - protein, 178 aa, Enterobacter cloacae
QATYWQITGEIVMSDDVTGTTTHQRLISLLTEQEARFRVVAHEAVGKCEAVSEIRGTDLRQGAKALVCKVKGNGVKKHILAILAADRQADLSLLASHFGGLKASLASPAEVDALTGCVFGAIPPFSFHPDLTLVADPLLFERFDEIAFNAGLLEKSVIMDTQDYLRIARPELVTFRKQ

SEQ ID NO: 7074 - protein, 398 aa, Enterobacter cloacae
ETIMTTAIQPSGKQGALLVAGILMIATTLRVTFTGVAPLLDTIRQDYGLSTAQTGLLTTLPLLAFAFISPLAAGVARRLGMERSLFIALLLICIGIGVRSLPSAALLFIGTAIVGCGIALGNVLLPGLIKRDFPGQVAKLTGAYSLTMGAAAAAGSALIVPLSLGSGGWHGALLMLMFFPLVALLLWLPQWRQRPAATLTGAGALHNRAIWRSALAWQVTLFMGINSLIYYVIIGWLPAILLSHGYSETQAGSMHGLLQLATAVPGLAIPLILHRLNDQRGIAGLVALMCAVSAAGFWFAPGLAVVWTLVFGFGSGATMILGLTFIGLRASSAHQAAALSGMAQSIGYLLAACGPPLMGKIHDTAGDWRIPLLACALAAVVMALCGMLAGRDREITPR

SEQ ID NO: 7075 - protein, 250 aa, Enterobacter cloacae
GSLCYLKILRHKESLMELSPVKTTLRIALVGDFNPDVIAHQAIPLAIDDAAAVLDLTADYDWLATPELTSPEDLVGYDAIWLVPASPYKNTEAAFIAARYARENSIPFLGTCGGFQHALIEYARNVLGWHDAGHAETDTEGRMVIAPLTCSLVEKTDAIELRNNTLIAKAYGKPEIQEGYHCNYGVSSEFASQLERGDMRVTGWDEQGEIRAAELITHPFFVITLFQHERAALQGRPVVLVQAMLRAAQG

SEQ ID NO: 7076 - protein, 88 aa, Enterobacter cloacae
RIMIMKYLLLALVVPLAACSTKTTPPDAPQPPHAIGMANPASVYCLEKGGEQIPVQSPQGVRTECKLPGGEVIDEWDLYRRDHPQPTR

SEQ ID NO: 7077 - protein, 274 aa, Enterobacter cloacae
NDSLSLISDNFMYGLGLDGYDPDSQHDAAVAFRIRVVAQEQFIPLHQHRKGQLIMALGGAITCEVESAMLMVPPQYAVWIPGQTPHSNKATPGAQLCLLFIEPGALELPTRTCTLKISPLVRELVLALADRSREELPLPATGRLVDVLFDELPLQPQEHLQLPVSPHPKIRLMSETMANEPAAWQTLAQWASHFAMSERNLARLVVKETGLSFRRWRHQLQLIVALQFLIGGKSVQQAAQALGYDSTTAFITMFKKGLGQTPARYIASLTTTSR

SEQ ID NO: 7078 - protein, 188 aa, Enterobacter cloacae
TQRPADCTFTNHAFDSLIPSLKFKKYDAVISGMDITPERSKQVAFTDPYYANSAVVIAKKGAYKSFDELKGKRIGMENGTTHQKYLQDKHPEVKTVAYDSYQNAIIDLKNGRIDGVFGDTAVVNEWLKTNPQLGTATEKVTDPQYFGTGLGIAVRPDNKALLEKLNGALKAIKADGTYQKISEQWFPQ

SEQ ID NO: 7079 - protein, 110 aa, Enterobacter cloacae
RQVIVHYRCYSPSGLFFEEREMFAVIFGRPGCPYCVRAKELAEKLTEERDDFNFRYVDIHAEGITKADLEKTVGKPVETVPQIFLDQKHIGGCTDFEAYAKEHLGLFAAQ

SEQ ID NO: 7080 - protein, 293 aa, Enterobacter cloacae
LRIPVNYIDQFINFVSTLYTPRRACTTLFMICGGVLSLCKILPLLHLWLTTAIKPIAQNYETYILLISLVIGVSLGIVVFSIVDLIVLTIYEHLISKKKKSQSELKAIKEKNIRDEVIFSNFKTAYFHLSIDKINIIRSLITFPSLSFHSEHEDVKFLEKSGWIEALTYISDEEKVYQLNQTIRLYADDRWNEEVNFNTDHFHSFDAETAISIINAMSDVKIKAELDEFNFSFYKSDIEKCFEVSEFTETLYSLRFKERYEKKFSELHLKPFRSERLFSIKVRENIPDLDIPF

SEQ ID NO: 7081 - protein, 600 aa, Enterobacter cloacae
CLGYLSGSREMQSDSLTLKTVAQIVLSFNNLLVNKKLASVNINVADLLNGNYILLLFVVLALGLCLGKLRLGSVQLGNSIGVLVVSLLLGQQHFSINTDALNLGFMLFIFCVGVEAGPNFFSIFFRDGKNYLMLALVMVGSALLIALGLGKLFGWDIGLTAGMLAGSMTSTPVLVGAGDTLRHSGMAGTPLSSALDNLSLGYALTYLIGLVSLIVGARYLPKLQHQDLQTSAQTIARERGLDTDSKRKVYLPVIRAYRVGPELVAWTDGKNLRELGIYRQTGCYIERIRRNGILANPDGDAVLQMGDDIALVGYPDAHARLDPSFRNGKEVFDRDLLDMRIVTEEIVVKNHNAVGRRLAQLKLTDHGCFLNRVIRSQIEMPIDDNVVLNKGDVLQVSGDARRVKTVADRIGFISIHSQVTDLLAFCAFFIVGLMIGMITFQFSNFSFGIGNAAGLLFAGIMLGFLRANHPTFGYIPQGALNMVKEFGLMVFMAGVGLSAGSGIGNGLGAVGWQMLVSGLIVSLVPVVICFLFGAYVLRMNRALLFGAMMGARTCAPAMEIISDTARSNIPALGYAGTYAIANVLLTLAGTLIIIIWPGLG

SEQ ID NO: 7082 - protein, 159 aa, Enterobacter cloacae
PKVGWFARRKPSMIPANSRPAALPMPKLKLLNWKVIIPIIRPTMKKAQKANRSVTWLWIEIKPIRSATVLTRRASPLTCNTSPLLSTTLSSIGISIWLRITRLRKQPWSVSFSCARRRPTALWFFTTISSVTIRMSSRSRSNTSFPLRKLGSRRAWASG

SEQ ID NO: 7083 - protein, 175 aa, Enterobacter cloacae
QSVSLIVIATDSHLLSHDFCACFGKDCRIALSDWASTGRFLYLIEISQEDSLNFKRNWAGVISCFLLFTVVCMSLAFNVKGAFRASGHPELGLLFFILPGVVAGFLSRKGEVVMPLIGAMLAAPLCLLLMRVLFLSSRSVWQEVAWLLSGVFWCALGALCFLFTRSLLQQRKHRK

SEQ ID NO: 7084 - protein, 361 aa, Enterobacter cloacae
RVTATTAATPGATIFVAPLSRRTARSFSTTCTNRAGQRGSPFLLRLVYDRQAFTMSLERCRVKIAILSRDGTLYSCKRLREAAAKRGHQVEILDPMSCYMNIDPAASSIHYKGRKLPHFDAVIPRIGSQITYYGTAALRQFEMLGSYPLNESVAISRARDKLRSLQLLARQGIDLPVTGIAHSPDDTSDLIDMVGGAPLVIKLVEGTQGIGVVLAETRQAAESVIDAFRGLNAHILVQEYIKEAKGCDIRCFVVGNEVVAAIERQAKEGDFRSNLHRGGIARVALISEREREIAVKAAQTLGLDVAGVDLLRADRGPLVMEVNASPGLEGVEKTTGVDIAGKMIAWIECHATPGFCLKTGG

SEQ ID NO: 7085 - protein, 170 aa, Enterobacter cloacae
SGQRFYLRGCTAMDLQVVPTLDTLRQWLDDAGITFFECDSCQALHLPHMQNFDGIFDAKIDLINDVILFSALAEVKPSALLALASDLSAINASSLTVKAFLDIQDDNLPKLVVCQSLFSGAGLSFKQFAWFMRLSEEQISMVMMEANAHHLLYSAEDDAENNDASPNFLH

SEQ ID NO: 7086 - protein, 291 aa, Enterobacter cloacae
TSAETDGRPRMNNLPVVRSPWRIAILIIGFTFLYAPMLMLVIYSFNSSKLVTVWAGWSTRWYSELFHDDAMMSAVGLSLTIAALAATMACVLGTIAALVMVRFGRFRGANGFAFMITAPLVMPDVITGLSLLLLFVALAHAIGWPADRGMLTIWLAHVTFCTAYVAVVISSRLRELDRSIEEAAMDLGATPLKVFFIITLPMIMPAVISGWLLAFTLSLDDLVIASFVSGPGATTLPMLVFSSVRMGVNPEINALASIILGVVGIVGFIAWYLMARAEKQRVRDIQRARRG

SEQ ID NO: 7087 - protein, 172 aa, Enterobacter cloacae
CAAYDAALFFREVKTLGFLQKTRHSHARPNVPALVQVAALAIIMIRCLDVLMIMNTLGPRGMGEFIHRSAQTWNLTLVFLSSLMLVFIEIYCAFSLVKGRNWARWVYLLTQITAAGYLWAASLGYGYPELFSIPGESRREIFHSLVMQKLPDMLVLFLLFAPASSRRFFRLQ

SEQ ID NO: 7088 - protein, 513 aa, Enterobacter cloacae
KKMPPSRRSFAPSGAKATNSRSRIMMRRFSLSQRLTLLFTVLLLLCATVACAVQLYISMQYGNAMVQRLSGGLAQQIVQREAILDSQGRVDRSALKPLFDRLMTFNPSVELYVVSPDGDILADAAPPGHIQRQKIDLAPIQNFLSGTVMPVFGDDPRSQNKKVFSATPLRQDGELKGYLYIILQGEESNALAEMAWHKALWSTALWSMLLVALFGLLAGVLLWYWVTRPVKELTLDVAGLEQDSISAIKQLAAQPLEPAGQDEVAILRNTFIELARKITSQWDRLADSDRQRREFIANISHDLRTPLTSLLGYLETLSLKSATLSPQEHQQYLATALRQGQKVRHLSQQLFELARLEHGGIKPQRERFAMAELISDVAQKFELTARTREVNLRIDVPGRLPLVNADVSMIERVVTNLLDNAIRHTPSGGEIRLAVWQENERLQVEVADNGTGVDASLRDDLFQRPSALNPQASRENRGGLGLLIVKRMLELHGGGIRLMESVSGARFRFFVPL

SEQ ID NO: 7089 - protein, 405 aa, Enterobacter cloacae
AGQALAPPGDAHPDGAFAPVLIYAGEHPVNDAIPRPQAKVRKALTPLLEIRNLTKSFDGQHAVDDVSLTIYKGEIFALLGASGCGKSTLLRMLAGFEQPTAGQIVLDGVDLSSVPPYQRPINMMFQSYALFPHMTVEQNIAFGLKQDKLPKAEITARVAEMLSLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGLLKERQDDGLVIESPGLVHPLKVDSDNSVVDNVPVYVALRPEKIMLCDEPPADGYNFAVGEVVHIAYLGDLSIYHVRLKSGQMLSAQLQNEHRYRKGQPTWGDEVSLCWDADSCVVLTV

SEQ ID NO: 7090 - protein, 320 aa, Enterobacter cloacae
GAVMSTLEPPARVKKPGGFALWLARMQMAHGRKLVIAMPYIWLILLFLLPFLIVFKISLAEMARAIPPYTDLWEWADGQLTLTVNLGNFLQLTDDPLYFEAYLQSLQVAAISTICCLLMGYPLAWAVAHSKPSTRNILLLLVILPSWTSFLIRVYAWMGILKNNGILNNFLLWLGVIDQPLTILHTNLAVYIGIVYAYLPFMVLPIYTALTRIDYSLVEASLDLGARPLKTFFSVIVPLTKGGIIAGSMLVFIPAVGEFVIPELLGGPDSIMIGRVLWQEFFNNRDWPVASAVAIVMLLLLIVPIMWFHKHQQKQMGDHG

SEQ ID NO: 7091 - protein, 378 aa, Enterobacter cloacae
GFHMQCALYDAGRCRSCQWIEQPVSQQLTAKMANLQQLLAAHAVGEWCAPVSGPEQGFRNKAKMVVSGSVEKPLLGMLHRDGTPEDLTDCPLYPASFEPVFSALKPFIARAGLTPYNVARRRGELKYLLLTESQIDGGMMLRFVLRSETKLEQLRAALPGLQQQLPQLKVITANIQPVHMAIMEGEKEIFFTEQHALEERFNGVPLWIRPQSFFQTNPTVASALYTTARDWVRALQVHHMWDLFCGVGGFGLHCATPDMQLTGIEISAEAIACAKQSAAELGLTNLHFQALDSTQFATGQGNVPELVLVNPPRRGIGQALCDYLSQMAPEYIVYSSCNAQTMAKDIASLPGYRIARVQLFDMFPHTAHYEVLTLLTKA

SEQ ID NO: 7092 - protein, 270 aa, Enterobacter cloacae
YSQAMFRQLHQVEHCLYWLPYVLRNTKRDKMTPTIDLLRSHRSIRHFTDEPITQAQRDAIIDSARGTSSSSFLQCSSIIRITDPAMREQLVTLTGGQKHVAQAAEFWVFCADFNRHLQICPEAELGLAEQLLLGVVDTALMAQNAFTAAESLGLGGVYIGGLRNNIESVTELLKLPKHVLPLFGLCLGWPADNPDLKPRIPAAMLVHENHYQPVDQDVLHQYDEELANYYLTRDSNNRRDTWSDHIRRTIIKENRPFILDYLHKQGWATR

SEQ ID NO: 7093 - protein, 378 aa, Enterobacter cloacae
RTFRRNNNMIALNKKWLSGLVAGALMAVSAGTLAAEQKTLHVYNWSDYIAPDTVANFEKETGIKVVYDVFDSNEVLEGKLMAGSTGFDLVVPSASFLERQLTAGVFQPLDKSKLPNWKNLDPDVLKLVAKHDPDNKYAMPYLWATTGIGYNVDKVKAALGPDVKLDSWDVVLKPENLEKLKSCGVSFLDAPEEIFATVLNYLGKDPNSSKADDYTGPATDLLLKLRPNIRYFHSSQYINDLANGDICVAIGWAGDVWQAANRAKEAKNGVNVSYFIPKEGALAFFDVFAMPADAKNKEEAYQFLNYLMRPDVIAHISDHVYYANGNKASEPLVSEEIRNNPAIYPPADVFAKLFTLKVQEPKIDRVRTRAWTKVKSGK

SEQ ID NO: 7094 - protein, 242 aa, Enterobacter cloacae
QMIEGLPMKQILLVEDDHDIAALLRLNLEDEGYAITHEPDGGNALQRLETQPWDAVILDLMLPNVDGLEICRRIRQMTRYLPIIIISARSSETDRITGLETGADDYLAKPFSVQELIARIKALFRRQQAMGQAQTDGIIQAHGLTIDPLARTVRLNGQHVDLTPREFELLYFFARHPGEVFSRLALLEQVWGYQHEGYEHTVNTHINRLRIKIEKDAAEPEIVRTVWGKGYKFAEQNHDASL

SEQ ID NO: 7095 - protein, 698 aa, Enterobacter cloacae
LMNKLFLLSGLALAISSACHAELRTWPDPTGPSQSDFGGTGLMQMPDARFGREGEFSVNYRDNNQYRFYSSSVVLFPWLEGTIRYTDVRTRKYSSNEDFSGDQSYKDKSFDFKVRLWEEDYSLPQVALGKRDIAGTGLFDGEYLVASKMAGPVDFTFGIAWGYPGNSDNVGNPLCHDNNKYCTRGESHDAGDISFSDMFRGPASLFGGLQYQTPWQPLRLKLEYDGNNYADDFAGSIKQSSHINVGAVYRVADWADLNLSYERGNTLMFGFTLRTNFNDLRPALRDNPKPAWQPAPAGETLDYTSAANQLTALKYNAGFDAPEILQHGNTLYMTGEQYRYRDPREAVDRANRILINNLPDGVDTIAITQQRDHLPLVTTQTDVASLRKQLAGQPLGQEEALRQQRVEPVDTTAFGRGYRIRADRFSYSVKPTLAQSLGGPEDFYMFQVGVMASASYWLTDRLLLDGGVFANLYNNYDKFKSSLLPADSSLPRVRTHIRDYVSNDVYINNLQANYVDALGNGFYAQIYGGYLETMYGGVGAEALWRPLDSDWALGVDANYVKQRDWDDMMRFTDYSVPTGFITAYWNPAKLNSVLMKLSVGQYLAKDKGATLDVAKRFDSGVTVGVWAALTNVSKEDYGEGGFSKGFYISIPLDLMTIGPNRNRAVVSWTPLTRDGGQMLGRKYQLYDMTSERETPVGQ

SEQ ID NO: 7096 - protein, 158 aa, Enterobacter cloacae
NREIYQNMAKLTFNAILVICTGNICRSPIGERLLRRLLPAARVDSAGTCGLEGRTADSQATEIAAERGTLLEGHVARRLTPAMVRDYDLILAMELEHIEQFTAIAPEARGKMMLFGHWTGKKEIPDPTVKPGTHLNMFMGCWSRPVWNGRNGSVNHTG

SEQ ID NO: 7097 - protein, 728 aa, Enterobacter cloacae
LRFMSTNNLHAHDASAANNEIDLVRLLGELLDHRKFILILTALFTLVALLYALFATPVYQADALIQVEQKQGNALLSNLSEFIPDSSPESAPELQLLQSRMILGKTIDDLNLRTQVSENYFPFVGRGWARLTGQQPGIVDIRMLNLPPVAGRAQKLTLTVGEKGHYQLEGDNVTLQGVVGQPLSAANIAITIADIQAKPGTQFTITQQSELEAIDALQLRFSVSERSKDSGMLGLTITGEDPDEMARVLNCIADNYLQQNVARQAAQDAKSLQFLKQQLPQVRSELDQAEEKLNRYRQQNDSVDLNLEAKAVLEQIVNADNQLNELTFREAEISQLYKKDHPTYRALIEKRQTLEQEKNRLNKRVSSMPSTQQEVLRLSRDVESGRVIYQQLLNREQELSIARSSAIGNVRIIDPAVTRPQPVKPKKALVVVLGVLLGLFVSAGWILARSMLRMGIETPEQLEEHGINVYATVPLSEWLAKKMRLRKKDFMSPGLRHKTKHIPFLAADNPVDLSVEAIRGLRTSLHFAMMESANNILMISGATPDSGKTFVSSTLAAVVAQAGQKVLYIDADMRRGYAHDLFKLDNTCGLSEILSGKAEYTQGVQTFDKGGFDTIVRGQIPPNPAELLMHTRFQQLLDWANERYDLVIIDTPPILAVTDAAVVGRRAGTTLLVARFGMNSVKEMLVCVQRLEQSGVNTKGVILNGVVKRASNAYGYGYHHYGYNYSSN

SEQ ID NO: 7098 - protein, 605 aa, Enterobacter cloacae
LNFACRFQLLPSFCCNKNNALKRARKMHFCSWSAAPGQGIPFAKQGGVIMVKWISILMIFLSSGAMAICPVWSPAKAGQEIAALKAQLTRWNEDYWKQGSSEVSDDVYDRLNARLKQWQRCFHDEPLHDDPPAASGTVKHPFAHTGVHKVESKQALSRWMATQQDLWVQPKVDGVAVTLVYKNGKLAQAISRGDGLQGEEWTAQARMIPAIPQTLAGPLANSVLQGELFLLREGHIQQRMGGMNARAKVAGAMMRATDRAALKQTGIFIWAWPNGPKVMKARLSALAEAGFTLTARYTLPVKNAADVEAQRTAWFKASLPFATDGIVVRASAEPPGEEWLPGEGSWVVAWKYLPVAQVTEVKAIHFTVGRTGRITAIAQLEPLMLDDKRVQRVSLGSVNRWQRLDIAPGDQVLVSLAGQGIPRLDNVVWRNVDRRKPQPPSSRYNGLTCFYASPECMEQFFARLTWLSSRQALDIEGMGESGWRTLYQAHRFEHLFSWLQLTQAQLTATPGISASHGAALWHQFNLARERPFIRWITAMGIPLARSTLKAAGDRTWQALIQRSEAEWRMLPGVGQEKARQIVNWLHQPQIDALAKWLAAEHIGGF

SEQ ID NO: 7099 - protein, 274 aa, Enterobacter cloacae
FRYRPGTPERTDARRGRIPCRHDDVEARPMNRLRKWLPGVGLSLFSLSALCASVVTVHQPGKTWSAEPADTLSRLVTQPQLNNVWWQGAVIATPSATLRAQQTQQQVLASLSVWQNRTDDERIATIRAVAAQIRSLRIVGRQFVSLDPDAVRTDARGDRFLEGRYDLWLSPAPRTVTLMGAVVTPGKRAWRPGASIRDYLQGQLRLAGADRNNVTVIDPDGSTVVAPVAYWNARHIEAEPGAVLWVGFDPRAVPDDFTGLNEQIVALLTRRIPD

SEQ ID NO: 7100 - protein, 377 aa, Enterobacter cloacae
MKNVKFSVLALAMMALSGCTIVPGQGLSTQGKDIIDLPDSNYDLNKMVNVYPLTPGLVEQLLPGKVDSRANPELDRQLQNYQYCIGVGDVLMVTVWDHPELTTPAGQYRSASDTGNWVNADGTIFYPYIGKIRVVGKTLAQVRDEIAARLDSVIESPQVDVSVAAFRSQKAYVTGEVAKSGQQPITNIPLTIMDAINAAGGLTSEADWRHVVLTHNGQDTHISLYALMQRGDLTQNKLLYPGDILFIPRNDDLKVFVMGEVGKQSTQKMDRSGMTLAEALGNAQGVNQDMADATGIFVIRPLQGKQNGKIANVYQLNARDATAMVLSTEFQLEPYDIVYVTTAPLVRWNRVISQLVPTITGVHDLTETGRYIRTWPN

SEQ ID NO: 7101 - protein, 225 aa, Enterobacter cloacae
LISMLFNQGFLVRLFILLIMTLLIQGCTPSQQSIIETFNASLDGRQDVTVTDGQIQAFPYSTMYLRLDNGPRILVVLGYIEQGNSKWLSQDNAMIVTHNGRLIHTLKLPYNLLEVTNLEHDPLRHTPQLRDGSQWSRDVRWQEEGRYRSAHLNSRFSLSGTENLTLAGNTLRCQVWQEAVQADGLDRRWHNTFWIDSATGQVRQSEQMLGAGVFPVAMTMLKPAP

SEQ ID NO: 7102 - protein, 82 aa, Enterobacter cloacae
GPRGAQAHPRHGARLRSDSGDGAGTYRAVHGYRTGGARQNDALWSLDGQKRDPGPHRKTRDAFEYVYGLLEQASLEWAKRLS

SEQ ID NO: 7103 - protein, 279 aa, Enterobacter cloacae
TFPFLKERWGDYSFQGLLRIGISVLYPYNAQPHSFQAGESIMRPAGRNANQVRPVTLTRNYTKHAEGSVLVEFGDTKVLCTASIEKGVPRFLKGQGQGWITAEYCMLPRATHTRNAREAAKGKQGGRTMEIQRLIARALRAAVDLKTLGEFTITLDCDVIQADGGTRTASITGACVALADALNKLVAAGKLKTNPMKGMVAAVSVGIVNGEALCDLEYVEDSAAETDMNVVMTEDGRIIEVQGTAEGEPFTHEELLTLLALARGGIESIVATQKAALEN

SEQ ID NO: 7104 - protein, 229 aa, Enterobacter cloacae
VAFFLPVRLKRQRSKSMKSYQRQFIEFALNKQVLKFGEFTLKSGRKSPYFFNAGLFNTGRDLALLGRFYAEALVDSGIDFDLLFGPAYKGIPIATTTAVALAEHHDRDVPYCFNRKEAKTHGEGGNLVGSALQGRVMLVDDVITAGTAIRESMEIIQANGATLAGVLISLDRQERGRGDISAIQEVERDYNCKVTSIITLKDLIAYLEEKPEMADHLAAVRQYREEFGV

SEQ ID NO: 7105 - protein, 72 aa, Enterobacter cloacae
RTPDIVAGVAALKTLVPNVVGFAAETNNVEEYARQKRTRKNLDLICANDVSLSTQGFNSDRQRIAPFLAGWR

SEQ ID NO: 7106 - protein, 227 aa, Enterobacter cloacae
CNNKPQTSVCGSLCGCQPDKCLFSGVFCNMAEKQTAKRNRREEILQSLALMLESSDGSQRITTAKLAASVGVSEAALYRHFPSKTRMFDSLIEFIEDSLITRINLILKDEKDTSTRLRLIVLLILGFGERNPGLTRILTGHALMFEQDRLQGRINQLFERIEAQLRQVLREKKMREDEGYNTDETLLASQILAFCEGMLSRFVRSEFKYRPTDDFDARWPLVAAQLQ

SEQ ID NO: 7107 - protein, 305 aa, Enterobacter cloacae
EAPESYNPPISPLKTGMSMIRSMTAYARREIKGSWGSATWEMRSVNQRYLETYFRMPEQFRSLEPVVRERIRTRLTRGKVECNLRFEPDASAQGELILNEKLAKQLVNAANWVKMQSDEGEINPVDILRWPGVMAAGEQDLDAITAEILAALDGTLDDFIVARETEGQALKAMIEQRLEGVSAEVAKVRAHMPEVLQWQRERLVAKLEEAEVQLENNRLEQELVLMAQRVDVAEELDRLEAHVKETYNILKKKEAVGRRLDFMMQEFNRESNTLASKSINAEVTNSAIELKVLIEQMREQIQNIE

SEQ ID NO: 7108 - protein, 193 aa, Enterobacter cloacae
HIQKTLMAQGTLYIVSAPSGAGKSSLIQALLKTQPLYDTQVSVSHTTRAPRPGEVHGEHYFFVNHDEFRAMIGRDAFLEHAEVFGNYYGTSRETIEQVLATGVNVFLDIDWQGAQQIRKKMPDSRSIFILPPSKDELDRRLRGRGQDSEEVIAKRMAQAVAEMSHYAEYDYLIVNDDFDAPLSDRFHQRRPEG

SEQ ID NO: 7109 - protein, 214 aa, Enterobacter cloacae
SPSLHSGGFMLLHILYLIGITAEAMTGALAAGRRRMDTFGVIIIATATALGGGSVRDILLGHYPLGWVKNPEYVIIVATAAVLTTIVAPVMPHLRRVFLVLDALGLIVFSIIGAQIALDMGEGPVIATIAAVITGVFGGVLRDMFCKRIPLVFQKELYAGISFAAAVLYVALQHYVTSHDVVVISTLLFGFTARMLALRLKLGLPVFHYKHNAH

SEQ ID NO: 7110 - protein, 189 aa, Enterobacter cloacae
QRQATHCTFSGRMEIKSYRLSAKNSWANTYWTRSLPVMMKKIDVKILDPRVGEQFPLPTYATSGSAGLDLRACLDDAVELAPGATTLIPTGLAIHIADPSLAAVILPRSGLGHKHGVVLGNLVGLIDSDYQGQLMVSVWNRGQDSFTIEPGERIAQMVFVPVVQAEFNLVADFDATDRGEGGFGHSGRK

SEQ ID NO: 7111 - protein, 525 aa, Enterobacter cloacae
FAAGECFPRMRISFSVLASPSDDFMDALLQLKGIDKSFPGVKALSGAALNVYSGRVMALVGENGAGKSTMMKVLTGIYQRDAGSLLWLGKETTFNGPKSSQEAGIGIIHQELNLIPQLTIAENIFLGREFVNRFGKIDWKTMYAEADKLLAKLNLRFKSDRLVGDLSIGDQQMVEIAKVLSFESKVIIMDEPTDALTDTETESLFRVIRELKSQGRGIVYISHRMKEIFEICDDVTVFRDGQFIAEREVATLTEDSLIEMMVGRKLEDQYPHLEKAPGEIRLKVDNLCGPGVNDVSFTLRKGEILGVAGLMGAGRTELMKVLYGALPRTSGYVTLDGHEVVTRSPQDGLANGIVYISEDRKRDGLVLGMSVKENMSLTALGYFSRSGGSLKHKDEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLGGEFTREQATQEVLMAAAVGKLNRVNQE

SEQ ID NO: 7112 - protein, 89 aa, Enterobacter cloacae
SSPSAAVGCGLASMAKVVACRALRSKPLIPSPQGDTFNGALVTALLEGKAMDDAIRFAHAAAAIAVTRKGAQPSVPWRKEIDEFLSQQG

SEQ ID NO: 7113 - protein, 331 aa, Enterobacter cloacae
RLATMKDVARMAGVSTSTVSHVINNDRFVSEAIREKVDAAIKELNYAPSALARSLKLNQTRTIGMLITASTNPFYSELVRGVERSCFERGYSLVLCNTEGDEQRMNRNLETLMQKRVDGLLLLCTETHQPSKEIIQRYPSIPTVMMDWAPFDGTSDLIQDNSLLGGDMATQHLIDKGHTRIACITGPLDKTPARLRLEGYLSAMERAGLAIPDGYRITGDFEFNGGFEAMQKLLAQEPRPQAVFIGNDAMAFGAYQALYQAGLRVPDDMAIVGYDDIELARYMTPPLTTIHQPKDELGELAIDVLIHRMAQPTLQQQRLQLTPVLMERGSV

SEQ ID NO: 7114 - protein, 623 aa, Enterobacter cloacae
SMSTDNKQSLPAVTLAAIGVVYGDIGTSPLYTLRECLSGQFGFGVERDAVFGFLSLIFWLLILVVSLKYLSFVMRADNAGEGGILTLMSLAGRNTSARMTSVLVIIGLIGGSFFYGEVVITPAISVMSAIKGLEIVAPQLDTWVVPLAIIVLTLLFAIQKHGTGLVGKLFAPIMLAWFLILAALGLRSIIANPDVLHALNPLWAVHFFLKYKVVSFVALGAVVLSITGVEALYADMGHFGKLPIRVAWFSVVLPSLVLNYFGQGALLLAHPEAIKNPFFLLAPDWALVPMLILATLATVIASQAVISGVFSLTRQAVRLGYLSPMRIIHTSEMESGQIYIPFVNWLLYFAVVIVIVSFEHSSNLAAAYGIAVTGTMVLTSILSTTVAYRNWHWNKFLVGLILVGFLCIDVPLFSANLDKIVSGGWLPLTLGLVMFIVMTTWKSERFRLLRRMHEHGNSLEAMIASLEKSPPVRVPGTAVYMSRALNVIPFALMHNLKHNKVLHERVILLTLRTEDAPYVHNVRRVQIEQLSPTFWRVVASYGWRETPNVEEVFHRCGLEGLSCRMMETSFFMSHESLIIGKRPWYLRLRGKLYLILQRNALRAPDQFEIPPNRVIELGTQVEI

SEQ ID NO: 7115 - protein, 276 aa, Enterobacter cloacae
IRSKKMTTQAVSGRRYFTKAWLMEQKSLIALLVLIAIVSTMSPNFFTVNNLFNILQQTSVNAIMAVGMTLVILTSGIDLSVGSLLALTGAIAASIVGIEVNALVAVAAALAAGAAIGAVTGVIVAKGRVQAFIATLVMMLLLRGVTMVYTNGSPINTGFTDNADLFGWFGIGRPLGVPTPVWIMAIVFLAAWYMLHHTRLGRYIYALGGNEAATRLSGISVNKVKIIVYSLCGLLASLAGIIEVARLSSAQPTAGTGYELDAIAAVVLGGTSPCGR

SEQ ID NO: 7116 - protein, 331 aa, Enterobacter cloacae
IMKTAYIAKQRQISFVKSHFSRQLEEKLGLIEVQAPILSRVGDGTQDNLSGCEKAVQVKVKTLPDAQFEVVHSLAKWKRQTLGQHDFSAGEGLYTHMKALRPDEDRLSPIHSVYVDQWDWERVMGDGERHVGTLKSTVEAIYAGIKATEAAVSKEFGLAPFLPETIHFVHSQELLSRFPDLDAKGRERAIAKELGAVFLIGIGGKLSDGKRHDVRAPDYDDWSTVGESEYAGLNGDILVWNPVLEDAFELSSMGIRVDAEALKRQLAVTGDEDRLQLEWHQALLRGEMPQTIGGGIGQSRLTMLLLQLSHIGQVQCGVWPQQVRESVGSLL

SEQ ID NO: 7117 - protein, 149 aa, Enterobacter cloacae
RNVSLVEQKMKKGTVLNSEISSVISRLGHTDTLVVCDAGLPVPRSTTRIDMALTQGVPSFMQVLEVVTAEMQVEAAILAAEIKQHNPQLHETLLSHIEQLQQHQGNTIEIRYTTHEQCKQHTAHSHAVIRSGGMFPPYANIILCAGVTF

SEQ ID NO: 7118 - protein, 181 aa, Enterobacter cloacae
PWCTPTAARLIPALPITPICLAGSVSVARWVSRPRSGSWLSFSWRRGTCCTIPVWVVISMRWAVTKRQRACPVSALIKSKLSFTPCAACWRLWRASSKWRASLPHSQRRVRAMSWMPSRQWFWAVRVLAGGKGRIVGTLIGALILGFLNNGLNLLGVSSYYQMIVKAVVILLAVLVDNKKQ

SEQ ID NO: 7119 - protein, 305 aa, Enterobacter cloacae
LTTLQDILDMNMKKLATLVSAVALSATVSANAMAKDTIALVVSTLNNPFFVSLKDGAQKEADKLGYNLVVLDSQNNPAKELANVQDLTVRGTKILLINPTDSDAVGNAVKMANQAKIPVITLDRQATKGDVVSHIASDNVLGGKIAGDYIAKKAGEGAKVIELQGIAGTSAARERGEGFQQAVAAHKFNVLASQPADFDRTKGLNVMQNLLTAHPDVQAVFAQNDEMALGALRALQTAGKSDVMVVGFDGTPDGEKAVNDGKLAATIAQLPEQIGATGVQTADKVLKGEKVQAKYPVDLKLVIKQ

SEQ ID NO: 7120 - protein, 298 aa, Enterobacter cloacae
GTPNKRKVWHTPPGNTGGALRWTPQYMKTAGNLVVLGSINADHILNLETFPTPGETVTGNQYQVAFGGKGANQAVAAGRSGANIAFIACTGDDDTGERVRKQLASDNIDIAPVSVVAGESTGVALIFVNAEGENVIGIHAGANAALTTERVEAQRGIIAGAEALLMQLESPVESVLAAAKIAHENHTSVVLNPAPARVLSDELLALVDIITPNETEAEKLTGIRVENDDDAARAALALHDKGIGTVIITLGSRGVWASVNGEGRRVPGFKVKAIDTIAAGRHLQRCAGNGAAGRKSNG

SEQ ID NO: 7121 - protein, 146 aa, Enterobacter cloacae
KLTWWRTEDNFNQVVDHFLVMRSSLEPQACLLAATLGTAEQKAQLNTLMEEMVDLKKHFNRERWIAVDMAWHEHIYNMSGNPFLTSFASLFHSVYHTYFTSITQDEVVKLNLHQAIVDAIQESDGQRALSACQALLAAPTHQQVNK

SEQ ID NO: 7122 - protein, 487 aa, Enterobacter cloacae
TGASMLTLDTLNVMLAVSEEGLIEEVVITLLASPQLAAFFEKFPKLRKAMTDDLPRWRDNLRQRFKETEVPPELTEEVAGYQQCQRLSTPQFIAQLQQTLTLLDNVHSPFASQARALVTDNPSFTPALHTLFLQRWRLSLVVQATALNQQLLDEEREQLLSEVQERMTLSGQLEQVLVENENAAGRLWDMSAGQLKRGDYQLIVKYGDFLAQQPELMKLAEQLGRSREARSVPKKDAPMETFRTLVRKPSTVPEQVDGLQQSDDILRLLPTELSTLGMTELEYEFYRRLVEKQLITYRLHGEAWREKISQRPVVHQDFDEQPRGPFIVCVDTSGSMGGFNEQCAKAFCLALMRVALADRRRCYIMLFSSEVVGYELTSPQGLEQAIRFLSQRFRGGTDLASCFRSIIERMQGGDWYDADAVVISDFIAQRLPDEVVNKVKEMQRVHQHRFHAVAMSAHGKPGIMRIFDHIWRFDTGLRSRLLRRWRR

SEQ ID NO: 7123 - protein, 477 aa, Enterobacter cloacae
MTEKKARSMAGLPWIAAMAFFMQALDATILNTALPAIAQSLNRSPLAMQSAIISYTLTVAMLIPVSGWLADRFGTRKVFMLAVTLFTLGSLACALSTSLTELVIFRVLQGIGGAMMMPVARLALLRAYPRSELLPVLNFVTMPGLVGPILGPVLGGVLVTWASWHWIFLINIPIGVAGLIYARKYMPNFTTPRRSFDMGGFFLFGLSLVLFSSGMELFGEKIVSTWLALAVILSGILLFLLYIRHARRHPTPLISLSLFNTRTFSVGIAGNIASRLGTGCVPFLMPLMLQVGFGYPALIAGCMMAPTAMGSILAKSTVTQVLRWFGYRKTLVGVTIFIGLMIAQFSLQSAALPIWMLILPLFVLGMAMSTQFTSMNTITLADLTDENASSGNSVLAVTQQLSISLGVAVSAAVLRFYEGFDGTNTVEQFHYTFITMGALTVVSAVVFMLLKPKDGRNLIKERHKEKAKPNRVPSEQE

SEQ ID NO: 7124 - protein, 528 aa, Enterobacter cloacae
RRTSAYYQARPKRLYSLQLAATTAKGCKTIMAHSHLLAERISRLSSALEKGLYERSHAIRLCLLAALSGESVFLLGPPGIAKSLIARRLKFAFQNARAFEYLMTRFSTPEEVFGPLSIQALKDEGRYERLTAGYLPEAEIVFLDEIWKAGPAILNTLLTAINERRFRNGASEEKIPMRLLVAASNELPEADSSLEALYDRMLIRLWLDKVQDKSNFRSMLVSQQDENENPVAASLQVTDEEYHQWQEEIGKIKLPDPVFELIFMLRQQLDLLPSAPYVSDRRWKKAIRLLQASALFSGRDAVAPIDLILLKDCLWHDAEGMNLMQQQLDVLMTGHAWGQQSMLNQLGAIAQRRLQLQQQQSDKTALKVNRLGGMFARKPHYELPAGLTDASLTLLLQQPLKLHDMQVVHVTIERVALVQWLDKGGEIRGKLNGIGFAQPLSMEVDSSQHLVIRDVSLQGSRLALPGTASDTVPEEIKQQLDALDNEWHQQHTRFSEQQKCLFIHSDWLGRIEASLQDVSAQIKQARQC

SEQ ID NO: 7125 - protein, 155 aa, Enterobacter cloacae
EKPMENYQIDNLDRGILEALMANARTAYAELDKQFGVSPGTIHVRVEKMKQAGIITGARIDVSPKQFGYDVCCFIGIIMKSAKDYPSALEKLNALDEVTEAYYTTGHYSIFIKVMCRSIDALQQVLINKIQTIDEIQSTETLISLQNPIMRTIRP

SEQ ID NO: 7126 - protein, 179 aa, Enterobacter cloacae
SGNFIPTFSTGRSQLVHSVQWPPLYLSERSMADITLISGSTLGGAEYVAEHLAEKLEDAGFSTQTLHGPLLEDLPTDGVWLLITSTHGAGDLPDNLQPLYDELLEQQPDLSNVRFGAVGIGSREYDTFCGAIEKVEAAVTACGAKQLGETLKINILDHDIPEDPAEIWLAEWKNLLKND

SEQ ID NO: 7127 - protein, 325 aa, Enterobacter cloacae
WHVVSRSLRYLHRLYIGSTILSQSKFQRAFLHPRYWFTWFGLGVLWLLVQLPYPVIRFLGSKLGSASRHFLKRRESIARKNLELCFPHYNAQQRETLIAENFKSIGMALLETGMAWFWPDERVRKWFDVEGLDNLKRAQMQNRGVMVVGLHFMSLELGGRVMGLCQPMMATYRPHNSALMEWVQTRGRMRSNKAMISRNNLRGMVGALKKGEAVWFAPDQDYGPKGSSFAPFFAVKDVATTNGTFVISRLSGAAMLTVTMVRKADKSGYRLHISPEMANYPEDESEAATFINKVIEFEIMRAPEQYLWMHRRFKTRPLGEASLYI

SEQ ID NO: 7128 - protein, 244 aa, Enterobacter cloacae
QMKVIIVEDEFLAQQELSWLIKTHSQMEIVGCFEDGLDVLKFLQHNRVDAIFLDINIPSLDGVLLAQNINQFAHKPFIVFVTAWKEHAVEAFELEAFDYILKPYQESRIISMLHKLEAAWQQQSLPASASPVARENDTINLVKDERIIVTPVDDIYYAEAHEKMTFVYTRRESYVMAMNITEFCNKLPAAHFFRCHRSFCVNLNKIREIEPWFNNTYILRLKDLDFQVPVSRSRVKEFRQLMHL

SEQ ID NO: 7129 - protein, 419 aa, Enterobacter cloacae
AVLYKEIIMLHPRARTMLLLAVPALIIGVASSLVLIVVMKVAAVLQTILWTALPVKLGISIDSPGWIMVMLTLTGIAVGLVIRYSPGHAGPDPALEPLIGAPVSPSALPGLIIALIIGLAGGVSLGPEHPIMAVNIALAVFLGARLFPRVGALDWTILASAGTIGALFGTPVAAALIFSQTLSSDHEVPLWDKLFAPLMAAAAGALTTSLFFHPHFSLSIPHYGQMQLTDIFSGAVVVAIAIALGMVAVWCLPRLHRLMHRLKHPVLILGMGGFILGVLGAIGGTVTLFKGLDEMQQLAFSQVFSVSDYLLFALVKLAALVVAAACGFRGGRIFPAVFVGVALGLMLHEHVDAVPAAITVSCSILGLVLVVTRDAWLSLFMAAVVVPDTTLLPLLCIVMLPAWLLLAGKPMLMAWRNDR

SEQ ID NO: 7130 - protein, 318 aa, Enterobacter cloacae
MSNYPEGAVMKDINEEKIGENNEELEIESEEKDRGEEIEVDEDRLPSRAMAIHEHIRQDGEKEMERDAMALLWSAIAAGLSMGASLLAKGIFHVQLEGVPGGFLLENLGYTFGFIIVIMARQQLFTENTVTAVLPVMQNPTLGNFGLLMRLWSVVLLGNLIGTGIAAWAFEYMPIFDEPTRDAFVKIGMDVMKNTPVEMFSNAIISGWIIATMVWMFPSAGSAKIVVIILMTWLIALADTTHIVVGTVEILYLVFNGTLHWSDFFWPFALPTLAGNICGGTFIFALLSHAQIRNDMSNKRKAELKAQEKKDKTAEKSA

SEQ ID NO: 7131 - protein, 126 aa, Enterobacter cloacae
HNQKFIAAVAKNVITGSHVVVERAGDFSQDLVPGIVPPGIVDLFKFVDVNQQRRELCSRPGGVQDFAFEDGWQETAIQQAGQDINPHLVSRHFVKQFAQKRDDLRERITHSLQEFIPLRFITQTLP

SEQ ID NO: 7132 - protein, 574 aa, Enterobacter cloacae
IFPVFPGLTVHEIFNMLLAVFDRAALMLICLFFLIRIRLFRELLHKSAHSPKELLAVTFIFSMFALFSTWSGVPVEGSLVNVRIIAVMSGGILFGPWVGIITGIIAGTHRYLIDIGGVTAVPCFITSIIAGLLSGWINRKIPKKQHWRAGIIAGMVCETLTMILVIVWAPTVALGLDIVSKIGIPMILGSVCIGFIVLLVQSVEGEKEASAARQAKLALDIANKTLPLFRHVNAESLRQVCDIIRRDIHADAVAITNIDHVLAYVGVGEHNYRDSDDTISPTTRQAINYGKIIIKNNDEAHRTPEIHSMLVIPLWEKGVVTGTLKIYYCHAHQITSSLQEMAIGLSQIISTQLEVSRAEQLREMANKAELRALQSKINPHFLFNALNAISSSIRLNPDTARQLIFNLSRYLRYNIELKDDEQIDIKKELYQIKDYIAIEQARFGDKLTVIYDIDEEVNCVIPSLLIQPLVENAIVHGIQPCKGKGVVTISVTESGNRVRIAVRDTGHGIDPKVIERVKSNEMPGNKIGLLNVHHRVKLLYGDGLHIHRLEPGTEIAFYVPNERTPVNAPISLLP

SEQ ID NO: 7133 - protein, 436 aa, Enterobacter cloacae
RWANGESGHFYHMSEPITVAQAVLTEQNACYEIDRVLTTMLRERRPGYLMLPADVAKKAATPPVSALTVNPAPADSACLQAFREAAEKRLSTSKRTALLADFLVLRHGLRAALQTWVKEVPMAHATMLMGKGIFDERQSGFYGTYSGSASAAPVKEAIEGADTVLCIGTRFTDTLTAGFTHQLTPDQTIEVQPHASRVGDVWFTGIPMREAIETLTALCKTYVRDTRAPSDHSGFSFPTIEGALTQESFWRTLQTFIRPGDIILADQGTSAFGAIDLRLPADVNFIVQPLWGSIGYTLAAAFGAQTACPNRRVIVLTGDGAAQLTIQELGSMLRDKQRPIILVLNNEGYTVERAIHGPEQRYNDIALWNWTQIPQALSLAPQAECWRVSEAEALAEVLDKVAHHERLSLIEVMLPKADIPPLLSALTKALEARNNA

SEQ ID NO: 7134 - protein, 417 aa, Enterobacter cloacae
RDSEESMAEFSPERRFTRIDRLPPYVFNITAELKMAARRRGEDIIDFSMGNPDGPTPPHIVEKLCTVAQRPDTHGYSTSRGIPRLRRAISRWYQDRYQVDIDPENEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVLDIAAQYKRRRDVLVKGLHEAGWMVEMPKASMYVWAKIPEPYAAMGSLEFAKKLLQDAKVCVSPGIGFGDYGDTHVRFALIENSDRIRQAVRGIKSMFRADGLLAAKSVAEQPES

SEQ ID NO: 7135 - protein, 326 aa, Enterobacter cloacae
RSSRRMTKYALVGDVGGTNARLALCDVNSGEISQAKTYSGLDYPSLEAVVRVYLEEHKVSVEDGCIAIACPITGDWVAMTNHTWAFSIAEMRKNLGFSHLEIINDFTAVSMAIPMLKPEHLIQFGGTAPVEGKPIAVYGAGTGLGVAHLVHVDKRWVSLPGEGGHVDFAPNSEEEGIILEELRAEIGHVSAERVLSGPGLVNLYRAIVKSDGRLPENLQPKDVTERALADSCIDCRRALSLFCVIMGRFGGNLALNLGTFGGVYIAGGIVPRFLDFFTASGFRGGFEDKGRFRSYVQDIPVYLIVHDNPGLLGSGAHLRQVLGQIL

SEQ ID NO: 7136 - protein, 471 aa, Enterobacter cloacae
ICVPACLLKVQTMETYLQTVKEEWVKLINETDPDVHRLATELARDNATPLVAEFYRVVLADPSAAEFLTTEQVERQLQEALRRWLIDVLSCRVEQVEEQMRAQQRAADVHARIGISVDLVEMGFRVLKKLLLPVITTSAHSPEVKLHIYHYAINSIDLAMEVMSRAYVFSENNAAKEDENYRIFSLMENAEEEKERQTAALLSWEMVLLYKITLNSSIGNSLPLGQSEFGLWFSHKGRHYFSGIAEAGHISRLIQEFDDLFNEVRLSGQGLSDKAQRDKFLQRMRNTLSQIITLLRELFDEVSRHEVGVDVLTRLLNRRFLPTIFKREILHATRAGTKLSTLLIDVDKFKQINDTWGHNTGDEILRKVSGAFYDNVRTCDYVFRYGGDEFLIVLTEISEVDALRIAERIRRRVEKIKVNSPTGDIIPLSLSIGVAMFNGHPDYERLIQAADEALYGVKRRGRNCVELWKGA

SEQ ID NO: 7137 - protein, 295 aa, Enterobacter cloacae
RERVVIVLVDIGKRAVTITCTFQAEHHRLRHRWHSTIAILNREKFMKLRLSALALGVTMLVGCASSGEQTGRSDPLEGFNRSMYSFNYNVLDPYLVRPVAVAWRDYVPQPARNGLSNFTSNLEEPAVMVNYFLQGDPYQGMVHFTRFFLNSLLGMGGLIDVAGMANPKLQREQPHRFGSTLGHYGVGYGPYVHLPFYGSFTVRDDGGDMVDTLYPVLSWLTWPLSIGKWTVEGIETRAQLLDSDGLLRQSSDPYIMVREAYFQNHDFIANGGKLKPEDNPNAKAIENELKDIDSE

SEQ ID NO: 7138 - protein, 174 aa, Enterobacter cloacae
YGHEWRWMPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 7139 - protein, 77 aa, Enterobacter cloacae
CCQLTDLVYDGVFEVLQWLLFLSAVPPVQLLTGWCVTVKVLPDISAISALTAVKHGSYSSHTQPLNPVRTRKSLIWP

SEQ ID NO: 7140 - protein, 313 aa, Enterobacter cloacae
PGRNPSCIPSWSGLEQRARLAAEFMYGLLSRQGVIDTAFASLTTKPHLTQDQQALIQDILTDIRIYGQPHFDVTAFYNGMLSYLNRGRFRATGELTTQDRLREVFRISSIDEFRALLANEPMLVLPECPDNKLTLEAFFWRDEYFNSQGPDALLSYLFSPEQIQRYLNVRAEFEDKGKTVEKLSAGQRGTFYVCLKLAADAFGSPFVFDQPEDDLDNEFIMHSLVPLFRKIKQYRQVIIVTHNANLVVNCDAEQVIIAANNDEVISYRSGALEYGDHGAPNSMCKAICDVLEGGRQAFEAREQKYGMVWLNAI

SEQ ID NO: 7141 - protein, 94 aa, Enterobacter cloacae
GAPVASVSISCPSCSATDGVVRNGKSTAGHQRYLCSHCRKTWQLQFTYTASQPGTHQKIIDMAMNGVGCRATARIMGVGLNTIFRHLKNSGRSR

SEQ ID NO: 7142 - protein, 174 aa, Enterobacter cloacae
YGHEWRWMPGNRPHYGRWPQHDFPPFKKLRPQSVTSRIQPGSDVIVCAEMDEQWGYVGAKSRQRWLFYAYDRLRKTVVAHVFGERTMATLGRLMRLLSPFDVVIWMTDGWPLYESRLKGKLHVISKRYTQRIERHNLNLRQHLARLGRTSLSFSKSVELHDKVIGHYLNIKHYQ

SEQ ID NO: 7143 - protein, 77 aa, Enterobacter cloacae
CCQLTDLVYDGVFEVLQWLLFLSAVPPVQLLTGWCVTAKALPDISAISALTAVKHGNCSSLTPLLNPVRTRKSLIWP

SEQ ID NO: 7144 - protein, 94 aa, Enterobacter cloacae; identical to SEQ ID NO: 7141

SEQ ID NO: 7145 - protein, 242 aa, Enterobacter cloacae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSANRNDKNEPPGCDGL

SEQ ID NO: 7146 - protein, 98 aa, Enterobacter cloacae
CPMTLSCSSTDFENDSDVRPSRARCCLRFRLCRSIRCVYRLLITCSFPFRRDSYSGQPSVIHITTSKGDSSLIRRPSVAIVRSPNTCATTVFRSLSYA

SEQ ID NO: 7147 - protein, 226 aa, Enterobacter cloacae
AINPMRILLVEDDPMVGEVVTSSLKDNAWAVDWVKSGNDACVGFSTWQYDVILLDLGLPGKDGLTVLAEIRQKALPVPVLILTARDALEDRLKGLDGGADDYILKPFEMSELLARIRAVIRRNTGNGNPVLSNGVLTLDPVTHEASISETQQKFLLSNREYALLEALMLRPGGILSRSALEDRIYGWGDEVESNAIEFLIHALRKKLGRDAIKNVRGVGWLVSKNG

SEQ ID NO: 7148 - protein, 470 aa, Enterobacter cloacae
TMFGLDAFHLARVQFAFTVSFHIIFPAITIGLASFLAVLEGLWLKTRNDTYKELYHFWSKIFAVNFGMGVVSGLVMAYQFGTNWSGFSQFAGSITGPLLTYEVLTAFFLEAGFLGVMLFGWNRVGPGLHFFATCMVALGTLFSTFWILSSNSWMQTPQGYAIENGVVIPVDWLKIIFNPSFPFRLLHMSTAAFLASAFFVGASAAWHLLKGNDTPAIRKMFSMALWMALIVSPIQAVIGDAHGLNTLEHQPAKIAAIEGHWENKPGEATPLVLFGLPDMNAEETKYKIEVPYLGSIILTHSLDKQVPALKSFPKEDRPNSTIIFWSFRVMAGLGMLMILLGVVSVWLRWRKRLYTSKPFLYFSLFMGPSGLIALLAGWFTTEIGRQPWVVYGVQRTKDAVSAHGDLHMSISLLAFLLVYTSVFGVGYIYLVRLIKKGPVHAEEHQEVTDGTPARPLSAVNEGLATRGRDK

SEQ ID NO: 7149 - protein, 245 aa, Enterobacter cloacae; identical to SEQ ID NO: 6695

SEQ ID NO: 7150 - protein, 98 aa, Enterobacter cloacae
CPMTLSCSSTDFENDSDFRPSRARCCLRFRLCRSIRCVYRLLITCSFPFRRDSYSGQPSVIHITTSKGDSRLIRRPSVAIVRSPNTCATTVFRSLSYA

SEQ ID NO: 7151 - protein, 461 aa, Enterobacter cloacae
KCQGSRMAGFKKRMKTSVQLRLSLALGIAILLTAVISGGITFYLALDEARELQDDTLKQIAYVTKSPGHNALPEIKGQKRADEDSDGKILVEYLTVSGTQNDDTGITFHLPAPVREGFQNATITGVQYRVLVHRLTPEQFVIVGQQTEVRDEIAFASALRTLIPFILLLPVLLLVTTDLIKKSFRPVLNLAAGVYRRDERDLTPLRDDNIPDEIRPFVESINRLLHKVNNTIQAQKRFIADAAHELRTPLTALSLQAERLSGSDMSAEARERLAALRLGLTREKNLLEQLLSLAREQQPLQTQGTEAVSLNEVFRQVIETLLPLALEKGIDIGVVETPYQAESQVITEKNTLYTALKNLVENAIHYIPENGQIDLRLQFIDNSAVIDVEDNGPGIAAEQRERVFDAFYRPAGTEKPGSGLGLSIVKACVHRLGGTIILAPSSHFPSGLRARIILPVESHSG

SEQ ID NO: 7152 - protein, 115 aa, Enterobacter cloacae
RYRGCPVPPGSLCIRARNSMKDEIARQIAGLIELNKFNGYTLVSGEDWQKPTVTEILLVRGFIPLTDNQLANRLDVDERTIRKWKSGETSMVYTTWCCLCWLAGLGMPLDNIISG

SEQ ID NO: 7153 - protein, 346 aa, Enterobacter cloacae
GFGNTWERQIMGIDLSIIWFVIIVFATLMYIVMDGFDLGIGILFPFHKHDVDRDTMMNTVAPVWDGNETWMVLGGAALYGAFPLAYAVIIDALSIPLTAMLLGLIFRGVAFEFRFKAIPEHRPIWDKAFIVGSVLATFSQGVAVGTLLNGLSVSGRAFSGSALVWLAPFPLFCGLGLVLAYALLGCTWLIMKTEDSFHRRMSELATPLTIGLLAVIAIISVWTPLTHPEIASRWFSMPNVIFFLPVPLLVLVCCWGIVRSVYSRRSSFGPFMLTLGLIFLGFSGLGISIWPYIIPPSVTIWQAASPPQSQGFMLIGGLLIIPVILMYTCWSYYVFRGKVKTGDGYH

SEQ ID NO: 7154 - protein, 166 aa, Enterobacter cloacae
IIYISTIYMTSLRLFRACTTLQRHFELYNIFCEFSSKLYTYNHMINIYFIKYIIKYLKNCTFLMYRFENYVYLKCNVTDYENLQERNMQQNGHLADTATAIAQYFEKAALPTQQETLGQVVVEILSDGRNLNRKSLCTKLLSRLEKANGPEEEHHYHMLLGLLFER

SEQ ID NO: 7155 - protein, 126 aa, Enterobacter cloacae
EQMRQNIQLQPEYHSAFLDSALSEYFRHAGDRFAEESAIFSTAVRCVLASEGHLTNKSIILWLIQTLESTDDVVKADVIRKTLEIVVGYTMDDLYRLTLPISSDSVSSSILTNGLTITCPLSPNAL

SEQ ID NO: 7156 - protein, 727 aa, Enterobacter cloacae
TLLHFLTGLLLMKKIASVCPYCGAGCKLNLVVKNNRIIRAEAADGVTNQGTLCLKGFYGWDFLNDTRLLTPRLTQPMIRYSKGEAFTPVTWEEAIRYTAYRLKSIKEQYGPRSIMTTGSSRGTGNETNYVMQKFARAVLNTNNVDCCARVCHGPSVAGLQETLGNGAMSNSINDIENSKCLLVFGYNCADSHPIVARRVLKARENGAKIIVCDPRHIETARIADLHLQLKNGSNMALVNAFGYVLLEEELYDKNYVARFTEGLEAYRLTVKDYAPEQVEHLTGIPARDVRQAMRMFAAAPSATVMWGMGVTQFGQAVDVVKGLSSLALLTGNLGRPAVGVGPVRGQNNVQGACDMGVLPNMFPGYQDVTDPAVRLKFADAWKINVNRMDDRVGTRITEVPHLALEGKIKAYYIMGEDPLQTEADLGLVRRGFEALDFVVVQDIFMTKTAELADVLLPATSWGEHAGVFTCADRGFQRFGKAIEPSGNVRRDWEIISLLATEMGYPMHYEDNQQIWDEMRELCPLFYGVTYEKMGEMGHVQWPCPTLDHPGTPYLYKDNQFDTPTGKGQLFAAPWRAPAETPDADYPLVLCTVREVGHYSCRSMTGNCAALQSLADEPGRVQINPADADERGIAEGQLVWVRSRRGKVITRASISERINAGAIYMTYQWWIGACNELTQDNLDPISRTPETKYCAVQLEAIEDQRWAEDFAASAYQTMKTRLIAAVNV

SEQ ID NO: 7157 - protein, 228 aa, Enterobacter cloacae
GKKMRFITTTGLVMALLPLTLTSASAGVIIGGTRVIFDGAKKEASINITNPDNGPYLIQSWIDVQDEQSGKAPFIITPPLYRLDGGQKNLERIVMTGSLPQGQESLFWLNIKAIPSASKQMNSLQIAVKTRIKLIYRPEALRASTPEEQANKLTWRRAGNTLLVNNPTPYVINFNEITLGNKKLDDVTYVMPSGTARFPLPNGTSGNTLTFKVINDYGSPGELHRASL

SEQ ID NO: 7158 - protein, 856 aa, Enterobacter cloacae
SLRVNQVLVMTTALNTMQPARLAIFIALALAGVSPTLYASETFNTELVELDNPGMGKADLSAFESGSQAPGTYHVDIILDDRLLETRDIRFMAVKDANGSETLQPCLSIGQLKAWGVKTALFPQLDAGEGECADLRAIPQASADFQFGAQRLAISIPQAAIDLPARGYVPPDMWDEGITAAMLNYSLSGANSRARSGAGTRSDSQYANLRPGINVGPWRLRNYTTWSRDASGLDKWDNVYTLMQRAIIPLQAQLTLGDSSAPADVFDSMPFRGVQLASDDDMLPDSLKGYAPVVRGIARTNAQVVVRQNGYQIYQSYVAPGAFEIADMYPTGGAGDLDVTIVEADGSEQHFTLPYASLPVLQREGRLKYALTAGQYRSYNRSVEKTPFGQLTGIYGLPHGITLYGGVQGADKYQSAALGMGKNMGDLGAVSADVTLGWSTPEHTAKTNGQSWRARYSKNFITTGTNFSIAGYRYSTRGYYGMQDVLGSYGDSSALQDRRRNRAELTMSQTLGDNLGALTLSAAREDYWNDGKSMASWSVGYSNYWHNISYGLTWTYSKNVRSASENRKSQKNADHNQLLSFNVSIPLDKFLPQTWANYGMNASSNNGTTHNVGLNGVALENRALSWNVQQGYGTEGVGNTGNVNADYKGTYGEVTAGYGYDKNSERLNYGLQGGILAHADGITLSQPLGETSVLIKAPGAYDVDIRNQPGVRTDFRGYTVVSNLSVYRKNDLTLDPETMPDDVELEINTRTVTPTRGAVVRADYLPKSGRRVLMTLTDNDRAVPFGAVVTLVGDESGSFIVGDRGQVYLTGMREQGTLVATWGSQSSQQCRADFTLPNHSMYGGIADMRATCRQER

SEQ ID NO: 7159 - protein, 226 aa, Enterobacter cloacae
RCTAGDEQPTIFATVCRGARDVAINGPILPDVNPRGVRFSECLRHPEFDLPVAGKKMKIRCRTLLLLALLSGKVCSADSVNIGVTGNIVASPCIFNGGNNNLDVNLGNIQATNMATPGSTSDPVPFSLLFTQCPTGTQSVTVAFTGSPDPEAGADYFMNSGSATHVAIAMRDAQTGALKGTGSSMTQTIAADRTATLAMLASVKSMTGGATPGSIRAVVVMTMQYN

SEQ ID NO: 7160 - protein, 427 aa, Enterobacter cloacae
CAITEFSPRVFVVTPSIFRISMLTTIIYRSHICEDVPVKALEDMVAAANCRNRQFDVTGILLFNGTHFFQLLEGPADNVKEIYQLICRDPRHHNVVELLSDHGPSRRFGNVGMELFDLRQYDTDEVLQKVLDKGTTRYQLTYNDRALQFFRTFVEATEKANYFELPPADAWEFVTENTPLSSQPTVVAKGADCSFAFQPIVDPFMQQVVSWEALIRTPSGESPESYFANLSREALYESDLKSKQVALSMASALGLQTQTLSINLLPMTLVNVPGAVDFLLTAIEANGFVPEQIVVEFTESEAISRFEEFTSAVRQLKSAGISVAIDHFGAGFAGLQLLAQFQPDRIKINRDLIANVHKSGPRQAIIQSIIKCCASLEILFCAVGVELAEEWMWLESAGISQFQGHLFASPRLGGIPAIAWPEKKYDL

SEQ ID NO: 7161 - protein, 283 aa, Enterobacter cloacae
RVSGSLSHSLVSERGVSYTNDLYNLIRLVWLGMEVLCVRELMAYYSIGEVAERCGINPVTLRAWQRRYGLLKPQRSEGGHRQFDDEDILRIEEIKRLMKTGVSVGKVKALLENTEVMTQGNWASFQEEMLTVLRYASPAKLRAKIGEFRRDHAMDVLIDNIITPVRQRMNQDQNTVRHMASLLDGVLIEFAVASLGESRKKAGKDALLIGWECDDRTHLWLEAARLAYKGWHIDVLAEPIDSPRPELIPGQKIFVWTGKAPTPRQQEQLDHWREQGFAVSIHH

SEQ ID NO: 7162 - protein, 125 aa, Enterobacter cloacae
GGPMELHSETFNPADFAWRGLTLTPAAAAHIHELVAKNPDILGVRLGVKQTGCAGFGYVLDTVTEPEKDDLVFETDGAKLYVALQAMPFIDGTEVDYVREGLNQLFKFHNPKAQNECGCGESFGV

SEQ ID NO: 7163 - protein, 438 aa, Enterobacter cloacae
NPVTLRWLNNWRSRVMAGLPNSSNALQQWHRLFEAQAGARSEQAQHHLQQMLRLGLPTRKHENWKYTPLDGLLNGEFVTRLAQVSPGQRDVLALSVDAVRLVFVDGQFREELSDSVQESGFDIVINDERQSLNAPVQPEVFLHLTESLSQSVTHIRVKRNQRPAKPLLLMHITQGVAGDEINTAHYRHHLELAEGAEATVIEHYVSLNDTRHFTGSRLTMNVAANAQLHHIKLAFENPLSHHFAHNDILLGQDAAAYSHSFLLGGAVLRHNTSTQLNGENTTLRINSLAMPVKSEVCDTRTWLEHNKGYCNSRQLHKTIVSDKGRAVFNGLINVAQHAIKTDGQMTNNNLLLGRLAEVDTKPQLEIYADDVKCSHGATVGRIDDEQMFYLRSRGIDQQAAQKMIIYAFAAELTEALPDGGLKQQVLARIGQRLPGGEA

SEQ ID NO: 7164 - protein, 354 aa, Enterobacter cloacae
SPHGEVNPASNAALISRCRITQCTVGSLICAPPAVRNANMKCLNSMLLLCLLAAGSIARAGTCTTIIPQLSTLSVGTINVQRDAPVGTVVFSGAASATGSYLTGCTNPLMLGFSMRYNSATLSSYGNHVYNTNVIGIGIRFSSNGYFENPSNTFSYNAQTSYVDWYGGRIELVVTGPVSSGALTPGVIGVVTLQGSDGLYRDGLTTQLTSGNINALACTVNTAQLTFPIGDIPASAFGTVVGTTPAGAQNTQNLGLTCAAGTNITVSLSGIQNPDSANTSVMALTGQGNAGTAKGVGVQLIYNGAPLAMNSRLFLRQSAGGQETLPLTARYYQTLTRVESGSANASATLNLTYQ

SEQ ID NO: 7165 - protein, 177 aa, Enterobacter cloacae
GTGHVPRIAGDVQHNGRGRQTGGGIKTYSSAAWLTERREMADLPDRDKLLRNFGRCANWEEKYLYIIELGQRLPPLSEEAHNPDNIIQGCQSQVWIQMQQTDDVVIDLQGDSDAAIVKGLIAVVFILYHQMSAQDIVAFDVRPWFEKMALTQHLTPSRSQGLEAMIRAIRAKAAILS

SEQ ID NO: 7166 - protein, 281 aa, Enterobacter cloacae
PESPERMRLRRKLWGIGGTMSRNTEATSDVNTWSGGHLNYKEGFFTQLQTDELAKGINEEVVRAISAKRNEPEWMLEFRLSAFRAWLEMEEPHWLKAHYDKLNYQDYSYYSAPSCGSCDDTCASQPGAVQQTGAENSFLSKEVEEAFNQLGVPVREGKEVAVDAIFDSVSVATTYREKLAEQGIIFCSFGEAIHDHPELVKKYIGTVVPSNDNFFAALNAAVASDGTFIYVPKGVRCPMELSTYFRINAEKTGQFERHILVADESSYVSYIEGCSAPVRDS

SEQ ID NO: 7167 - protein, 233 aa, Enterobacter cloacae
QLQPGVVEVIIHKDAEVKYFTVQNCSPGDVNTGGILNFVTKRALCEGENSKMSWTQSETGSAITWKYPSCILRGDNSIGEFYSVALTSGHQQADTGTKMIHIGKNTKSTIISKGISAGHSQNSYRGLVKIMPTATNARNFTQCDSMLIGADCGAHTFPYVECRNNSAQLEHEATTSRIGEDQLFYCLQRGISEEDAISMIVNGFCKDVFSELPLEFAVEAQKLLAISLEHSVG

SEQ ID NO: 7168 - protein, 251 aa, Enterobacter cloacae
GKHMLSIKDLQVSVEEKEILRGLNFDVKPGEVHAIMGPNGSGKSTLSATLAGREDYEVTSGSVEFNGKDLLEMSPEERAGEGIFMAFQYPVEIPGVSNQFFLQTALNAVRKYRGLEALDRFDFQDLMEEKIKLLKMPEDLLTRSVNVGFSGGEKKRNDILQMAVLEPALCILDETDSGLDIDALKIVADGVNSLRDGNRSFIIVTHYQRILDYIKPDYVHVLYQGRIVKSGDFTLVKQLEEQGYGWLTEQQ

SEQ ID NO: 7169 - protein, 422 aa, Enterobacter cloacae
TAGAGPYRSATAWRRSMTFPVEKVRADFPVLTREVNGLPLAYLDSAASAQKPNQVVDAEAEFYRHGYAAVHRGIHTLSAEATQRMENVRTQVAAFLNARSPEELVFVRGTTEGINLVANSWGNAQVHAGDNIIITQMEHHANIVPWQMLCERVGAQLRVIPLNEDGTLQLEKLDALLDDRTRLVAVTHVSNVLGTENPVALIVDKAHQAGAKVLIDGAQAVMHHAVDVQALDCDFYVFSGHKLYGPTGIGVLYVKEDILQAMPPWEGGGSMIATVSLTEGTTYARAPWRFEAGTPNTGGIIGLGAAISYVSETGLAAIQEYEQLLMHYALQELASVPELTLYGPADRLGVIAFNLGKHHAYDVGSFLDNYGVAVRTGHHCAMPLMAYYEVPAMCRASLVMYNTTEEVDRLVAGLKRIHQLLG

SEQ ID NO: 7170 - protein, 202 aa, Enterobacter cloacae
IRNLSMKRASLITLLLLGSLSAVNSARAVDYPLPPAGSRLIGQNQTYTIQEGDNKLQSIARRFNTAAQLILETNNTIAPVNPAPGTVITIPSQMLLPDTEREGIVVNLAELRLYFYPPGENIVQVYPLGIGQLGLETPVSTTRVSQKIPNHTWTPTAGIRARSLAQGIKLPHVVPAGPNNPLGRFALRLGIGNGEYSADGPK

SEQ ID NO: 7171 - protein, 164 aa, Enterobacter cloacae
EEGSMANDWLELRQHAETGIETIKAHFEGHAFDPHWHDSYLVGITLSGTQQFHCRRERHRSQPGDAFLLEPGEIHDGDAPVEGGFTYLTFYLDEHWLTHTLQGLYDSTPGSYTLHFAQTLTREPQLVRAIGDTFASLHNDEMKIVQQSTMDNLLSQITTHCHWR

SEQ ID NO: 7172 - protein, 329 aa, Enterobacter cloacae
  UNSURE (31)
  UNSURE (42)
KLTSQLQSSAVAHRARDYLYAHIGENVGLSXLARETGTDRFXLTRCFKREFTWARTPGLSSCDWQRPDRCWRVGNCLLMLRRQWVLPIKAILVAGSSVHTVFLRHTTAGCAQTFQTFPENNGTFVALIKKESPVNLLPFLLFAFVASITPGPTNILVLANSQHFGVKNTVPAILGGCIAASAIVLVSGAGAGEVLRQYPLIRQVMSWAGVLWLSWMSWQLFSAPAANLSSSSHVRFTARAAALLQVVNPKTWMMALAVVSLFAPASDHALRDITLMALWFLAISVVCLLCWAWLGKAVNRIFRTTVAMVRFQRAMALCLFISAWMGMLA

SEQ ID NO: 7173 - protein, 269 aa, Enterobacter cloacae
GSFNQVFRRHNRQVGHFSQLLYRQLLIAIWRVQACTDGGCAQVHFQQQFGRTQQVFRLFVQQHVKRVEFLSEGHWHRVLQLGTAHFQNVLELNGFTLEAIAQLINRVDQFNDRGIHRDAEAGWVGVVGGLTFVNVVVRVQVLVFTFLMTHQLQADVCQHFVGVHVDRGARAALIDVDRELIHAFAVVQHLIARGDNRICSAFRNGLQLFVCQSRGFFYHHHATHKFRDVADFAVADVEVFNRSQSVNTIVGIRWNFPGTQQIFFDTNVV

SEQ ID NO: 7174 - protein, 178 aa, Enterobacter cloacae
KRSGAKTRYPKGYYQNSFKMSEECQRNLARRNAQHFSFGHLFSIRFTRGQLLSSLLKTRNNMRIKVCAGIVGAALLLAGCSTSNELTAAGQSVRFVEDKPGSECQLLGTATGEQSNWMSGQHGEEGGSMRGAANALRNQAAAMGGNVIYGVSSPTQGMLSSFVPTASQMNGQVYKCPN

SEQ ID NO: 7175 - protein, 280 aa, Enterobacter cloacae
EVSVCFNNGSSGLPFSIRATNARGTRRAKRRFASRPARNASCCSRSKRRSNSSGLVITSASCDNQSSLDGVFRVTICAILWLSYQLTNLEGLMATYYSNDFRAGLKIMMDGEPYAVEASEFVKPGKGQAFARVKLRRLLTGTRVEKTFKSTDSAEGADVVDMNLTYLYNDGEFWHFMNNETFEQLSADAKAIGDNAKWLLDQAECIVTLWNGQPIAVTPPNFVELEIVETDPGLKGDTAGTGGKPATLSTGAVVKVPLFVQIGEVIKVDTRSGEYVSRVK

SEQ ID NO: 7176 - protein, 406 aa, Enterobacter cloacae
AGVIHLNCGQQGWVGWQHEQGGNRCKRGNRRQRRHAQHQCRRHQRFGGRSLGVQQRRGKEQHYCQQPRIVVQQVACNGLDIADVRFHKGITEPRHAQHAHAGAHTGFEGAGVQHFAGVDFTGDADQRRDGQHKHHNGFVTRQNRVLDQTYRVADGGRVEHHGDDTNQKQQHGAFCMRLQLEDLATAQAHFTFCQTLLVNRIVFQLGTEEVTQHGSDHYRNQRDRNTDCQQRQVTYAHWLKDAREEDHRRGNRRGGNRNLGGDHGNRKRARRANTLLFRHFGDDRQRGEGSMASTGENGHKPGHQRGKEGDVFRMATQHTLRQAHQVVHTASDLHGRDSSNNRHDDFDNVKRDCAGFNLKDQGKYKHSETASKTDADSPESCAQINRQQDDDEFCSKHKDLPCSLTS

SEQ ID NO: 7177 - protein, 184 aa, Enterobacter cloacae
NLANRRHLLSTRFANTFSQGQKAPAIQEMPVRWIPFIAFFLYVYIEISIFIQVAHVLGVLLTLILVIFTSVIGMSLVRNQGFKNFLLMQQKMAAGESPAAEMIKSVSLIIAGLLLILPGFFTDFLGLLLLLPPVQKHLTMKLLPHLRFSRMPGGGFSTGPGDTFEGEYQRKDEQRDRLDHKDDR

SEQ ID NO: 7178 - protein, 129 aa, Enterobacter cloacae
KAIPISQGTSRKTACGPASSITDNDFLKGELSMSIRPLHDRVIVKRKEVETKSAGGIVLTGSAAAKSTRGEIIAVGKGRILENGTVQPLDVKVGDIVIFNDGYGVKSEKIDNEEVLIMSESDILAIVEA

SEQ ID NO: 7179 - protein, 72 aa, Enterobacter cloacae
TRIHLGTHAWLIQLRLAKARQMLACGELPVDVATAVGFADQSHLGRWFQRAYRISPAHYRRLCTNLPDVSRK

SEQ ID NO: 7180 - protein, 552 aa, Enterobacter cloacae
  UNSURE (381)
GNKNMAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVASAVEELKALSVPCSDSKAIAQVGTISANSDETVGKLIAEAMDKVGKEGVITVEDGTGLEDELDVVEGMQFDRGYLSPYFINKPETGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVGQIRKQIEEATSDYDREKLQERVAKLAGGVXVIKVGAATEVEMKEKKARVDDALHATRAAVEEGVVAGGGVALVRVAAKLAGLTAQNEDQNVGIKVALRAMEAPLRQIVSNAGEEPSVVANKVKAGEGNYGYNAATEEYGNMIDFGILDPTKVTRSALQYAASVAGLMITTECMVTDLPKGDAPDLGAAGGMGGMGGMGGMM

SEQ ID NO: 7181 - protein, 110 aa, Enterobacter cloacae
VKEPDMSWIVLVIAGLLEVVWAIGLKYTHGFTRLTPSVITIAAMIVSIVMLSWAMRSLPVGTAYAVWTGIGAVGAAITGILLLGESASLARIASLALIVAGIIGLKLSTH

SEQ ID NO: 7182 - protein, 415 aa, Enterobacter cloacae
MSGLRQELGLAQGIGLLSTSLLGTGVFAVPALAALVAGNNSLWAWPVLIVLVFPVAIVFAILGRHFPSAGGVTHFVGMAFGPRMERVTGWLFLSVIPVGLPAALHIATGFGQALFGWHDEQLLLAEIGTLAIVWWVGSRGASSSANLQTLVAVLIVALIVAIWFAGDITVADIPFPAINDIDHAQLFAALSVMFWCFVGLEAFAHLASEFKQPERDFPRALMIGLLLAGTVYWACTVLVLHFNAFSEEKAAAASLPGIVVQLFGVKALWVACVIGYLACFASLNIYIQNFARLVWSQALYKPDSPLSRLSKRQLPVNALNTVLGCCVVNSLAIYLLDINLDALIVYANGIFIMIYLLCMLAGCRLLKGRFKALAAVGCVLCLMLLAMVGWKSVYAIVMLAGLWVFLPKRQAPQAR

SEQ ID NO: 7183 - protein, 505 aa, Enterobacter cloacae
SSVIKYSKPHIYCVFSTIHRQLEKKVHMLNNIRIEEDLLGTREVPADAYYGVHTLRAIENFYISNSKISDIPEFVRGMVMVKKAAALANKELQTIPKSAANAIIAACDEVLNNGKCMDQFPVDVYQGGAGTSVNMNTNEVLANIGLELMGHQKGEYQYLNPNDHVNKCQSTNDAYPTGFRIAVYASVVKLVDAINQLGDGFQRKAVEFQDILKMGRTQLQDAVPMTLGQEFHAFNVLLNEETKNLLRTSELLLEVNLGATAIGTRLNTPDGYQQLAVQKLAEVSNLPVVPAEDLIEATSDCGAYVMVHSALKRLAVKLSKICNDLRLLSSGPRAGLNEINLPELQAGSSIMPAKVNPVVPEVVNQVCFKVIGNDTTVTMASEAGQLQLNVMEPVIGQAMFESIHILTNACYNLLEKCINGITANKEVCEGYVYNSIGIVTYLNPFIGHHNGDIVGKICAETGKSVREVVLERGLLTEAELDDIFSAQNLMHPAYKAKRYTDESEQ

SEQ ID NO: 7184 - protein, 573 aa, Enterobacter cloacae
RLSLMAQRFITLILLLCSTSVFAGLFDAPGRSNFIPADQAFVFDFQQNQHDLSLTWQVKEGYYLYRKQVSITPTKANVGALQMPAGVWHEDEFYGKSEIYRQRLSVPVTVNHADKGATLTVTYQGCADAGFCYPPETKVVPLSEVKGAASPLPSGERARMKGEGAGEATSDLPFSALWALLIGIGIAFTPCVLPMYPLISGIVLGGKQRLSTARALLLAFIYVQGMALTYTALGLVVAAAGLQFQAALQHPYVLIGLSAVFILLALSMFGLFTLQLPSSLQTRLTLMSNRQQGGSAGGVFAMGAIAGLICSPCTTAPLSAILLYIAQSGNLWLGGGTLYLYALGMGLPLILVTVFGNRLLPKSGPWMETVKTAFGFVILALPVFLLERIIGDVWGTRLWAMLGVAFFSWAFIVSLGAKKPWMRLLQILLLAAALVSVRPLQDWAFGTPAGQTQAHLNFIQIKNVDDLNHALAQAKGKPVMLDLYADWCVACKEFEKYTFSDPQVQHALSDTVLLQANVTANSTQDKALLKQLKVLGLPTILFFNEQGEEQPTQRVTGFMDATAFNAHLRNRQP

SEQ ID NO: 7185 - protein, 346 aa, Enterobacter cloacae
LSHKMAHIVTLNTPSREDWLSQLADVITSPDELLRLLDLEQHEALRAGREAKRLFALRVPRAFVARMEKGNPDDPLLKQTLTSQDEFITAPGYSTDPLQEQNSVVPGLLHKYRNRALLLVKGGCAVNCRYCFRRHFPYAENQGNKRNWQVALDYITAHPELDEIIFSGGDPLMAKDHELDWLLTQLETIPHIKRLRIHSRLPIVIPARITDALVTRLEQSRLQVLLVNHINHANEIDADFREAMARMRKAGVTLLNQSVLLRGVNDSARVLADLSNALFDAGVMPYYLHVLDRVQGAAHFMVTDEEARKIMRELLTLVSGYMVPKLAREIGGEPSKTPLDLQLRQQ

SEQ ID NO: 7186 - protein, 208 aa, Enterobacter cloacae
RHYYQLFFFRRCTLYLYYRPGNHAACRHSGVQICWRELSATVDRPHGSSLRSGGKMIAQSRKNIMDLFIDGARRGFTIATTSLLPNVVMAFVIIQALKVTGLLDIVGRVCEPIMALWGLPGAAATVLLASVMSMGGGVGVCASLVAAGTLNGHDATILLPAIYLMGNPVQNTGRCLGTAGVNPKYYPHIIAVCVINALLSMWVMQLLF

SEQ ID NO: 7187 - protein, 557 aa, Enterobacter cloacae
VRRVAFRQVGHHALGRDHQASYRCRVLQSRTGHFSWIQDTEVDHVAVFFSCRVVTVVTFTRFHLVRNHRRLFTGVGHDLTQRSFHCAQRNFDTHVLVFVLSSQASQFSGYTHQRDTTTSNHAFFYRSTGRVQGVVNACFLLFHFNFGSRTDFDYRYATCQFRYALLEFFTVVIGSCFFDLLTDLTNTALNSGFFTHTVDDGGGVFVDHNAFRLAQVFQSRFFQLHTDLFGDHGTAGQGSDILEHRLTTIAETRCFNRCHFHDATHGVNHQGRQRFAFNVFSNDYQRLACFRDSFQHWQHFADVGDFLVSQQDERAFQLNSASFWLVDEVWGQVTAVELHTFNHVQFVFQTSTVFNGDHAFFTDFIHRFSDQFTYGFVGVSGDSTNLSNGFRVRARYGQRFQFFNSGSDGFVDTTFQIHWVHARSNGFQAFGDDRLRQYGRGGGTVTGSVVRFRGNFFHHLCAHVFELVFQLDFTCNRNTIFGDGWRAEGFVQHYVTAFRAESDFHCVCQYVYAAEHFYTSVVTEFYVFSCHVLISSNSYSFRALITLQQLPECRSRT

SEQ ID NO: 7188 - protein, 111 aa, Enterobacter cloacae
GGRLVNTPDAVVVLCTAPDEASAQDLAAKVLAEKLAACVTLLPGATSLYYWEGKLEQEYEVQMLLKTNLTNQQALLDCLKSHHPYQTPELLVLPVVHGDNDYLSWLNASLR

SEQ ID NO: 7189 - protein, 226 aa, Enterobacter cloacae
PGLWTRRHSTRICAIANRKPHFRRDKPLGIAEEITVQREDVLGQALQLLEIQGIASTTLEMVADRIDYPLDELRRFWPDKEALLYDALRYLSQQVDIWRRQLMLNEELTTEQKLLARYTALTECVTNNRYPGCLFIAACTYYPDPGHPIHQLADQQKRAAHEFTHELLTTLEVDDPAMVAKQMELVLEGCLSRMLVNRSQADVDTAHRLAEDILRFAQCRMGGALT

SEQ ID NO: 7190 - protein, 321 aa, Enterobacter cloacae
EREEEKKKRGKRGKKKEGGKKREKGGKKKERKEGKGEEGEGGKGGGKRGRRGGKKGEKKKEKEGKREEKGREKKGRGKEGEEGKGGEGGKKKKEKKGRKKKKKKKKKKKKKKKKKKKKTRQNTLHNLPHFPCCHLHLTKNSKETPMRILPVIAAVTAAFLVVACSSPTPPPGVTVVSNFDAQRFLGTWYEIARMDHQFERGLEKVTVNYSAMDDGGIRVINRGYNPDRQMWQQSVGQAYFTGASNRAAMKVSFIGPFYGGYNVIALDREYRHALVCGPDRNYLWILSRTPTIPAEMKQQMLDIATRQGFDVTKLLWVKQPH

SEQ ID NO: 7191 - protein, 212 aa, Enterobacter cloacae
WQEAKPLADCENFMFKILLIDRCHFTRTGFEAWVNHSDLFSGHFVVTGVNNLFLAREHILQWKPALVIADLSGFRQDLHHFQQLSSLLIASETLPFIMLQSGQEQEMTDYLAQFPIWSSLSKNTDLEKLAAVINDALTSCASAELPEMAAPLLTRQEERVLSLWMDGASNQKIASNLRINGKTVYTYKRNIRMKLHMDTRYSPFLSLQEVEN

SEQ ID NO: 7192 - protein, 236 aa, Enterobacter cloacae
PPIVFSDATYNFCTRLKKGGFMSASSSGEEKVTWVGYLAFVLTIVFFSGFFAKSTEWWRVLDFTVLNGSFGPVNGALTFRGEGGTGAKDGFLFALELAPSVILSLGIIAVTEGLGGLRAAQQLMTPILRPLLGVPGICSLALIANLQNTDAAAGMTKELTNEGAITDHERAIFATFQTSGSAIITNYFSSGAALFTFITVPVITPLAVILVFKFVGANFLRLWIAHMEVRCAQEEK

SEQ ID NO: 7193 - protein, 396 aa, Enterobacter cloacae
CNYSSEEIKMDFSVLEPHLFRNAQLYAPEDLGHCDLLIAGGKIVAVEKAGHATMRPDCPESDLAGAVVCPGFIDQHVHLIGGGGEAGPHTRTPEVRLSALVAAGITSVVGLLGTDGVTRHPESLLAKTRALEHEGISAWMLTGAYGLPSPTITGSIEKDVALIDKIIGVKCAISDHRSSAPADDQLANMAAQSRVGGLLGAKAGISVFHLGNSPKLLEPLLNILNNADVPRTKLLPTHVNRAQALFHAALDYAREGGYIDITTSISEPIDAATAIATARDAQVPFNRLTLCSDGNGSQPNFDANGNLVGIGVAGFESLLDTLQQLVGRYHLPLEEALLPFTRNVAEFLGLEHKGRIAPGCDADFLVLTDDLKIREVWAKGRQMVREGVVCVKGTFE

SEQ ID NO: 7194 - protein, 157 aa, Enterobacter cloacae
AMALESEHGTDSAFSSSTAEATALSIPRFRSIGFMPAATAFRPSVMIACASTVAVVVPSPAASFALEATSFTICAPMFSNLSSSSISRATETPSLVMVGAPKDLSSTTLRPFGPRVTFTASASTFTPRSIFTRASLPNFTSLAAMFLFPQIRTVFVR

SEQ ID NO: 7195 - protein, 438 aa, Enterobacter cloacae
ARQVFMFGAELVIVLLAIYLGARLGGIGIGFAGGLGVLVLTLIFQIKPGAIPFDVIEIIMAVIAAIAAMQVAGGMDYLVSLAERMLRRHPKYITFLAPLVTWFMTILAGTGHTAFSTLPVITEVAKEQGIRPSRPLSIAVVASQIAITASPISAAVVFFAGILEPMGVSYLTLLAICIPVTLIAVMITAVLCNFLGAELKDDPVYQERLAKGEVSLRGSQVFELKPHAKRSVLLFLIGIVAVMFYATAISDTVGLIQNPVLPRNEAIVVFMLTIATLISITCKIDTSEVLNASTFKSGMSACVCVLGVAWLGDTFVKAHISDIQTVAGDLLHNYPWLLAVVLFFAATLLYSQAATTKALMPAALMLGVTPLTAIASFAAVSALFVLPTYPTLLAAVEMDDTGSTRIGKYVFNHAFLIPGVVAITLCVILGFIIGGIVL

SEQ ID NO: 7196 - protein, 577 aa, Enterobacter cloacae
RHVAGRKSDGRDRAASASGCRPVAKMPGRVRTTHNRKTVRVSDPAGRDTVTFKIKKHNTTTQQQSRGTPMSMSSIPSHSPSGKLYGWVERIGNKVPHPFLLFIYLIVILMVATAVLSAFEVSVRSPADGSMVAVKNLLSVEGLHWFLPNVIKNFSGFAPLGAILALVLGAGLAERVGLLPALMVKMASHVSARYASYMVLFIAFFSHISSDAALVIMPPMGALIFLAVGRHPVAGLLSAIAGVGCGFTANLLIVTTDVLLSGISTEAASTIDATMHVSVIDNWYFMASSVIVLTIVGGLITDKIIEPRLGKWEGRSDEKLETLSKEQQFGLRVAGIVSLAFIAVVALMVVPENGVLRDPIKHTVLPSPFIQGIVPLIILFFFVVSLAYGIATGKIRRQGDLPHLMIEPMKEMAGFIVMVFPLAQFVAMFNWSNMGKFMAVSLTDALEAAGLSGVPAFVGLALLSSLLCMFIASGSAIWSILAPIFVPMFMMLGFHPAFAQILFRVADSSVIPLAPVSPFVPLFLGFLQRYRPEAKLGTYYSLVLPYPLIFLGVWLVMLVAWYLVGLPIGPGVYPRLN

SEQ ID NO: 7197 - protein, 174 aa, Enterobacter cloacae
GVLMLRLLEDKIATPLGPLWVIADEAFNLRAVEWEEHSDRMVELLNIHYRAEGYERVTARNPGGLSDKLTAYFEGDLSIINTLPTATAGTPFQREVWQALRNIPCGQVMHYGQLAEQLGRAGAARAVGAANGSNPVSIVVPCHRVIGRNGTLTGYAGGVQRKEWLLRHEGYFLL

SEQ ID NO: 7198 - protein, 255 aa, Enterobacter cloacae
GLSKPMIPEKRIIRRIQSGGCAIHCQDCSISQLCIPFTLNEHELDQLDNIIERKKPIQKGQTLFKAGDELKSLYAIRSGTIKSYTITEQGDEQITGFHLAGDLVGFDAIGSGHHPSFAQALETSMVCEIPFETLDDLSGKMPNLRQQMMRLMSGEIKGDQDMILLLSKKNAEERLAAFIYNLSRRFAERGFSPREFRLTMTRGDIGNYLGLTVETISRLLGRFQKSGMLAVKGKYITIENGEALAILAGHSRNVA

SEQ ID NO: 7199 - protein, 489 aa, Enterobacter cloacae
FPVDARCVMQENYAFIADAIDTRCQTFTDIADDIWDHPETRFEEFWSAERLASALEAEGFTLTREAGGIPNAFIASYGSGKPVIALLGEYDALAGLSQQAHCATAQSATPGANGHGCGHNLLGTAAFAGAVAVKSWLEQHGGSGTVRFYGCPGEEGGSGKTFMVREGLFDDVDAGVTWHPEAFAGMFNVSTLANIQAAWRFKGIAAHAANSPHLGRSALDAVTLMTTGTNFLNEHIIEKARVHYAITDTGGISPNVVQAQAEVLYLIRAPEMADAQQIYARIEKIAQGAAMMTETTVECRFDKACSSYLPNRTLEAAMYRALQHYGTPAWTEEEREFARKIRATLTANDLQNSLKNIAATGAEEGKAFARRHQETLLVDEVAPYAITDNVLAGSTDVGDVSWKMPVAQCFSPCFTVGTPLHTWQLVAQGRTSIAHKGMLLAGKVMGATALHLLQDADLLRKCREEFEQHITEKPYECPIPQGVTPSPLK

SEQ ID NO: 7200 - protein, 572 aa, Enterobacter cloacae
IRYDDSIDVTLPLLLRMTAMLKNLHVITGIIFALTIFCLLQVVTGGLFYSAVNNDRHNFQNSGLLNAQQESLSDSVNTLVKTRVTVTRVAIRYLKNQRDPASLAAINTLLGTANGSLAKAEDYYKNWQAIPQVKGQHAALTEEMQKAWKQMHEVMRLSIEYLRADNYQAYGDLDAQQAQDEMEAVYTRWRAENNVLLKAAAEENQSSFTQMQWTLAAIFLTVIAVLVVIWQGLQHLLLKPLNAIMNHIRTIASGDLTQNVAIAGRNEMGQLAAGLHEMQQSLVSTVSAVRGSTDSIYTGAGEIAAGSNDLSARTEQQAASLEETAASMEELTATVKQNSDNARQATLLAKNASETAARGGQVVDNVVRTMNDIADSSQQIAHITGVIDSIAFQTNILALNAAVEAARAGEQGRGFAVVAGEVRTLASRSAQAAKEIKGLIENSVSRVNTGSEQVSEAGATMKEIVAAVTRVTDIMAEISSASDEQSRGIEQVSLAVSQMDSVTQQNAALVQESATAAAALEDQSEQLRQAVAAFRLNAQASPAARPKNVKTPVLLRPSAAGANTADANWETF

SEQ ID NO: 7201 - protein, 448 aa, Enterobacter cloacae
SSSHILMMTGKDMNALAQYIQTLAPQLSAWRRDFHHFAESGWVEFRTAAKVAEILASLGYELAMGRDVVDAESRMGLPDDATLSREFARARAQGAPEKWLAPFEGGFTGIVATLNTGRPGPTLAFRVDMDALDLSEALDDSHRPFRDGFASCNPGMMHACGHDGHTTIGLGLAQVLKQHEAQLNGTIKLIFQPAEEGTRGARAMVAAGALDGVDYFTAIHIGTGVPEGTVICGSDNFMATTKFDVRFTGVAAHAGGKPEEGRNALLAAAQAAIALHGIAPHSEGASRVNVGVMQAGSGRNVVPADALLKVETRGESEAINQYVFERAQAVITGAAALYGVTTGINLMGAATSSVPSPAWVDYLREQASQVPGVTHAINKVKAPAGSEDATLMMARVQQNGGMASYMVFGTQLSAGHHNEKFDFDEQVMNVAIETLARTALNFPWTRGV

SEQ ID NO: 7202 - protein, 332 aa, Enterobacter cloacae
VTLLLTDCGDSSKETCMAKYQNMLVAIDPNQDDQPALRRAVYLHQRIGGKIKAFLPIYDFSYEMTTLLSPDERTAMRQGVISQRTAWIREQAKYYLEAGVPIDIKVVWHNRPFEAIIQEVVAGGHDLLLKMAHQHDKLESVIFTPTDWHLLRKCPCPVWMVKDQPWPEGGKAVVAVNLASEEDYHNSLNEKLVKETLQLADQVNHTEVHLVGAYPVTPINIAIELPEFDPSVYNDAIRGQHLLAMKALRQKFSIDENMTHVEKGLPEEVIPDLAEHLQAGIVVLGTIGRTGISAAFLGNTAEQVIDHLRCDLLVIKPDQYQTPVELDDEEDD

SEQ ID NO: 7203 - protein, 431 aa, Enterobacter cloacae
KRNHLGIAGLAIALIATIFGPDPGNVAWILVAMIIGGAIGIRLAKRVEMTEMPELVAILHSFVGLAAVLVGFNSYLYHEPGLEPILVNIHLTEVFLGIFIGAVTFTGSIVAFGKLRGKISSKPLMLPNRHKLNLAALVVSFVLLVVFVRTESVGLQVLALLVMTIIALAFGWHLVASIGGADMPVVVSMLNSYSGWAAAAAGFMLSNDLLIVTGALVGSSGAILSYIMCKAMNRSFISVIAGGFGSDGSSTGSDEEVGEHREISAEDTAEMLKNSHSVIITPGYGMAVAQAQYPVAEITEKLRARGIKVRFGIHPVAGRLPGHMNVLLAEAKVPYDIVLEMDEINDDFADTDTVLVIGANDTVNPAAQDDPRSPIAGMPVLEVWKAQNVIVFKRSMNTGYAGVQNPLFFKDNTHMLFGDAKASVDAILKAL

SEQ ID NO: 7204 - protein, 298 aa, Enterobacter cloacae
IRIIFMRKVSMSSIDKSGTFTLGTRTVKRFGYGAMQLAGPGVFGPPKDKNAALAVLREAVASGVNHIDTSDFYGPHVTNQLICEALHPYRDDLTIVTKIGARRGEDASWLPAFSAQELTQAVHDNLRNLKRDVLDVVNLRIMFSAHGPAEGSIAAPLSTLAELQQQGLVRHIGLSNVTASQVAEAQKMVSVVCVQNMYNVVNRGDDVLVDSLAQQGIAWVPFFPLGGFTPLQSSGLQAVADSLGATPMQVALAWLLQRSPNILLIPGTSSVAHLRENLAAVDLVLPPEALETLNSLVG

SEQ ID NO: 7205 - protein, 409 aa, Enterobacter cloacae
KRCNFAHPDKPPPGAVFLFLRPAFLLCLYFTLCVIRGGVMRFLSRFDIIELMMTPSFWIGVATVVFVTLLVYWLLTRLIAFVKKGITTWGDKHPSTNRMRFILTDMLNRTSRVLLFVVALLFSLRFVDLPDHLFGTVSHAWFLVFAIQVALWMDQGVVSWLRHVMLAPGSHKNPVTLVITGLILRAIVWSVMLLSILANAGVNITALVASLGVGGIAIALAVQTILSDVFASLSIGFDKPFEIGDFVVFNDVAGTVEHIGLKTTRIRSLSGEQIVCGNAILLQQTLHNYKRMQTRRIVFTFGVASDTAPEKLRSVGEMVKQIITDVGETKFDRAHFLGFDRDRLTFEVVHIVNTADYNKYMDIQQEINIRILEELNQQEIKLALPSMVLHAPWMNAGDEASAQRLSEAQ

SEQ ID NO: 7206 - protein, 308 aa, Enterobacter cloacae
TTVIGLVMSFQIKFHQIRAFVEVARQGSIRGASRTLNLSQPALTKSIKELEEGMAAQLFVRRSKGVALTECGEGFYHRANLILEELRAAQDDIRQRQGELAGQINIGMGASISRSLMPAVITRFHAQHPQVNVRIMEGQLVSMINELRQGELDFTINTYYQGPYDHEFTFEKLFEKPFAVFCRAGHPATGATSINELLQYNWTMPTPRGSYYKQLQDTFNHRSQIPRIGVVCETFSSCISLVAQSDFISILPQELGCDPLLAHRLIMLPVVETLPKAAYYLIQRRDSRQTPLAESLITQFRREARKLI

SEQ ID NO: 7207 - protein, 216 aa, Enterobacter cloacae
AIICTRARMIETRNGRRYSTSLRCSRRISMNPDDKSLFLDAMEDVQPLKRCADIHWQQSRNTRARQEIDTEQLDNFLTLGFLELLPLDEPLMFQREGVQQGVFDKLRSGKYSRQASLTLLRQPAEQCRQLVYSFIRQAGRDGLRNLIIVHGKGREQQSHPNVVRSYLARWLTEFDEVQAFCEAQPHHGGSGACYVSLRKSEDAKRDNWERHAKRSR

SEQ ID NO: 7208 - protein, 469 aa, Enterobacter cloacae
IMTLTSRWPAVLQAVMQGQPRALADSHYPQWHPAPVTGLMNDPNGFIWFAGRYHLFYQWNPLGCNHRYKCWGHWSSADLVHWQHEPMALMPDEEYDRNGCYSGSAVDNNGVLTLCYTGNVKFDDGGRTAWQCLAVQNDDGTFAKLGPVLPLPDGYTGHVRDPKVWRHDGLWYMVLGAQDRHKRGKVLLFTSADLHTWASCGEIAGHGVNGLTDAGYMWECPDLFELDGTHVLIYCPQGLAREPHRYLNTYPAVWMSGAFDYQTPAFTHGELHELDAGFEFYAPQTTVAEDGRRILIGWMGVPDGEEMLQPTRAHGWIHQMTCPRELRYRDGKLWQTPVRELETLREDEHHWQGRASDAPVLAGARLEFELSASCVNVDFAGALRLIVDDAGIRLERASLKTADTLTRYWQGTVHHLRVLCDRSSVEIFINHGEGVMSSRYFPDHPAQVRFEGASDITLRYWSLRSCMIE

SEQ ID NO: 7209 - protein, 533 aa, Enterobacter cloacae
RLDSADNQREIISLRCVMSLKKSSLIILFSLLFFFVASTITSVGLIIKSNTSLDNVNKEIQVVLSIIDPINHSRTLRVRVMEYVKMVEAGDATDPSAKLASVKEALTKADSAFSAFMASPRLQEEAPLVTAYQEAWQNYRNQGLAPLIAAAAAHDVSRFNALIPVVSQLDRQYEIVLDQVLSVHQKYAKTLNEEASHDFVSGLVIIASIAVLFVVVIFAVSLLMKRVVFAPVNLAREHCRQIAAGKLDVPVPIKRDSGNEIDHLMSSMEQMRQALLSTISQVRDASQTVTHAAQEIASGNIDLASRTEQQASALTQTAASMEELSATVANNTDNVFQAGKLVQDAVKNAHTGEAVTREVIETMSTIASNSKRIEDITSVINSIAFQTNILALNAAVEAARAGAQGRGFAVVASEVRTLAQKSAVAAKDIESLIAQSVSSVKNGAELVNRSGEVIDSIISSVNKVHMLMEQISVASEEQSRGIGQVGQAVTEMDGVTQQNAALVQQSAAAAASLEEQAQQLSQSISRFSLPATA

SEQ ID NO: 7210 - protein, 290 aa, Enterobacter cloacae
ERVSFQPRGEDLAGTGGGVYDVKWNDTLRSNFSLYGRNFGSEEEIDNNVQNYILSMNHFAGPVQMMVSGLRAKDNDDRKDSNGDPIKTDAANNGVHALVGLHNESFYGLREGSAKTALLYGHGLGAEVKSIGSDGALLSEADTWRFASYGVTPLGGGWHIAPAVLAQSSKDRYVKGDSYEWVTLNTRLIKEVTQNFALAFEGSYQYMDLSPEGYKDRNAVNGSFYKLTFAPTLKAGKIGDFFSRPELRLFATWMDWSNKLDNYASDDAFGSTGFNAGGEWNFGVQMETWF

SEQ ID NO: 7211 - protein, 478 aa, Enterobacter cloacae
PFTLPHRGGVSNTIKRGQEEVSMDFNHIARELIPLLGGKENIASAAHCATRLRLVLVDDALADQQAIGKVEGVKGCFRNAGQMQVIFGTGVVNKVYAAFIQAAGISESSKSEAADIAARKLNPFQRIARLLSNIFVPIIPAIVASGLLMGLLGMVKTYGWVNPDNALYIMLDMCSSAAFIILPILIGFTAAREFGGNPYLGATLGGILTHPALTNAWGVASGFHTMNFFGLEIAMIGYQGTVFPVLLAVWFMSIVEKQLRRAIPDALDLILTPFLTVIISGFIALLIIGPAGRALGDGISFILSTLIAHAGWLAGLLFGGLYSVIVITGIHHSFHAIEAGLLGNPSIGVNFLLPIWAMANVAQGGACLAVWFKTRDAKIKAITLPSAFSAMLGITEAAIFGINLRFVKPFIAALIGGAAGGAWVVSVHVYMTAVGLTAIPGMAIVQASSLLNYIIGMVIAFGVAFTVSLLLKYKTDSE

SEQ ID NO: 7212 - protein, 340 aa, Enterobacter cloacae
VVVRKTKRVTIKDIAELAGVSKATASLVLNGRSKELRVAEETRERVLAIAKEHHYQPSIHARSLRDNRSHTIGLVVPEITNYGFAVFSHELETLCREAGVQLLISCSDENPGQETVVVNNMVARQVDGLIVASSMLNDADYQKLSEQLPVVLFDRHMNDSTLPLVLTDSITPTATLVADIARKHPDEFYFLGGQPRLSPTRDRLEGFKQGLRDAGVELRPEWIIHGNYHPSSGYEMFAELCARLGRPPKALFTAACGLLEGVLRYMGQHNLLQSDMRLASFDDHYLYDSLTIPVDTVRQDNRQLAWHCFDLIGKLIEGETPEPIQRKLDATLQRRYKAVE

SEQ ID NO: 7213 - protein, 278 aa, Enterobacter cloacae
SVDRAINFDHSEKQYLRGVVMLQRLAKKKVLLLSALMVSGLVRAEESLPDVVKHFSEQQDIKIIKKIDAPGGAPAWLGQYQDMGVTLFLTPDGKHVVSGYLYDEKGTNLSEAFFQKEIYAPMGREMWKKLNAAHPLKEGAESAPRKVFVFADPFCPYCKQFWAEAQPWVKAGKVQLNTLLVAFLNPNSGRNASAILNAKDPVSAWKAYELSGGKKLPKPEGAASRETVEILQNHQTLMDSLGANATPAIYYLNEQNELQQVVGMPDAKQLEAMFGPKP

SEQ ID NO: 7214 - protein, 196 aa, Enterobacter cloacae
RCESAGSRVSDMKAGEAGESLLISALNACRRRLKAFIRGRTAVRDDVDDILQEVTWQLMKVEQPVENVAAWLFRAARNEMIDRARKKHEVSLPGYLTADDEDFPEQEIAETLFGVPQTPEEEYLNMLLWEELGQALSELPPPQREVFEKTEFEGYSMKVLAEETGDSVQALLSRKHKAVRFLRSRLKDIYEALTGQ

SEQ ID NO: 7215 - protein, 297 aa, Enterobacter cloacae
RHGMQFRLMRNFIVVAEELHMHRAAERLNMAQPALSQQIKTLEDRLGVMLFSRANRRLTLTPAGEAFLSKARVAILMTDQAILDARQTARGEQGVLNLGCVSSAIFDSKLPAALRLLHEKWPAISLSMMTGNVQTLYTGVQSNQLDVAIIRAPLPLLPDDLQSRPFTTEKAVLALPRQHSLAGSAALTLASVKEEKWIALRDPEGMGLEQYFYDACHSAGIQPDVVQNATDVPTVISLVSAGFGIAMLPASAKAICVQNVVFVDILDRLRESELTLVCHRIIRSEVLKKLMSILDHT

SEQ ID NO: 7216 - protein, 515 aa, Enterobacter cloacae
MMQLIALFVRLRMDAFIRGGKNMENHINDLRSAIELLKRHEGQYLETSHPVDPDAELAGVYRHIGAGGTVKRPTRIGPAMMFNAIKGYPDSRILVGMHASRERAALLLGCDPSELAKHVGQAVKNPIAPVVVPAAQAPCQEQVFYADNPDFDLRKLLPAPTNTPIDAGPFFCLGLVLASDPEDASLTDVTIHRLCVQERDELSMFLAAGRHIEVFRKKAEEAGKPLPVTINMGLDPAIYIGACFEAPTTPFGYNELGVAGALRQTPVELVQGVAVNEKAIARAEIIIEGELLPGVRVEEDQHTHTGHAMPEFPGYCGEANPSLPVIKVKAVTMRHQAILQTLVGPGEEHTTLAGLPTEASIRNAVEEAIPGFLQNVYAHTAGGGKFLGVLQVKKRQPSDEGRQGQAALIALATYSELKNIILVDEDVDIFDSDDILWAMTTRMQGDVSITHLPGIRGHQLDPSQAPDYSPSIRGNGITCKTIFDCTVPWALKSRFERAPFMEVDPTPWAPELFKK

SEQ ID NO: 7217 - protein, 368 aa, Enterobacter cloacae
RRYRRAVKHPLRPIHSMDRSHSLPGGSQKSQLNYDELTIEEPIMFTVKKLAISTLLAGSVLFFPAIHAVASVPQHVVKQQAGGYSVQVGDTIVTAFTDGSVPQDLHALLRRTTAENTDALLAKNFQANPVEASINAFYIAIPGHKILVDTGSGQLFGPGKGGRLIESLATQGIKPEDITDILITHAHSDHAGGLVKDGQRVFTRAQVYVGKPDIDFFFNDENQKKSGYDQNYFDVAHKTLKPYLDAGKVTTFSGTEQLLPGISGTVHPGHTPGSAFYTLESKGEKMTFVGDIIHVAAVQFPQPNVTIAYDEDQDGAARVRNAAFAEFVKNKALIAAPHLPFPGIGYVTKGERDGYAWVPVTYTNRDAK

SEQ ID NO: 7218 - protein, 122 aa, Enterobacter cloacae
RHLQEGAVIINTTSVQAFKPSAILVDYAQTKACNVAFTKSLAQQLGPRGIRVNAVAPGPYWTPLQSSGGQPQSKVQKFGEDTPLGRPGQPVEIAPLYVLFASDTCSYASGQVWCSDGGTGVL

SEQ ID NO: 7219 - protein, 311 aa, Enterobacter cloacae
PIPTVTQNKMSPSDMDMDLILTLDALLRDQNITHAAARLGISQPAMSARLARLRVLFGEPLFVPSPHGRGVLPTPRAEALRPQVATVLQGISAMLEPTTFNAQNSNRTFVIALHENPALMLGAELQNQISSAAPGIRLRFALPETQLLPAQMENGDVDIYVGVNAVAHDAWVRRKLFDDEYATAQRKGHPRGTGPMDLDSYCSLSHLVVSSEGDPFAGFVDQHLAGLGHQRNVVMSTQSYAMAPAIVAGTDLLCTLPRRMLLRFTQTLDIFPPPLDLPPIVIGMYWHPKNSQDPANRWLREQLLQAAGRQV

SEQ ID NO: 7220 - protein, 477 aa, Enterobacter cloacae
SSCAAPHGRGRKLKPSTSTPFTMTVTGSRTNRRLIPGRIAGHPGANTQMMRHVKRTGALLGCALLLVSCTSKPPKSLVTPLPQAKPVQQTNEPMRGIWLATVSRLDWPPVSSVNGRSADQRIAQQQRALTDKLDKLKNLGINTVFFQVKPDSTALWASKILPWSDTLTGTIGEDPGYDPLQFMLDEAHKRGMKVHAWFNPYRVSTNTKPSTIAALNRTSSLHPSSVYVLHPEWIRTSGDRFVLDPGIPEVRDWITQVVMEVVNHYPVDGVQFDDYFYTETPGSPLNDAWTFRRYGEGFSSKADWRRHNTQQLIVQVSRAIKQAKPEVEFGVSPAGVWRNRSFDPAGSDTRGAAAYDESYADTRKWVQQGLLDYIAPQIYWPFARDAARYDVLTKWWADVVKPTHTRLYIGIAFYKVGAPSRNEPDWTVNGGIPELKKQLDLNDSLPDVKGTILFREDYLNQPQTQEAVNYLRGRWGS

SEQ ID NO: 7221 - protein, 105 aa, Enterobacter cloacae
LHGLPLHRYGHFSRHPAPAYRPGKRCRCYSPPSRSALPCWRPSGSGPKPVARYGRPGRYCRRQFPALHASRFGWHRAPEKWWRAAPGASAPSRTSGDRFHSRNHA

SEQ ID NO: 7222 - protein, 202 aa, Enterobacter cloacae
QELRKRSRIMAVQTKVVRFFMAGAVAIALSGCVTVPDAIKGTSPTPQQDLVRVMNAPELYVGQEARFGGKVVEVLNQQGKTRLEIATVPLDDGARPVLGEASRGRIYADVSGFLDPVDFRGQLVTVVGPITGSVAGKIGNTPYKFMTMQVNGYKRWRIAQQVVMPPQPIDPWMWGPHPYRYGYGGWGWYNPGPAQVQTIVTE

SEQ ID NO: 7223 - protein, 523 aa, Enterobacter cloacae
QERVMEFLMDPSIWVGLLTLVVLEIVLGIDNLVFIAILADKLPPKQRDKARLIGLSLALIMRLGLLSVISWMVTLTKPLFTVMDFTFSGRDLIMLVGGLFLLFKATTELHERLENRQHDDGHGKGYASFWVVVLQIVVLDAVFSLDAVITAVGMVNHLPVMMAAVVIAMAVMLLASKPLTRFVNQHPTVVVLCLSFLLMIGLSLVAEGFGFHIPKGYLYAAIGFSILIELFNQIARRNFIKQQSNQPLRARTADAILRLMGGRRQVNVQADNENRNPVPVPEGAFVEEERYMINGVLSLASRSLRGIMTPRGEISWVDANLSVDEIRQQLLSSPHSLFPVCRGELDEIIGVVRAKEMLVALEEGVNVEAVAAASPAIVVPETLDPINLLGVLRRARGSFVIVTNEFGVVQGLVTPLDVLEAIAGEFPDADETPEIVADGDGWLVKGTTDLHALSHTLGVENVVNDDEDIATVAGLVISVNGQIPRIGDVLELPPLQITIVEANDYRVDMVRIVKEHSAHDEEE

SEQ ID NO: 7224 - protein, 401 aa, Enterobacter cloacae
GLSFTLIAQTPVKPAFFMGANKRESDLNYQMITTNDELASLCEVTREFPAIALDTEFVRTRTYYPQLGLIQMYDGKHVSLIDPLGITDWAPMRELLLDTAVTKYLHAGSEDLEVFLNTFGIMPQPLIDTQILAAFSGRPLSWGFAAMVEEYTGLTLDKSESRTDWLARPLTARQLEYAAADVFYLLPIAGQLMKEAEASGWLSAALDECRMTQQRRQEVVDPKEAWRDITNAWQLRTRQLACLQLLADWRLRKARERDLAVNFVVREEHLWAVARYMPGSLGELDSIGLSGSEIRFHGKTLLALVEKAQQLPEDALPEPLLNLMDMPGYRKAFKDIKALVQTVAGESKLSAELLASRRQINQLLNWHWKLKPQNGLPELVAGWRGELMAERLNTLLEGYPR

SEQ ID NO: 7225 - protein, 64 aa, Enterobacter cloacae
QELTMFAGLPSLSHDQQQKAVERIQELMSQGMSSGQAISQVAEELRATHTGERIVARFEDEDEE

SEQ ID NO: 7226 - protein, 639 aa, Enterobacter cloacae
ENTVADDFSPEGQLAQAIPGFKPREPQRQMAHAVAHAIDKAQPLVVEAGTGTGKTYAYLAPALRAKKKVIISTGSKALQDQLYSRDLPTVAKALKYKGRLALLKGRSNYLCLERLEQQALAGGDLPVQTLSDVIVLRAWANQTEEGDISTCASVPEDSPAWPLVTSTNDNCLGSDCPLYKDCFVVKARKTAMDADVVVVNHHLFLADMVVKDSGFGELIPEAEVMIFDEAHQLPDIASQYFGQSLSSRQLQDLAKDITIAYRTELKDTQQLQKCADRLAQCAQDFRLQLGEPGYRGNLRELLADKNIQRALLLLDDALELCYDVAKLSLGRSALLDAAFERATLYRGRLKRLKEINQPGYSYWYECTSRHFTLALTPLTVADKFKEVMAQKPGTWVFTSATLSVNDDLHHFTERLGIEQAESLLLPSPFDYERQALLCVPRNLPLPNQPGAARHLAAMLKPMIEANNGRCFMLCTSHAMMRDLAEQFRATMTLPVLLQGETSKGQLLQQFVSAGNALLVATSSFWEGVDVRGDTLSLVIIDKLPFTSPDDPLLKARMEDCRLRGGDPFDDVQLPDAVITLKQGVGRLIRDVTDRGVLVICDNRLVMRPYGATFLASLPPAPRTRDIKRAVRFLANPTAE

SEQ ID NO: 7227 - protein, 240 aa, Enterobacter cloacae
LTIARARRLMRILAIDTATEACSVALWNDGTIFAHFEECPREHTQRILPLVKTILTEGNTALTDLDALAYGRGPGSFTGVRIGIGIAQGLALGADLPMIGVSTLATMAQGAWRMTGATRVLAAIDARMGEVYWAEYTRDENGVWHGEETEAVLKPEAVTGRLKQLSGEWATVGTGWAAWPEMAKDTGLTLVDGNMLLPAAEDMLPIACQLFAAGKTVAVEHAEPVYLRNTVAWKKLPGRE

SEQ ID NO: 7228 - protein, 584 aa, Enterobacter cloacae
YNVNKLFIIGAVMTTNTHFRGDALKKVWLNRYPADVPAEINPDRYQSLIELFEHSVRRYADQPAFVNMGEVMTFRKLEERSRAFAAYLQEGLGLQKGDRVALMMPNLLQYPVALFGILRAGMIVVNVNPLYTPRELEHQLNDSGAAAIVIVSNFAHTLEKVVEKTQVKHVILTRMGDQLSTAKGTLVNFVVKYVKRLVPKYHLPDAISFRRALHAGYRMQYVKPEIVSEDLAFLQYTGGTTGVAKGAMLTHRNMLANLEQVNATYGPLLHPGKELVITALPLYHIFALTMNCLLFIELGGQNVLITNPRDIPGLVKELAKYPFTAMTGVNTLFNALLNNKEFQQLDFSTLHLSAGGGMPVQQAVAERWVKLTGQYLLEGYGLTECAPLVSVNPHDIDYHSGSIGLPVPSTEAKLVDDEDNEVPHGEPGELCVRGPQVMLGYWQRPDATDEIIKDGWLHTGDIAVMDDEGFLRIVDRKKDMILVSGFNVYPNEIEDVVMQHSGVLEVAAVGVPSGSSGEAVKIFVVKKDPSLTEDALITFCRRQLTGYKVPKLVEFRDELPKSNVGKILRRELRDEARAKVDNKA

SEQ ID NO: 7229 - protein, 89 aa, Enterobacter cloacae
VMALLDFFLSRKKSTANIAKERLQIIVAERRRSDAEPHYLPQLRKDILEVICKYVQIDPEMVTVQLEQKDGDISILELNVTLPEAEESR

SEQ ID NO: 7230 - protein, 321 aa, Enterobacter cloacae
QVTIAIVIGTHGWAAEQLLKTAEMLLGEQENVGWIDFVPGENAETLIEKYTAQLEKLDTSKGVLFLVDTWGGSPFNAASRIVVDKEHYEVVAGVNIPMLVETFMARDDNPGFDELVALAVETGREGVKALKAQPVEKPAPAPAAPKAVAPAKPMGPNDYMVIGLARIDDRLIHGQVATRWTKETNVQRIIVVSDEVAADTVRKTLLTQVAPPGVTAHVVDVAKMIRVYNNPKYAGERVMLLFTNPTDVERIVEGGVKITSVNIGGMAFRQGKTQVNNAISVDAKDIEAFNKLNARGIELEARKVSTDQKLKMMDLIGKVGK

SEQ ID NO: 7231 - protein, 204 aa, Enterobacter cloacae
SESYPETTGELTVKKDNLTLDDFLSRFQLLRPQVSRATLNQRQAAVLIPVVRREQPGLLLTQRSPHMRKHAGQVAFPGGAVDSTDASLIAAALREAHEEVAIPPETVEVIGVLPPVDSVTGFQVTPVVGIIPPDLQYHASVDEVSAVFEMPLEEALRLGRYHPLDIHRRGHDHRVWLSWYQHYFVWGMTAGIIRELALQIGLKP

SEQ ID NO: 7232 - protein, 167 aa, Enterobacter cloacae
PSGEKSSATVFSHCIFAQGLCQPLLSGATPNSDDGGTLWQSCRLTTKDNEDTFMTITRIDAEARWSDVVIHNQTLYYTGVPANLDADAFEQTANTLAQIDAVLEKQGSDKSRILDATIFLANKDDFAAMNKAWDAWVVAGHAPVRCTVQATLMKPEYKVEIKIIAAV

SEQ ID NO: 7233 - protein, 459 aa, Enterobacter cloacae
IIRANYFTLPGSMPYMNMRFPTVMTLPWRADAAEFWFARLSHLPFAMLLHSGHADHPYSRFDILVADPVKTLTTDALSPTDDPLMRLQNEIDALGLTATPDPDLPFQGGALGLFGYDLGRRFEKLPEHAQADISLPDMAVGLYDWALIVDHRKQTVSLLSHRDVQARLAWLEAQRPAAPEHFMLTSGWRSNMSAEEYAEKFSRVQAYLHSGDCYQVNLAQRFQAAYKGDEWQAFTRLNASNKAPFSAFLRFEHGAILSLSPERFIHLADGMIQTRPIKGTLPRLANADADRQQAETLAASPKDRAENLMIVDLMRNDIGRVAEPGSVRVPELFVVEPFPAVHHLVSTITARLPASRTACDLLRAAFPGGSITGAPKVRAMEIIDELEPHRRNAWCGSIGYVSLCGTMDTSITIRTLTACDGNLYCSAGGGIVADSQVEAEYQETFDKVNRILKQLENSR

SEQ ID NO: 7234 - protein, 468 aa, Enterobacter cloacae
HRYWNPSNPVRSVKVISIFDMFKVGIGPSSSHTVGPMKAGKQFVDDLVEKGLLESVTRVAVDVYGSLSLTGKGHHTDIAIIMGLAGNMPDTVDIDAIPAFIRDVETRGRLLLANGQHEVDFPQDDGMRFRSDNLPLHENGMTIHAWSGEKEIYSKTYYSIGGGFIVDEEHFGKESAGDVNVPYPFKSATEMLGYCKETGLSLSGMVMQNELALHSKKEIEDYFANVWQTMRACIDRGMNTEGVLPGPLRVPRRASALRRMLVTTDKFSNDPMNVVDWVNMFALAVNEENAAGGRVVTAPTNGACGIVPAVLAYYDHFIEPVTPDIYIRYFLAAGAIGALYKMNASISGAEVGCQGEVGVACSMAAAGLAELLGASPEQVCVAAEIGMEHNLGLTCDPVAGQVQVPCIERNAIASVKAINASRMAMRRTSEPRVSLDKVIETMYETGKDMNAKYRETSRGGLAIKVQCD

SEQ ID NO: 7235 - protein, 575 aa, Enterobacter cloacae
AFLSPICNRWANFPLSSRRFTYSPLHCHCCVWLFWPVLNRRPFMQTAQTIIKDYRRKRVIVCVTVALVTLVLTLGIRFISQRNINQDRIHDFTHHTVRALDKVLLSLEAQRETLLSLVGIPCSEANLILRKQAAILQTVRSIALIKDGILYCSSVFGSRNVPVSEFVPELPVSESRLLLSTDRWLVKGSPVLIQWSPVAGDGNDGVMEVVNIDLITKMILEPQRPQITDVVLRVGDNFLRDGQQVTTTPTFDENASLLEQSSQHYPFSVTVSGPGPGEMALKNLPTQLPLALMLSLLMGYIAWLATARRISFTWEINMGIAAREFELFCQPLVNARTRECVGVEILLRWNNPRQGWISPDVFIPLAEEHNLIVPLTRYVISETVRQIGYFPASRDFHIGINVAASHFRRAALIQDLNRIWFNASPVQQLIVELTERDALLDVDYRIVRELHRKGVKLAIDDFGTGNSSLSWLEKLHPDVLKIDKSFTTAIGTDAVNSTVTDIIIALGQRLNIELVAEGVETEEQSRYLRRHSVHILQGYLYARPMPLREFPKWLAESHSPPARHNGHIVPLLPLR

SEQ ID NO: 7236 - protein, 190 aa, Enterobacter cloacae
LRSNILSSSARNLFKILSSFLIQKNPHHEEVCVHEETTAGLWAPLPDSHVVLFLDFDGVCHRCKNETFERMPLLEKLLDNCPAMVIVISSSWRECANTSYLKSLFRVPYRDKIIGATGSVYLKHGQTGVRAAECEDFVFSHRVKAFICLDDDESLFPAGYPHLHKTDYYTGLTESDLAALNARYHQLMGR

SEQ ID NO: 7237 - protein, 263 aa, Enterobacter cloacae
IRQERDIMLHHCQAKSLDDIYLEDIPHIIHPATAVHDLEDTALPNRIIQEWNLPQGYTQFVSRYHQFHHQRPWLAYRDTLDDIRYGKIVLLRKDITGNAGPGVISNGNLRNDLPLSLFTRLRDIISRQLKRPGYYVRSTTPAQHAQSTKTINSKAAGRLLAAGGLYNGNVEGFRHTAEQLGGEAVEGYDQVLNETTSGMLVAAASLLVIRNPRSADELTSYLGKYKKAHVLLDDMNVSELNYMRRDRAEYLPLRGTIQQYCTP

SEQ ID NO: 7238 - protein, 164 aa, Enterobacter cloacae
SFLFNSQYCLYIQYKNSSVAMSVILEHISNKPYEMAPFFSDLLSCGVMSPCAGHEDNELNLHEYVVRNRPSTFFVRAAGLSMINAGINDGAILVVDRSLTARHGSIVVALVDGEFTVKILHTYPELLLMPSNPAYKPIRVNPESLEIWGVVTFALNQFSHVHAR

SEQ ID NO: 7239 - protein, 98 aa, Enterobacter cloacae; identical to SEQ ID NO: 7150

SEQ ID NO: 7240 - protein, 423 aa, Enterobacter cloacae
ISSAMYMHVDINGAYAAFECAMDPKLSKKPLIIASNNDSSVIAMNKLAKSVGIKRGTPIFKCRDLIQQHRIEVRSSNFTLYEDYSNRFHETLESFAPQSSRYSIDENFMLLKNMNKIIDYEDYGRLIRSTLLHNLSLTCGVGCSSTKTLAKLCTYASKRWAATGGVVVLTDQARIRKLLSLISTREIWGIGRKISERLSAFGIITAGDFYNSDVRFLRKSFGVEIERTWRELHGEPCFRLHESPPVRQQIIVSRSFGQRLNEIGKLHEAVSFFTARAAEQLRKDGSWTRQITVFIQSSNYAQGENRYSNCGIEPLTATQDTRDLVDAAMTILNRIYRPGIAYAKAGVMLSAMTDGTEQLSLFDTRPARPGSQALMKVMDRFNKEKRGALFLLGEGIQQDFRMKQAMLSPRYTTRWDELLVVKA

SEQ ID NO: 7241 - protein, 189 aa, Enterobacter cloacae
IKRRFSGEIVVFTPPADDVKPIPVPDEIYTQCITDAARYFGIDAELVFTLFDNEGGKVGTFSRNTNGTYDIGPMQINSSNLPEIKKHFPTVTWRVLAYDACASFWVGTWWLYRKIVDRKGNVFEGIADYNSKTPKVRAKYIFNFMVKYNRRIQQRNGMGELYQWTQQPPRYNGHIAKNVPEQNPTPVVK

SEQ ID NO: 7242 - protein, 75 aa, Enterobacter cloacae
NFATGKVPSGWQVHHKIPLDDGGTNAIDNLVLIQNSPYHSALSKAQSIITKDLPYNSSTKVLWPSPNGVIYPVGK

SEQ ID NO: 7243 - protein, 171 aa, Enterobacter cloacae
EALMKDLTQLLSSLKRLMVADHYPLASPVAPEVLKDLICNPPPVEWADHKKSAYIDIQKLIKTRLDYAQVFNAMDGFEYNGLTFYNLVQAENENLLWSNIYIRNFEARDNEIYVDPNLTDKVLIGEDGMSLFAYSFADDCFQIRDKASTDYVIESHTEFDRFLSSLIQTVS

SEQ ID NO: 7244 - protein, 499 aa, Enterobacter cloacae
WTKNSKAMTCLRPIRSIISMLAAVLEALMRSNAVFNFKKLLLSLSVCAAILAPTANADNAMRNIFNGMMTSTSPATFSTATRTGIVGGSMSYRTTNVNTNLVSMSFPKASVGCNGIDVFLGSFSMINGDQLVQVARGIAQGAAIYAFNVAVSAICADCAATINDIQNKLQALNKFAKDSCNATYSFLSENVGTPSQFANSVSSGPASILGSINGLIPDFGSSMTKSPEAVTSQVKAKDPEEFAEKFSGNLFYMSFMDIDKGTMNIGGVTELSGYKLAEQLMSLVGTVIINWDSKGEKAGMEVRPSTMTVTDYIMGPPAGGSIKMLKCSPAPDPSSPRKAQCLVMSEVNDGGFKGLKDTISDLLLNVQKKIINDVRVSDDELRIISYIGIPTIIDSLQTFEAPEGYAYIQDISTIAATSLVINMLRQVEAKISTMSIPSESLSGKRDDLNRLTDNLSKQVKAAYELSHSQVGTSSDVISTWDNRRLQRKAFTESIRGTRN

SEQ ID NO: 7245 - protein, 94 aa, Enterobacter cloacae; identical to SEQ ID NO: 7141

SEQ ID NO: 7246 - protein, 652 aa, Enterobacter cloacae
TVSAIWYDSPNIRIWKERYMGDLVSKNNIDRLERFHSLLAGQYWTSTDSIPEEGIVAGDTLLITSLRYVEDKLHTVILRAHPRVYGQTVAIVTEDSSGNRRERGKEMREHRFLVKDFLSSFVFEPDHKVIRDAELRQAQEEVNSLQASLTALVSDAQGLRDLAIEQLGTDDRENPVTGLSVALVPPQEQQAVTSLAIGSVQNALSSGISDTRIEQIREAALKEGQISTAISKIITQRTQAIANASKRMLPYFEEVAAASLATTEEAMEYVKKIHDGVGSLELYTGKDVEVVNIVKGESAPSHLPLQVVQAKLMVDEELAVWCDLDSWFDFSDMEKFHETLRTSPGLVEQIFPSERSIVCMATTRRYIDYRDPWENHVRNDRNRVVFLLVRDGQNIHQVYCSVESHLGASQLFPSASEQEAHFQGIDGSTIKFEDVSYTDRLKQHDLMALHYRRFLILICGLDHRLKLFGDFYDTNTPYSFLSLEFQERYFQFLHDKDGSGLLGMAETRPSLQSYLEQANSCLQSGSRVMCNWDSLMNPVTAPGAVQEDNSYSGYKWLGRTHKNYEPVIAFRQGDDICVNATVNRYSTDRDFNCKVNLSLFKESSRNDAELGFLCMDTIKAEELEWYIHRRKFRSNHLFYIRFFKMVLPTVQN

SEQ ID NO: 7247 - protein, 104 aa, Enterobacter cloacae
SAPLNTGELMITFEIRMEIKVLHKRGMSIRAIARELGISRNTVRSHLKAKSEKPQYSPRPAPSSLLDEYRDYISKRISDAHPYKIPATVIAREIMELGYRGRAF

SEQ ID NO: 7248 - protein, 252 aa, Enterobacter cloacae
GAEMKKIIKASVLLLSLSTAFTMNAEPVNTMVLPDAARDKLKAIGLSIEHVEPSPVKDIFTVISREGVSYVSKDGDYIFTGSLFHVKGKDVVNTTEQAILMGVREFASKTKSIDYKSPNEKYRLAIFTDITCGYCQKLHHDLKSYLDAGISIKFLAFPRAGLNSVVAGNMAKIWCSAKPNEALDAAMNPVSTIPEGRPDEACLNIIKSHFQVASTIPLQGTPTMVTLSGKPQLFTGWLSPENLVTQMGAAQK

SEQ ID NO: 7249 - protein, 302 aa, Enterobacter cloacae
SPKSIVSRIIPIYRASIIHRRLITNRLKSIKVAMSKEFYLKPMATILISAVIATAASALITATYFKPKVLSEEEIGKIAATYLVKNPHYLVEAGKALENQNVSASVERIIPYAPALLDTKETPNIGPDDADVAVIEFFDYQCIYCMRVTPVVESVMNQSKDVKFFFKEFPIFAGSKPVSAMGAATGLHVYQNFGAEAYRKYHNNLMAVAHTFMTSQRKFELTDFNTVVEKSGFNSTFSDREKNRYENVISGNMQLGEALGITGTPGFIIMNMKKPNAATTTFIPGAMDAATLQGAIEKARGA

SEQ ID NO: 7250 - protein, 77 aa, Enterobacter cloacae; identical to SEQ ID NO: 7143

SEQ ID NO: 7251 - protein, 1320 aa, Enterobacter cloacae
LRSDMDYNIYTLGDIDFVWSAFTGIALIFSQYTGVKEFLTTAAVVAGVSLFYKTWLWLQAPTKNELPFFSWFLGLILFMMAMVRVDVTIESVKSGEVRNVDGIPIFIAAMATVTTNLSQGLLKDYKTAFDPLSPVDLSATTLDDDITLGPMIRFVKFLQWGGDSQGYCSAFPEPASGLGPMNVCATVQSLAYNCLKATQNSSANIAGKETIFNDIFSANLADSMDRINQAMKGALKNASASIVGANGSKSGTCDEVWSTVKQVTSTAEARQTISLIGQTNGILTPDEANGAPTGASFTDVMASANGMYGKAIGSYDATLNLFIMNELRNGASKYKTPLGLASDMQLFEASLKRTNTMASQGQLWLQLSGAAIAFLEMFAYMVAPFALLMLLALGGNGVAAAAKYLQLILFVNMWPLTAVMVNAYVKKVATADLDTWSTLNSQNNAVTWMGLPGLAETYSSYLSVASALYALIPVLTLFLMTQSIHPMMNAVKGVTPDAPVDTGHVTPKVWDGPNSGKSSFGDVTRTALTSTGQGYSDGGAVDSSNFRLGMWNAGSSIANSQGQGSAVTSSVMSAASNSFQAGYSQMSEIGRSGQSSQQFSTNLQTMKQISDKIGASVAEGIATKHGVSASQMASIASNVILNAGLNGGVGTGNGAGLKAAVAGQLSSGASKTNTGSDSLSNDLSKAITNQLSQDSALTDQFSKAASQVSSDQISNTNAFKEASSKMNQATQTMAQNISTSVSTNASSNSGMSLDSKQSINLDRFSDSIRNKNFSDDDVRNFARKNGLDENAFMEKFNSYNDTFKASNQLGSQLQRTDALVAATRDFSEQKIAIDTARGETAESNKQDLRETSSLLKSLVSDFGGNAQQLLPITNQLDRISGDGSGINTITQAQDRTPDSVNTSGVMSASRVGELGGSVDSQAKLGLSSNAQDATQHVPGKSEAGFTPYNLDNAGKGDIQGIHNNNVGRTYSDEERNVLNSLEKNGPVLNNQGVEKVVNSGQDVRNAEGTFNDLEKVGGRVVGDGMDQRATALNSMYQSGQVRGLSNNTDNYFSRVANNPNLSRDDKRAELAQQAVFTYGASTMATGAEREQLKADTQKILNELGNYNVNWSMNDVKSIHSSFNTHNRADGSLESVVRANLGEGGSGGGLVGNRTQTVTDRLVGEKIEANTERGAISGALLGGQQFVSDTLTSVGAKPVNEMLTGAGILQTQTSIANDASNPANMPDSLQGKVLNHMQMSDGVAAVSDRYQSISSDGVSTYANAAQNSERAIRQQLTDDPRFGPQKADEFIQYMKSELSNTNEPYQSRVDKADQWLNENKK

SEQ ID NO: 7252 - protein, 174 aa, Enterobacter cloacae; identical to SEQ ID NO: 7138

SEQ ID NO: 7253 - protein, 150 aa, Enterobacter cloacae
KRITKLSLHWRANVVEQVSGILTRWRQFGRRYFWPHLLLGMVAASLGLPVLSNSADAATPARSTTTKHDLTTRVNFTNLAWLEASRRLNFSVDYWQQHANPTVNRHLSFARAPTRMLVAEKNLPVQAQHLGLVQSPNAALNPGNQPAIEP

SEQ ID NO: 7254 - protein, 70 aa, Enterobacter cloacae
IHADGRSVVKTLCMCGHNIIGAFTAFKSGHALNNKLLQAVLAKQEAWEYVTFEDEAELPLAFKAPTMVLA

SEQ ID NO: 7255 - protein, 501 aa, Enterobacter cloacae
CLMESDVMTQPAKKAPSIKLLFSALLLVMLLSALDQTIVSTALPTIVGELGGLDKLSWVVTAYILSSTIVVPLYGKFGDLFGRKIVLQIAIVLFLVGSALCGLAQNMTQLVLMRALQGLGGGGLMVISMAAVADVIPPADRGRYQGLFGGVFGLATVIGPLIGGFIVQHASWRWIFYINLPLGLFALLVIGAVFHGSARRSKHEIDYLGAIYLSMALLCIILFTTEGGTIRQWSDPQLWCILAFGLTGIAGFIYEERLAWEPIIPLSLFRDRSFLLCSLIGFIIGMSLFGSVTFLPLYLQVVKDATPTQAGLQLIPLMGGLLLTSIISGRIISRTGKYRLFPILGTLLGVVGMMLLTRISITSPTWQLYLFTGVLGMGLGLVMQVLVLAVQNSVSADQYGVATSGVTLFRSIGGAIGVALFGAVFTHILQSGLIDRLPEGAELPRELNPVAIHHLPDALRLDYLDAFGSAIHAVFMLAAEIMVLAFVLSWFLREAPLRRQA

SEQ ID NO: 7256 - protein, 153 aa, Enterobacter cloacae
AVRYSDCAENKERFMHLSITDKVTAEEKEELLTGLRAYNAQYLDLATFSGDIGVYMRDDNGVMLGGLIGVRKGDWLNIDYLWVSDSVRGTGVGSQLIKTAEEEARRKGCRHALVDTVSFQARPFYEKQGYQVQMSLQDYPYQGMQRHYLSKNL

SEQ ID NO: 7257 - protein, 320 aa, Enterobacter cloacae
QGREMSTINDVSRLAGVSKATVSRVLSGSRGVKEASRQAVLKAVDELNYRPNVIAQSLLSQSTGCIGVICAQENINQTTGYLYALEKHLSQHQKHLLLRFAHTKTEVMNALEELSCGLCDDILVIGARFPLDVDMDNVILVDCMEADNANSIQFDHAFAAETACNYLTSQGRRQIALIHPHGSGFADQVLLGYKHALEKNFLPFNRNLVFMDATSSSVALQELLNNASTLNFNALLVADEQEAQRVIPQLQAFNKSVPEDIMVFSLGGSLHLPGIPVIPAIEYSMDAMAARIVSWLTEKTQMLGSYVLRGDLIIPDVRKR

SEQ ID NO: 7258 - protein, 223 aa, Enterobacter cloacae
IRSRDTVTMPAQKDNSEPRRPGRPRGGKRVTASREQLLDIALNLFSRQGIANTSLNAIAREAGVTPAMLHYYFNSREQLLDAMIEERFLPLRERIGAIFADNRDSPVDALTEMVRVLAELAEKYRWFAPLWMQEVIGEMPVLRTHLQARFGDEKYHTTLATIKGWQQEGKLNPALAPELLFTTLLSLVLVPFSRMRNDERLSALSPEIVVRHVLAVIGTGIGG

SEQ ID NO: 7259 - protein, 1046 aa, Enterobacter cloacae
RDENQRRKRLMFSRFFVRRPVFAWVIAILIMLAGILAIRTLPVAQYPDVAPPSIKISATYTGASAQTLENSVTQVIEQQLTGLDNLLYFTSTSSSDGSVSINVTFEQGTDPDTAQVQVQNKVQQAESRLPTEVQQSGITVEKSQSNFLLIMGVYDKTDTASSSDIADWLVSNMQDPLARVDGVGSLQVFGAEYAMRIWLDPAKLASYSLMPSDVQSAIEAQNVQVSAGKIGALPSSNAQQLTATVRAQSRLQTVDEFKKIIVKSQSNGAVVRISDVARVEMGSEDYTATAKLNGHPAAGMAVMLSPGANALNTATAVKDKIAEFKKSMPEGYDVAYPKDSTEFIKISVEDVIQTLFEAIILVVVVMYLFLQNIRATLIPALAVPVVLLGTFGVLALFGYSINTLTLFAMVLAIGLLVDDAIVVVENVERIMRDEGLPAREATEKSMGEISGALIAIALVLSAVFLPMAFFGGSTGVIYRQFSVTIISAMFLSVVVALTLTPALCGSILNHTAPHKKGFFGAFNRFYSKTEHSYQNKVLRALRRSGGMLVIYALLCGAMGFAMLKLPGSFLPTEDQGEIMVQYTLPAGATAVRTAEVSRQVREWFLTKEKANTNVIFTIEGFSFSGSGQNAGMAFVSLKNWSERKGDENTAQAIALRATQELSTIRDATIFAMTPPAVDGLGQSNGFTFELMASGGTDRDALLKLRNQLIGEANQDNSLHAVRANDLPQMPQLQVDIDNNKAVSLGLSLSDVTDTLSSAWGGTYVNDFIDRGRVKKVYIQGDSDYRAVPSDLNKWYVRGSDSTMTPFSAFATTRWEYGPESLVRYNGSAAYEIQGENASGASSGTAMSKMEQLANSLPSGSTWAWSGLSLQEKLASGQAMSLYALSILVVFLCLAALYESWSVPISVIMVIPLGVLGAAVAASLRGLNNDVYFQVALLTTIGLSSKNAILIVEFAEAKVAEGYSLTRAALRAAQTRLRPIIMTSLAFIAGVTPLAIATGAGANSRVAIGTGIIGGTLAATLLAIFFVPLFFVLVKRLFSGKHANRRS

SEQ ID NO: 7260 - protein, 387 aa, Enterobacter cloacae
IPMAKVSFSFAAILGLLTAIGPLCSDFYLPALPEIATQLNTSTTLTQLSLTSALIGLGLGQLFFGPLSDRIGRKTPLLFSLLLFVLASVLCASTQNIYALIGWRFVQGVAGAGGSVLARSIARDNYHGTMLTQFFALLMTVNGIAPVVSPVLGGYIASHFDWRMLFWVMAGAGLALLIASQLFIRESLTEKQGRGSLTQTARTVLKNRRFMRYCLIQAFMLAGLFAYIGASSFVMQNEYGLSAMQFSLLFGVNGIGLIVSALIFSRLARRHLAERLMRTGLVLALSCAGLTLLFAWMQLSVPALVALFFTVAFNSGISTIAGSEAMSAVDTKESGTASAILGMLMFLFGGIAAPLAGIGGETMLKMSLAVLVSYGIALAIGYRTQNA

SEQ ID NO: 7261 - protein, 108 aa, Enterobacter cloacae
GWLSMFKIMLCCSAGMSTSLLVSKMIDVAKERGLPVKIDAYGVSEFDTQFPHYQVVLLGPQVKYMLKTLSDKAATQGIPVQPIDMMDYGMQRGDKVLDYALSLIEAAH

SEQ ID NO: 7262 - protein, 191 aa, Enterobacter cloacae
PTMSTKLEERQKLRQDEIITAARRCFRASGFHAASMSQIASEARLSVGQIYRYFSNKDAIIEEMIRRIIDSRIEEMQGKTLVEGMPQALAWRQTLNEDDDALMLEMSAEATRNPLVANMLIEAEARMFANACEHLKKQFPHLSDEHIRCCVEITAVMIEGTIYRRLTPLKVPSEQLEPIYQNILNMLFSAK

SEQ ID NO: 7263 - protein, 384 aa, Enterobacter cloacae
QGRLRSPWKKIMKTITTSIAALLLLTGCDNAQTSAPQRPLPEVGIVTLMSQPVSVVSELTGRTAAAMSAEVRPQVGGIIQKRLFTEGDTVKAGQALYQIDPSSYRAAYNEAAAALKQAQALVQADCQKARRYAQLVKDDGVSRQDAEDAKSTCAQDKASVESKKAALESARINLNWTTVTAPIAGRIGISSVTPGALVTTQQDTALATIRGLDSMYVDLTRSSADLLRLRKQTLASNSDTLNVSLILEDGSSYSEKGHLALTEVAVDESTGSVTLRAVFPNPQHQLLPGMFVRARVDEGIMNDAILAPQQGITRDAKGTATALVVNASNKVEQRQLETGDTYGDKWLVLSGLKAGDKLIVEGTDKVTAGQEVKAEEMKTNGGNA

SEQ ID NO: 7264 - protein, 461 aa, Enterobacter cloacae
ARKPEVIMFRVTVLTLALLSAGCVSLDPTYQRPDAPVPTTLPGAHGEANAVVSQWQQVMNDARLKSVVTMALNSNRDVQKAIADIDAARAQYGETRSSLFPTVDAELSHTRSRTLASGVATSDEANGAVSSFELDLFGRNQSLSRAARETWLASEFTAQNTRLTMVSELTTAWVTLAADNSNLALAKSTLESAANSLKIVKRQQEVGVAAATDVSEAMAVYQQARASVASYQTLVMQDKNALNLLAGDTVPENLLPGTLESLSDNAITLIPAGVSSSALLRRPDIQEAEHNLLSANANIGAARANFFPTISLTASAGVGSDSLSSLFSHGMKVWSFAPSITLPLFSGGNNMAQLRYAEAEKKGLIATYEKTIQSAFKDVADALARRETLSEQLDAQREYVAAEQKTLDVATRSYKAGAGDYLTVLTAQRSLWSAQESLIALQQTDLENRITLWQSLGGGIQ

SEQ ID NO: 7265 - protein, 428 aa, Enterobacter cloacae
STGLCSVAYRSGTLKGVHMSSLYQSMVAVIEQSITPLAAKLGQQKYVIAIRDGFTAALPFMIIGSFMLVFIFPPFSADTTNSFARGWLDFSETYREQLMLPFNLSMGVMTFFISVGIGASLGRQFNLDPVMSGLLAFMAFLLVAAPYADGKISTQYLSGQGIFTALITAIYSTRVYAWLKQNNVTIRLPKEVPTGVARSFEILIPVMVVIGTLHPLNLFIEAQTGMIIPQAIMHLLEPLVSASDSLPAILLSVLLCQIFWFAGIHGSLIVTGIMNPFWMANLSANQAALAAGAALPHVYLQGFWDHYLLIGGVGSTLPLAFLLLRSRVTHLRTIGKMGVVPSFFNINEPILFGAPIIMNPMLFIPFVFVPLVNACLAYGATKLGWLAQVVSLTPWTTPAPIGASWAANWALSPVVMCLICMVMSALMY

SEQ ID NO: 7266 - protein, 353 aa, Enterobacter cloacae
IMMKRNILAVVVPALLVAGAANAAEIYNKDGNKLDLYGKAVGLHYFSDNDSNDGDNTYARLGFKGETQINDQLTGYGQWEYNFQGNNSEGGDAQNGNKTRLAFAGLKFGDAGSFDYGRNYGLVYDAIGITDMLPEFGGDTGASDNFFAGRTGGLATYRNSNFFGLVDGLNFGVQYLGKNERTDAVRSNGDGWATSLSYDFEGFGIVGAYGAADRTNNQQTLEWGKGDKAEQWATGLKYDANNIYLAAIYGEMRNAARLGSRGFANKSQDFSVVAQYQFDFGLRPSIAYYKSKAKDVEGIGDEDYINYIDVGATYYFNKNMSTYVDYQINQLKDDNKLGINNDYIVALGLVYQF

SEQ ID NO: 7267 - protein, 222 aa, Enterobacter cloacae
  UNSURE (199)
YHRQSPAVWLKKEPKRMLFTLKKYIGGMMLPLPLLLLLIALGLAMIWFSRFQKSGKSLVTVGWLALLLLSLQPVADGLLRPIENTYPTWQGNQKVGYIVVLGGGYTWDPNWAPSSNLINNSLPRLNEGIRLWLANPGSKMIFTGAAAKTNPVSTAEAGARVAESLGVPRSAIITLDSPKDTEEEAAAVKQAIGDVPFAXGDIYFHTCRAQLFENELEIPPKE

SEQ ID NO: 7268 - protein, 402 aa, Enterobacter cloacae
SQWNFVMFENITAAPADPILGLADLFRADDRPGKINLGIGVYKDETGKTPVLTSVKKAEQYLLENETTKNYLGIDGIPEFGRCTQELLFGKGSTIVSEKRARTAQTPGGTGALRVAADFLAKNTSVKRVWVSNPSWPNHKSVFNSAGLEVREYAYYDAASHALDFDGLLASLSEAQAGDVVLFHGCCHNPTGIDPTLEQWEQLAKLSVEKGWLPLFDFAYQGFARGLEEDAEGLRAFAAVHQELIVASSYSKNFGLYNERVGACTLVAADEATVDRAFSQMKSVIRANYSNPPAHGASVVATILSNDALRAIWEQELNDMRQRIQRMRLLFVNTLAEKGADRDFSFIIKQNGMFSFSGLTKEQVLRLREEFGVYAVASGRVNVAGMTPDNMAPLCEAIVAVL

SEQ ID NO: 7269 - protein, 271 aa, Enterobacter cloacae
QNSGFAVSGTLPMRDRNFDDIAEKFSRNIYGTTKGQLRQTILWQDLDKLLAEFGDRPLRVLDAGGGEGQTAILMAQRGHHVTLCDLSAEMVARAGRAAEEKGVSDNMHFIHCAAQDIPQHLETQVDLILFHAVLEWIAEPQAMLKTLWSMLRPGGALSLMFYNANGLLMRNVLVGNFGYVQQGMYKKKRRTLSPDFPREPQQVYGWLEEIGWEITGKTGVRVFHDYLRDKQKQDDCLDALTEIETRYCRQEPYLSLGRYIHVTARKPQMQG

SEQ ID NO: 7270 - protein, 441 aa, Enterobacter cloacae
SMSEFSQTVPELVAWARKNDFSISLPVDRLSFLLAVATLNGERLDGEMSEGELVDAFRHVSDAFEQTSETISVRANNAINDMVRQRLLNRFTSEQAEGNAIYRLTPLGIGITDYYIRQREFSTLRLSMQLSIVAGELKRAADAADENGDEFHWHRNVYAPLKYSVAEIFDSIDLTQRLMDEQQQQVKDDIAQLLNKDWRAAISSCELLLSETSGTLRELQDTLEAAGDKLQANLLRIQDATMAHDDLHFIDRLVFDLQSKLDRIISWGQQSIDLWIGYDRHVHKFIRTAIDMDKNRVFAQRLRQSVQTYFDAPWALTHANADRLLDMRDEEMALRDEEVTGELPPDLEYEEFNEIREQLAAMIEEQLAVYKTRQAPLDLGLVVRDYLAQYPRARHFDVARIVVDQAVRLGIAQADFTGLPPKWQPINDYGAKVQAHVIDKY

SEQ ID NO: 7271 - protein, 1487 aa, Enterobacter cloacae
RGGRVMIERGKFRSLTLINWNGFFARTFDLDELVTTLSGGNGAGKSTTMAAFVTALIPDLTLLHFRNTTEAGATSGSRDKGLHGKLKAGVCYSVLDVINSRHQRVVVGVRLQQVAGRDRKVDIKPFAIQGLPTSVQPTALLTETLNERQARVLTLQELKDKLEAIEGVQFKQFNSITDYHSLMFDLGVVARRLRSASDRSKYYRLIEASLYGGISSAITRSLRDYLLPENSGVRKAFQDMEAALRENRMTLEAIRVTQSDRDLFKHLISEATNYVAADYMRHANERRIHLDQALEYRRELFTSRKQLVAEQYKHVEMARELGEHNGAEGDLEADYQAASDHLNLVQTALRQQEKIERYEADLDELQIRLEEQNEVVAEAAELQEENEARAEAAELEVDELKSQLADYQQALDVQQTRAIQYNQALQALQRAKELCHLPDLTPESADEWLDTFQAKEQEATEKLLSLDQKMSVAQTAHSQFEQAYQLVVAINGPLARNEAWDVARELLRDGVNQRHLAEQVQPLRMRLNELEQRLREQQEAERLLAEFCKRQGKNYDFDELEALHQELEARIAALSDTVSNASEQRMTLRQELEQLQSRSKTLLQRAPIWLAAQSSLNQLSEQCGQEFASSQDVTEYMQQLLEREREAIVERDEVGARKRDVDEEIERLSQPGGSEDPRLNALAERFGGVLLSEIYDDVGLDDAPYFSALYGPSRNAIVVPDLSLISDQLAGLEDCPEDLYLIEGDPQSFDDSVFSVDELEKAVVVKIADRQWRYSRFPELPLFGRAARESRIESLHAERETLSERFATLSFDVQKTQRLHQAFSRFIGSHLGVAFEPDPEAEIRKLNTRRGELERALASHENDNQQSRVQFEQAKEGVAALNRILPRLNLLADDTLADRVDEIQERLDEAQEAARFVQQHGNQLAKLEPMVSVLQSDPEQFEQLKEDYAWSQQVQREARQQAFALTEVVQRRAHFGYSDSAEMLSGNSDLNEKLRQRLEQAEAERTRAREAMRTHAAQLSQYSQVMASLKSSFDTKKELLNDLHKELQDIGVRADSGAEERARIRRDELHAQLSNNRARRNQLEKALTFCEAEMDNLTRRLRKLERDYHEMREQVVTAKAGWCAVMRMVKDNNVERRLHRRELAYLSADELRSMSDKALGALRLAVADNEHLRDVLRMSEDPKRPERKIQFFVAVYQHLRERIRQDIIRTDDPVEAIEQMEIELGRLTEELTSREQKLAISSRSVANIIRKTIQREQNRIRQLNQGLQSVSFGQVNSVRLNVNVREAHSTLLDVLSEQHEQHQDLFNSNRLTFSEALAKLYQRLNPQIDMGQRTPQTIGEELLDYRNYLEMEVEVNRGSDGWLRAESGALSTGEAIGTGMSILVMVVQSWEDEARRLRGKDISPCRLLFLDEAARLDARSIATLFELCERLDMQLIIAAPENISPEKGTTYKLVRKVFQNSEHVHVVGLRGFAPQPPESLPGTADAS

SEQ ID NO: 7272 - protein, 193 aa, Enterobacter cloacae
QFLLPVDLIIMDKFDANRRKLLALGGVALGAAAILPTPAFATLSTPRPRILTLNNLHTGETLKAEFFDGRGYIQDELARLNHFFRDFRANKIKAIDPGLFDQLYRLQGLLGTKRPVQLISGYRSLDTNNELRAHSRGVAKKSYHTKGQAMDFHIEGVSLANIRKAALSMRAGGVGYYPRSNFVHIDTGPVRHW

SEQ ID NO: 7273 - protein, 266 aa, Enterobacter cloacae
TRRCAWASHKPISPDCRRSGSRLTITEPRYRRMSLTNIEQVMPVKLAQALANPLFPALDSQLRAGRHIGLDELDNHAFLMDFQEYLEEFYARYNVELIRAPEGFFYLRPRSTTLIPRSVLSELDMMVGKILCYLYLSPERLANEGIFTQQELYDELLSLADESKLLKLVNNRSTGSDLDRQKLQEKVRSSLNRLRRLGMVWFMGHDSSKFRITESVFRFGADVRAGDDAREAQLRMIRDGEAMPVENHLQLNDEHEENQPDSGEEE

SEQ ID NO: 7274 - protein, 74 aa, Enterobacter cloacae
SAKPPTTWRRTICATPTSAVFISIRRWSIAASCLPPANSWWPSSISMSKWRANWASTMVLKGIWKPITRRPAII

SEQ ID NO: 7275 - protein, 109 aa, Enterobacter cloacae
WWCRAGKMKRAVCAAKTSLHVVCCSSMKPRVSTPAPSPRCLSFASDSICSSSSRRRKTSVRKKGQPISWCVRCSRTVNTCTSWACVVSPRSHRSHYRARLTPLNLGCDK

SEQ ID NO: 7276 - protein, 635 aa, Enterobacter cloacae
GKAAACMPFYTEGKLQNTGHVVKNRGQGMLLKKNRGRQLSALSLCLTVMFAPLFTAQADEPEIVPTDSSATMGAQPTSLSQPLDQSPATAIMAGIKPLPEGIDTGSLRQQLMTGLPSGYTPAYINQLTLLYAARDMKPMWENREAVRAFQQQLAEVAIAGFQPQFTTWVELLTDPAVTGQARDVVLSDAMMGYLQFVAGISVNGNRWLYSSKPYKLATPALSVINQWQLSLDNGELPRFIASLAPAHPQYATMHQSLLELVADSRPWPQLRGTTTLRPGQWSSDVPAIREIMKRSGILDSGPKIALPGDETQNAVVSPSAPVKEKTAVALSNKPAAYDRELVAAVKQFQAAQGLGADGVIGPSTRDWLNVSPAQRAGVLALNIQRLRLLPGTLSTGIMVNIPAYSLVYYQDGSEVLASRVIVGRPDRKTPMMSSALNNVVVNPPWNVPPTLARKDILPKVWNDPGYLERHNYTVMRGWNSKEAIDPWMVDWSTITPSNLPFRFQQAPGAHNSLGRYKFNMPSSDAIYLHDTPNHNLFQKDARALSSGCVRVNKASELANMLLQDAGWNDTRISDALKQGDTRYVNIRHNIPVNLYYLTAFVGADGRTQYRTDIYNYDLTARSGAQILPKAEQLIR

SEQ ID NO: 7277 - protein, 230 aa, Enterobacter cloacae
YRAGSALVITKHRSSMNYRIIPVTAFSQNCSLIWCEQTKLAALVDPGGDAETIKQEVAASGVTLMQILLTHGHLDHVGAAAELAEHYGVPIIGPEKEDEFWLQGLPAQSRMFGLEDCQPLTPDRWLNEDDRVNVGNVTLQVLHCPGHTPGHIVFFDDVSRLLISGDVIFKGGVGRSDFPRGDHGQLIQSIKQKLLPLGDDVTFIPGHGPMSTLGDERLHNPFLQDEMPVW

SEQ ID NO: 7278 - protein, 405 aa, Enterobacter cloacae
GCRLQHRDNGFAQRRHVVRRHTCNVHAARCNGIHAKLFTQAQHLLFGQAAEGEHAVLLDDEAEVTVSAFLSQRVHKQQTHALNALTHIVQLLLPDGAQRIVAQDRRDHRRTVCRWVGVVSADHGLHLAECAIDGCFVSSHQRTGADTLVIQTKVLGIGACDYQLLMHGGECAQTFCIFFQTTGKALVSEVKQRQPAFFNGQLSQLFPLLKRRIDTGWVMAAAVEQHHIARLGFAQAGQQAVEIQRVAGCVVVGVFTHFQTRRIKHALMVRPAWIAYPHTLHRSVFRQEICRHAQCAGTAWGLRRAGAFFAHNGAAFAEQQLLGAATKFRDTINTEVVFGGFVFQQILLSFFDAGQYRSFAGFIFIYTNTQVDFSRAVVGAKQIGQAQNWVGRSGSNVLKHDEVPL

SEQ ID NO: 7279 - protein, 463 aa, Enterobacter cloacae
DMKPGYHEIYSRYRDNIMRGVLKPGDRVPAIRLLAEELKVARKTVETAYAILTGEGYLVSQGARGTRVNPDLLLPAQNAPTEQATGTLPASLISQRERAGFLRPGIPALDSFPYKKWLLLAGQATRAMRQDEMLNPPVLGWYPLREAIARYLNISRGLSCTAEQVMITSGYSGSLRLILDTLASRSDKVVFEDPGYFMGQQLLKRIVPRLHTVPVDRAGMDTDYLLRNHHDARFAIVTPSHQSPLAVTLSLPRKQQLLDWASQNEAWIIEDDYDGEFHYTRKVLPSLKSLDQHDRVIFMGTFSKTIMPSLRMGYVVMPASTVGVFTDSADILTSGQPVLTQKILTAFLNEGHFFRHLKKMRALYQTRRDWMIAALREVYGDLFFTEQNDGGMHIVAFLAKGSADREIARCWQEQQLQVNALSGWYHGSGKRYGLVMGYNNVRSYQEALDLLERPKRQTLELLS

SEQ ID NO: 7280 - protein, 529 aa, Enterobacter cloacae
CSPRYASGVIIMENGQYNTDSKTAFVYHTDPLKRYLHGGLFIHLYWFNALYGENKGYSMTRYQHLANLLAERIEQGLYRSGERLPSVRTLSQEHGVSISTIQQAYQILENLQLITPQPRSGYFVSKRKAQPPVPAMTRPVQRPVDVTQWDEVMMLLDARADKEMISFGGGSPDINQPSLKPLWREMSRIAQHNPGEMLSYDVLDGRLELREQIARLMLDGGSTVAANEIVITNGCHGALSIALLSVCKPGDIVAVESPSFHGTMQMLRGFDIKAIEIPTDPETGISIEALELALEQWPIKAVILVPNCNNPLGFIMPEARKKQVLALAQRHDIVIVEDDIYGELAAEYPRPRTIHSMDIDGRVLLCSSFTKTVAPGLRVGWIVPGRYYDRVMHMKYAAGGFNVPGTQMAVAAFIRDGHYHRHVRRMRQIYQQNMETYTCWVRQYFPAEICVTRPQGSFLLWVELPETVDMVCVSKQLCRLKIQAAAGSLFSASGKYRNCLRINVALPPTDKNREALKKMSTRRGGVPRL

SEQ ID NO: 7281 - protein, 424 aa, Enterobacter cloacae
PMEKHTELKRAKLLALSLLLIAVAAFITTLFMPQTFWVRGVKAIAEAAMVGALADWFAVVALFRRVPIPFISRHTAIIPRNKDRIGDNLGQFVQEKFLDTQSLVDLIRRYEPAQMIGTWFSQPDNARRVGQHLVQVMGGFLELTDDGRIQRLLKRAVHKAIDKVDLTETSAVMLESMTKNNRHQVLLDAIINRLITLIQRESTREFIADQIVHWLKTEHPRKAMVLPTEWLGDQSAEMVSNAVNTLLDDISHDRTHQIRQAFDRATIKFIDNLKNDPEMTAKAENIKHYLKNDEAFNRYLGEMWADLRQWLKNDMQSDDSRVKQRIANAGLWFGETLTNDASLRASLNEHLEQAAHRVAPDFAAFLTRHISDTVKSWDAKDMSRQIELNIGKDLQFIRVNGTLVGGTIGLILFLLSQLPAVLGH

SEQ ID NO: 7282 - protein, 175 aa, Enterobacter cloacae
GTRMRVPATHACPLFINPAWITCGIACSRSTSSSRIVGDLPPNSSVTRLKLSAALRRIALPVFVEPVNEIFATSGWRLRVSPTVSPRPVTMLNTPGGSAASRSASVTICVCRALISLGLMTAVQPAASAAASLPQINPASLFHGVISPATPSGVICTVAAPAEVTNSNASSASMA

SEQ ID NO: 7283 - protein, 301 aa, Enterobacter cloacae
SMHRSGLTELEVVMAVVRRGSFRGAAQELGMSATAVSNAIAGLESRLETRLFNRTTRSVALTDAGQRYVARIGPALQEIRLAGEEIHSDTGEPAGTLRLDVPNHIGTLFLDQLLIDFMIRYPKMRVETVSEARMIDIVAEGYDAGIRLEESVPQDMIAVPLTGEIRQLVTATPDYFARHGIPETPDDLLSHQGIGMRMAHGGIYRWELARRGETYALAVPPRFATSDLFASIRAVKAGLGVGFLPELYIQDELKSGELVSVLNDWAQPFAGLRLYYPGHRHVPPGLRALVAMIRERGIIPG

SEQ ID NO: 7284 - protein, 349 aa, Enterobacter cloacae
PARDIEIAGYRLAQRIPAQNGRVEHFILTHGARRLARQQQPFFIGEAVEGGNAGAQKTGPFALANQRRRQRAGRLFCGGVLRGQQKIRIHPRPARALAHQIPFARQNGIRRLDGFARHLQLFRQQADGRYPVARLQHAAHDVVAIAGINLVIARLHVLPNFTLFVSFYYVMNGVDLLHRMTHAAQKRGKTMSTRVNHHKATPALTNALSALSMEVAKTSIDPALKHLIDIRVSQLNGCTFCLDMHSKEAKIAGERELRLYHLAAWRESPLFSAREKAALAFTEALTQIGVHGVSDALYRSVAEHFSDVEISELNFAIVAINAWNRLGITSRMEPGSLDAAYGLNKANLE

SEQ ID NO: 7285 - protein, 164 aa, Enterobacter cloacae
WRTTRGLPMSEEDLFSRRPMGMRMAMIVRQWRAVIDDAILDTGLTQSSWTVMMQLHQLGDNVSVSELAEVQGIELPPLMRTLTQLEKQGYLLRTVSPYDKRIRLLTLTPEGKAILERLSQVIETFQARVSQNIAPEHIDIFSATLNQIACNLRTIREEDNKTEK

SEQ ID NO: 7286 - protein, 247 aa, Enterobacter cloacae
RMMISWPLRSPHPGRRMLKTSLPSDNSAMLEKAIAAVAAAMADPSRVKMLCALMDGRAWTATELSAAADVAPSTASGHLARLVEGQLITCLSQGRHRYYRLAGHDVAALVEQMMGLSWSRITPPETSAPKAMREARTCYDHLAGAVAVQIYDFMQAEGWLEADGSALTLYGREQFLALGIPLSAHPRRKACCACLDWSERRFHLGGEAGAALLIHMESKGWIQRVAGYREVVVTASGKSAVRKHFSR

SEQ ID NO: 7287 - protein, 62 aa, Enterobacter cloacae
PHWHSEESIMEFYENRSKRPFIAFVWVAKTLRNWYRINRTRRILSQMSDEQLKDVGLSRYDV

SEQ ID NO: 7288 - protein, 482 aa, Enterobacter cloacae
QTGLTQPEEVYMHTIEQIFINGEFVTPHGTERFDLYNPATAQVIGQVRLADEVDAERAIAAAKAAFPAWSQTTKQERIAALKRMHAAVAARHDALLEAVIEEYGAPASRSAWMASYPAEVIAQAIEALEAFEFVTSAGAATVQMTPLGVAGLITPWNSDAGFICGKLAAALAAGCTAVIKPSEMSALQTQIVTEALRDAALPPGVFNIVTGRGETVGETLSRHPDVAKISFTGSTNTGKAILRNAAESFKRVTLELGGKSPTILLDDVDLEQAIPQVIQAGFMNSGQACVAGTRILVPYSRKAEIETALAQAVAAVKSGDPRNSTTDVGPMVSEKQWLRVQGYIRKGIEEGARLLAGGEGRPEGTRDGWFVRPTLFAGVNNRMTIARDEIFGPVLCVIPYQDEAEAIAIANDTEYGLSAMVLGGDVDRARRVAQQIVSGRVLVNTLAHEPKAPFGGFKHSGVGREMGEWGIRAFMEPRSVLG

SEQ ID NO: 7289 - protein, 132 aa, Enterobacter cloacae
SFALYRSIVLFHPAFSPQHHSGETIMIAVLFEAKAAPAHQARYLQLAAELKPLLADIDGFIDIERFQSLTTDGKILSLSWWRDEEAVRRWKQNVFHQAAQAEGRALIFSFYRIRVAQLVREYSSETGGHADV

SEQ ID NO: 7290 - protein, 358 aa, Enterobacter cloacae
DRKIMTPEQKFARWVRVSIASFLLMFVYFIVADIWIPLTPDSTVMRVVTPVSARVSGYVAAVHVHNNSQVKKGDLLFELDATPFRNKVEAAQIALEQARLSNDQLDAQIAAAQASLKTAVLTARNDKVTFDRYQKLSTLQNVSQADLDKVRTTWQSSEQSVSSIQANIHNLRIQRGERDEHRNVTLQKYRNALDEAELNLGWTKVYAEADGTVSNLQLSPGFYASSGSAALALVNTRIDIVADFREKSLRHTHQGTDAAVVFDAFPGHVFRAHVTSSDAGILAGQEAVNGQLSEPETSNRWVRDAQRMRIHVALDEALPKPLPTGARATVQLYNSEGPFARFFSGMQIHLVSLLHYVY

SEQ ID NO: 7291 - protein, 315 aa, Enterobacter cloacae
KRPQNNEESRMTMIKGITGSAVLLAALSLPLQAAEPVKVGSKIDTEGALLGNIILQVLESHGVKTVNKVQLGTTPVVRGAITSGELDIYPEYTGNGAFFFKDENDPAWKNAKAGYEKVKKLDAEKNKLVWLTPAPANNTWTIAVRKDIAEKGKLTSLDDLSRYLKEKGEFKLAASAEFIERADALPAFEKAYDFKLDQAQLLSLAGGDTAVTIKAAAQQTSGVNAAMAYGTDGPVAALGLQTLTDPKGVQPIYAPTPVVREAVLKAYPDIAEWLKPVFEKLDAKTLQQLNASIAVEGLDAKKVAADFLKQQGLVK

SEQ ID NO: 7292 - protein, 389 aa, Enterobacter cloacae
RDKAVPIKCHNRVLLLLACVAIAAVALPFVNVAPNRLVSGEPRALWQIWAFTPLLLGAALASTVALAFWPGRTALWLTFLLSEALFIVLFWSAGQAATQMAAVESPLARTSVGSGLWLWLALCLLVCSDAIRRLTPQPVWRWLLNAQFWVIPLLILFSGDLNQLSLLKEYVNRQEVFDNALAQHLTILFGTLIPALLLGVPLGMWCYRHTSRQGAVFTVLNVIQTIPSVALFGLLIAPLAGLVKSFPALAAAGIAGTGLTPALIALVLYALLPLVRGVVAGLSQVPPDVLESAHAMGMSARQCFWKIQLPLALPLLVRSLRVVTVQTVGMAVIAALIGAGGFGALVFQGLLSSALDLVLLGVVPTIALAVVLDALFALWLALLRRRAND

SEQ ID NO: 7293 - protein, 367 aa, Enterobacter cloacae
SGRAALEHWSSRGCSVARWIWCCWASCPQLRWRSYWMPCLPCGSRCSGEEPMIEFHDVSKTFAGRPAASHLNLHFAEGAFSILIGTSGSGKSTTLKMINRLVEHDSGTIRFAGEEIRSLPVLELRRRMGYAIQSIGLFPHWTVAQNIATVPQLEKWSRGKINERVDELMALLGLDASLRNRYPHQLSGGQQQRVGVARALAANPQVLLMDEPFGALDPVTRGALQAEMSRIHRILGRTIVLVTHDIDEALRLADRLVLMDHGEVVQQGTPLELLTSPANDFVREFFGRSELGVRLLSLRTVRDYLRPQDAQIGGEPLHDGMSLRDALSAFVARQCEVLPVADGQGTPCGTIHFRDLLAGEVTREVGP

SEQ ID NO: 7294 - protein, 256 aa, Enterobacter cloacae
ARPLYPNYLTIAAGGERMLRVLIVDDEPLARENLRVLLQEQSDIEVVGECANAIEGIGAVHKLRPDVLFLDIQMPRISGLEMVGMLDPEHRPYIVFLTAFDEYAVKAFEEHAFDYLLKPIEEKRLEKTLTRLRQERTAQDVTLLPEHQQPLKFIPCTGHSRIYLLQMDDVAFVSSRLSGVYVTSAEGNEGFTELTLRTLESRTPLIRCHRQYLVNMAHLKEIRLEDNGQAELVLRAGQTVPVSRRYLKSLKEAIGL

SEQ ID NO: 7295 - protein, 94 aa, Enterobacter cloacae
IRNTNHLVYRDNWNIQLTKTGFTNAAGHCLVMRTVFNGKPVALVVMDAFGKYTHFADASRLRTWIETGKVHPVPASALAYKKHKAEQMATAQND

SEQ ID NO: 7296 - protein, 796 aa, Enterobacter cloacae
PCKVFRLCGTLRFSHGLAGCFPRLLMRENNNMKWLCSVGVAVSLALQPALAEDLFGNHPLTPEARDAFVTDLLKKMTVDEKIGQLRLISVGPDNPKEAIREMIKDGQVGAIFNTVTRQDIRKMQDQVMELSRLKIPLFFAYDVVHGQRTVFPISLGLASSFNLDAVKTVGRVSAYEAADDGLNMTWAPMVDVSRDPRWGRASEGFGEDTYLTATMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTASDPEDAVRVALKSGINMSMSDEYYSKYLPGLVKSGKVTMAELDDAARHVLNVKYDMGLFNDPYSHLGPKDSDPADTNAESRLHRKEAREVARESLVLLKNRLDTLPLKKSGTIAVVGPLADSKRDVMGSWSAAGVADQSVTVLTGIKSAVGDNAKVVYAKGANVTDDKDIVTFLNQYEEAVKVDARTPKEMLDEAVNAAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGPLYPFGYGLSYTTFKVSDVKMSAPTLKRDGKVTASVEVTNSGKREGATVIQMYVQDVTASMSRPVKQLRGFEKVNLKPGETRTVSFPIDVNALKFWNQQMKYDAEPGKFNVFIGVDSARVNKAEFELQ

SEQ ID NO: 7297 - protein, 246 aa, Enterobacter cloacae
RVKWVRDPLLWLTGLFIALLYLMPHSAALFNALIPGLPRPVYQQESFVNLTLAHFWLVAVSSVIAIVLGTGAGIAVTRPAGREFRPLVETIAATGQTFPPVAVLAIAVPAIGFGQEPAIIALILYGVLPILQGTLAGIAAVPASALSVAEGMGMSAWQRLVKVELPLAAPVIIAGVRTSVIINIGTATIASTVGANTLGTPIIIGLSGFNTAYIIQGAILVALAAIVVDRLFERLAGYLSQHRREQ

SEQ ID NO: 7298 - protein, 567 aa, Enterobacter cloacae
NVRFVSMYEFNLVLLLLQQMCVFLVIAWLMSKTRLFIPLMQVTVRLPHKFLCYVVFSIFCIMGTWFGLHIEDSIANTRAIGAVMGGLLGGPVVGGLVGLTGGLHRYSMGGMTALSCMISTIVEGLLGGLVHSYMIKRGRPDKVFSPFTAGAITFVAEMAQMAIILLIARPFDDALHLVSSIAAPMMVTNTVGAALFMRILLDKRAMFEKYTSAFSATALKVAASTEGILRQGFNEENSMKVAQVLYKELDIGAVAITDREKLLAFTGTGDDHHLPGKPISSAYTLRAIETGEVVYADGNEVPYRCSLHPQCKLGSTLVIPLRGENQRVMGTIKLYEAKNRLFSSINRTLGEGIAQLLSAQILAGQYERQKALLTQSEIKLLHAQVNPHFLFNALNTLKAVIRRDSDQAAQLVQFLSTFFRKNLKRPSEIVTLADEIEHVNAYLQIEKARFQSRLQVSLSVPDELAYQHLPAFTLQPIVENAIKHGTSQLLGTGEIMISASRFNHHLVLDIEDNAGLYEASASGGLGMSLVDKRLRAHFGDDCGITVACEPDRYTRITLRLPLEENAC

SEQ ID NO: 7299 - protein, 174 aa, Enterobacter cloacae
GCKTDTLRAIASSTFEGSMLSNDILRSLRYTLKANNNDMVRILALSDMESTSAGFDTWMTKEDEEGFVRCPDIILSGFLNGLIYDKRGKDESAPELALERRVNNNTVLKKLRIAFCLKTDDILAIMTEQKFRVSMPEITAMMRAPDHKNYRECGDQFLRYFLRGLTQRVHNQKG

SEQ ID NO: 7300 - protein, 393 aa, Enterobacter cloacae
AFSQRGCCQPRGEDVYFHSLFWPAMLEGSNFRKPTNLFVHGYVTVNGAKMSKSRGTFIKASTWLNHFDADSLRYYYTAKLSSRIDDIDLNLEDFVQRVNADIVNKVVNLASRNAGFIAKRFDGVLSAELADPELYKTFTDAAAAVGEAWESREFGKAIREIMALADVANRYVDEQAPWVVAKQEGRDADLQAICTMGLNMFRVLMTWLKPVLPQLAARAEAFLNTELTWDAIQQPLLGHKVNTFKALYNRIEMKQVEALVEASKEEVKAAAAPVTGPLADDPIQETITFDDFAKVDLRVALIENAEFVEGSDKLLRLTLDLGGEKRNVFSGIRSAYPDPQVLIGRQTVMVANLAPRKMRFGISEGMVMAAGPGGKDIFLLSPDEGAKPGQQVK

SEQ ID NO: 7301 - protein, 274 aa, Enterobacter cloacae
FVQKRIKSSWFRKVGLQLSWGRASLGAKMALYTIGEVALLCDINPVTLRAWQRRYGLLKPQRTDGGHRLFNDADIDRIREIKSWIDNGVQVGKVKSLLSQYDPDTQHLWREQQETLLRLLQSGNLQRLRGWIKEQGRDYPAQTLITHLFIPLRRRLQCQQTTLQALLSMLDGVLINYISVCLASARNKNSKDALVIGWNVHDTTRLWLEAWIATQQGWRVDVLAHSLAQLRPELFEGQTLLVWCGEVPSASQQQLLTEWREHGYPVYSLGPNAS

SEQ ID NO: 7302 - protein, 640 aa, Enterobacter cloacae
PREAPGQTVRKAQCATKPENLAGLFSDFSHEYPTAQRLIALCFTARNLPHHKEWKMSSVRTDDNTTFINELSRLVGHSHLLTDPAKTARYRKGFRSGQGEALAVVFPGTLLELWRVLSACVAADKIILMQAANTGLTEGSTPNGNDYDRDIVIISTLRLDKLHLLDKGEQVLAFPGTTLYSLEKALKPLGREPHSVIGSSCIGASVIGGICNNSGGSLVQRGPAYTEMSLFARIDENGKLTLVNHLGIDLGVTPEQILSKLDDDRVKDEDVQHDGRHAHDHDYITRVRDINADTPARYNADPDRLFESSGCAGKLAVFAVRLDTFPAEKKQQVFYIGTNQPEVLTEIRRHILAEFTHLPVAGEYMHRDIYDIAERYGKDTFLMIDKLGTDKMPFFFTMKGRTDAMLEKVSLFKPHFTDRFMQKLGNVFPAHLPERMKTWRDKYEHHLLLKMAGDGIDEAQSWLTEFFKTADGDFFACTPEEGSKAFLHRFAAAGAAIRYQAVHSEEVEDILALDIALRRNDTEWFEHLPPEIDSKLVHKLYYGHFMCYVFHQDYIVKKGVDAHALKEQMLALLHERGAQYPAEHNVGHLYKAPETLKQFYRKNDPTNSMNPGIGKTTRKKYWKESAESEQHNTQASDELI

SEQ ID NO: 7303 - protein, 211 aa, Enterobacter cloacae
ALLKRTRVSACCQRNVSLAFQTRSGQNMSAVETFPETEIEVRDALPDDAHAISAIYAWHVLHGRASFEEVPPTVDEMRQRMKSVTDSGLPWLVALYRGIVVGYCYATFYRPRQAYRYTLEESIYVDASTTGRGFGSALLQALIARCEQGPWRQMIAVVGDGQNNPGSLRLHKKHGFEIVGQLRSVGYKKGDWRDTVMMQRPLNDGDWTLPE

SEQ ID NO: 7304 - protein, 299 aa, Enterobacter cloacae
NDVESADGDIHRCNIRRTIRSLVTGDRVVWRPGKEAAEGVTVKGIVEAVHERTSVLTRPDFYDGVKPIAANINQIVIVSAILPELSLNIIDRYLVACETLQVEPLIVLNKIDLLDDEAMAFVNEQMDIYRNIGYRVLMVSSRTKDGLKPLEDALTNRISIFAGQSGVGKSSLLNNLLGLQQEILTNDVSDVSGLGQHTTTASRLYHFPHGGDVIDSPGVREFGLWHLEPEQIFNGFVEFHDYLGACKYRDCKHDNDPGCAIREAVENGEIAETRFENYHRILESMDQVKTRKNFSDSDN

SEQ ID NO: 7305 - protein, 138 aa, Enterobacter cloacae
NHAKECMMTTKRKAYVRPMPSTWWKKLPFYRFYMLREGTAFPAVWFSLELMYGVYALKHGPEAWASFVGFLQNPIIVVLNLIVLAAALLHTKTWFELAPKAANIIVKGEKMGPEPVIKGLWAVTAVVSVVILFVALFW

SEQ ID NO: 7306 - protein, 417 aa, Enterobacter cloacae
QLMLNLTVCQAQSNPTDYACLMGPDTPLTRYYGRLLMMKKSLCCALLLGLSCSALAAPVSEKQLAEVVANTVTPLMKAQSVPGMAVAVIYQGKSHYYTFGKADIAANKPVTPQTLFELGSISKTFTGVLGGDAIARGEISLDDPVTRYWPQLTGKQWQGIRMLDLATYTAGGLPLQVPDEVTDNASLLRFYQNWQPQWKPGTTRLYANASIGLFGALAVKPSGMPYEQAMTTRVLKPLKLDHTWINVPKAEEAHYAWGYRDGKAVRVSPGMLDAQAYGVKTNVQDMANWVMANMAPEKVADASLKQGIALAQSRYWRIGSMYQGLGWEMLNWPVEANTVVEGSDSKVALAPLPAAEVNPPAPPVKASWVHKTGSTGGFGSYVAFIPEKQIGIVMLANKSYPNPARVEAAYHILEALQ

SEQ ID NO: 7307 - protein, 347 aa, Enterobacter cloacae
NRPLFSGSGSVMPDQERQNNGLEATLLNSFKLSLQYILPKLWLTRLAGWGASKRAGWLTKLVIDLFVKYYKVDMKEAQKPDTASYRTFNEFFVRPLRDEVRPLNTDPNVLVMPADGVISQLGKIENDKILQAKGHNYSLEALLAGNYIMADLFRNGTFATTYLSPRDYHRVHMPCNGILREMIYVPGDLFSVNHLTAQNVPNLFARNERVICLFDTEFGPMAQILVGATIVGSIETVWAGTITPPREGVIKRWTWPAGEEEGSVALLKGQEMGRFKLGSTVINLFAPGKVNLVDELESLSVTKLGQPLAVSTEVFATPDVAPAPLPEDEIKAEHDASPLVDDKKDEG

SEQ ID NO: 7308 - protein, 613 aa, Enterobacter cloacae
TSFSSSRCGKTKIWRNVVQTFQADLAVIGAGGAGLRAAIAAAQANPNAKIALISKVYPMRSHTVAAEGGSAAVAQDHDSFEYHFHDTVAGGDWLCEQDVVDYFVHHCPTEMTQLEQWGCPWSRRPDGSVNVRRFGGMKIERTWFAADKTGFHMLHTLFQTSLQFPQIQRFDEHFVLDILVDDGHARGLVAMNMMEGTLVQIRANAVVMATGGAGRVYRYNTNGGIVTGDGMGMALSHGVPLRDMEFVQYHPTGLPGSGILMTEGCRGEGGILVNKNGYRYLQDYGMGPETPLGEPKNKYMELGPRDKVSQAFWHEWRKGNTISTPRGDVVHLDLRHLGEKKLLERLPFICELAKAYVGVDPVKEPIPVRPTAHYTMGGIETDQQCETRIKGLFAVGECSSVGLHGANRLGSNSLAELVVFGRMAGERAVERAATAGEANSAALDAQVVDVEKRLKDLVNQEGNENWSKIRDEMGLSMEEGCGIYRTPELMQKTVDKLAELQERFKRVRITDTSSVFNTDLLYTIELGHGLNVAECMAHSALARKESRGAHQRLDEGCTERDDVNFLKHTLAWRDADGTTRLDYSDVKITTLPPAKRVYGAEAEAADKKEKANG

SEQ ID NO: 7309 - protein, 138 aa, Enterobacter cloacae
QQLSLWSFCLSHCFGKETTVINPNPKRSDEPVFWGLFGAGGMWSAIIAPVIILLVGIMLPLGLFPGDALSYERVLAFASSFIGRVFIFLMIVLPLWCGLHRIHHAMHDLKIHVPSGKWVFYGLATILTVVTLIAVVTI

SEQ ID NO: 7310 - protein, 1160 aa, Enterobacter cloacae
PNSASLWQYRRRSLQHQTLRQPRCRKMRSKPSTTPARWLTTKKTKANNRRIADVRPIIVLLMAWCLSMGAYAATAPDAKQITQELEQAKAAKPAQPETVESLQSALNALEERKGSLERAQQYQQVIDNFPKLSQTLRSQLNNLRDEPRQVPAGMTSEALNQEILQVSSQLLEKSRLAQQEQERAREIADSLSQLPQQQTDARRQLNEVERRIGTQTGSTPQNQAQNLGLQAESARLKALVDELELAQLSANNRQELSRMRSELAQKQSQQLDAYLQALRNQLNSQRQREAERALESTELLAENSANLPDSIVAQFKVNRELSAALNQQAQRMDLVASQQRQATNQTLQVRQALNTLREQSQWLGSSNLLGEALRAQVARLPEMPKPQQLDTEMAQLRVQRLHYEDLLNKQPQIRQIRQADGQPLTGEQSRILEAQLRTQRELLNSLLQGGDTLILELTKLKVSNSQLEDALKEVNEATHRYLFWTSDVRPMTFAWPIEIVQDLRRLISLDTFSQLGLASVMMITSKETIFPLLGALILVGFSIYSRRHFTRFLERSSARVGKVTQDHFWLTLRTVFWSILVASPLPVLWMTLGYGLREAWPYPLAVAIGDGVTATVPLLWVVMICATFARPNGLFIAHFGWPRNRVARAMRYYLMSIGLIVPLIMALIMFDNLNDREFSGSLGRLCFMLICGALAVVTLSLKRAGIPLYLDKTGSGDNMLNRLLWNLLLSAPLAAMLAAAVGYLATSQALLARLETSVAIWFLLLVVYHVIRRGMLIQRRRLAFDRAKHRRAEILAQRARGEEEPNHVNSTEGTTDADDVELDLDAISTQSLRLVRSILMLVALLSVIYLWSEIHSAFGFLENISLWDVTSTVQGVESLEPITLGAVLIAILVLIITTQLIRNFPALLELALLQHLDLTPGTGYAITTITKYLIMLFGGLVGFSMIGIEWSKLQWLVAALTVGLGFGLQEIFANFVSGLIILFEKPIRIGDTVTIRDLTGSVTRINTRATTISDWDRKEIIVPNKAFITEQFINWSLSDSVTRVVLTVPAPSDANSEEVTQILYTAAERCSLVIDNPPPEVFLVDLQQGIQIFELRIYAAEMGHRMPLRHEIHQLILAGFREHGIDMPFPPFQMRLETLDGRKTGRTLTSAARTRPAGSL

SEQ ID NO: 7311 - protein, 269 aa, Enterobacter cloacae
KSPRCHRRNACTVQKQKPPIRRRRRMAEMQKLKVEVVRYNPEVDAAPHSAFYEVPYDEQTSLLDALGYIKDNLAPDLSYRWSCRMAICGSCGMMVNKVPKLACKTFLRDYTKGIKVEALGNFPIERDLVVDMTHFIESLEAIKPYIIGNPRTPDQGPNTQTPAQMAKYHQFSGCINCGLCYAACPQFGLNPEFIGPAAITLAHRYNEDSRDHGKKERMAQLNSQNGVWTCTFVGYCSEVCPKHVDPAAAIQQGKVESSKDFLIATLKPR

SEQ ID NO: 7312 - protein, 300 aa, Enterobacter cloacae
LLIFLTEETMTRSYLPLNSLRAFEAAARHLSFTHAAIELNVTHSAISQHVKTLEQHLNCQLFVRVSRGLMLTTEGENLLPVLNDSFDRIAGMLDRFANHRAQEKLKIGVVGTFATGVLFSQLEDFRRGYPHIDLQLSTHNNRVDPAAEGLDYTIRYGGGAWHGTEAEFLCHAPLAPLCTPDIAASLHSPADILRFTLLRSYRRDEWTAWMQAAGEHPPSPTHRVMVFDSSVTMLEAAQAGVGIAIAPVDMFTHLLASERIVQPFATQIELGSYWLTRLQSRAETPAMREFSRWLVEKMKK

SEQ ID NO: 7313 - protein, 326 aa, Enterobacter cloacae
LMSETATWQPSASIPNLLKRAAIMAEIRRFFADRGVLEVETPCMSQATVTDIHLVPFETRFVGPGHSQGMNLYLMTSPEYHMKRLLAAGCGPVYQLCRSFRNEEMGRHHNPEFTMLEWYRPHYDMYRLMNEVDDLLQQVLDCAEAETLSYQQAFQRHLEIDPLSADKTQLREVAAKLDLSNVADNEEDRDTLLQLLFTFGVEPQIGKDRPTFVYHFPASQASLAQISTEDHRVAERFEVYFKGIELANGFHELTDAREQQQRFEQDNRKRNARGLPQQPIDTNLLEALKAGLPDCSGVALGVDRLVMLALGAEQLGDVIAFTVDRA

SEQ ID NO: 7314 - protein, 520 aa, Enterobacter cloacae
PQYLSGHLLPSAQFNSVSDGYMSHSLKKMTLTGLILMIFTSVFGFANSPSAFYLMGYSATPFYIVSALFFFIPFALMMAEMGSAYRKEEGGIYSWMNNSVGPRYAFIGTFMWFSSYVVWMVSTAAKVWVPFSTFLFGADKTQVWSLAGLSSTQVVGILAVCWMVVVTLVASKGINKIARITAVGGISVMCLNLVLLLVSIAILCLNGGHFAQEVNFVSSPNPGYQSGLAMLSFVVFAIFAYGGIEAVGGLVDKTENPEKNFAKGIIFAAIVISIGYSLAIFLWGVSTNWQQVLSNNTTNLGNITYVLMKSLGVTLGNAMDLAPETSATLGIWFARITGLSMFLAYTGAFFTLIYSPLKAIIQGTPKALWPARMTQLNAAGMPANAMWMQCMLVCVFILLVSFGGDTASAFYNKLTLMANVSMTLPYLFLTLAFPFFKAKQDLERPFVIFKTRAATLLATTVVVLVVAFANIFTVIQPVVEANDWNSTLWMVGGPIFFSLLAMGIYEHYRRRSTACVAEVA

SEQ ID NO: 7315 - protein, 213 aa, Enterobacter cloacae
NMAKYPISNKADNDRIQIRSFWISERKAPYVYSFLKKTELCHRGDQLDLIRSAISTGLVLNNLFPDLANFINGLNERLTLADLNRFLNDGNTIDTEPKPPINVLLENVLDQKFKEYLTPLQLDNSKQDSVSVKETFLVQKEHACFGVKIENEGSDTSIPSESPLSSGASKISKEKSISSVVPVLEKVSDENQTASISIKSKAKANKRLATLAR

SEQ ID NO: 7316 - protein, 101 aa, Enterobacter cloacae
LHKISRRVRAHMSHTIRDKQKLKARTSKIQGQVAALKKMLDEPHECAAVLQQIAAIRGAVNGLLREVIKGHLTEHIVHESEEQKREEDLDVVLKVLDSYIK

SEQ ID NO: 7317 - protein, 436 aa, Enterobacter cloacae
EWKRSYLYRQYLASECSERSYQHIFCKPASGRRKKMMIENDKEKSLNDATSPEVQNDIRSESTEKSKEMGRSRYSSIAMIDYFNAIERLCEEKKINPENIDLSFKVHWLRNAVGGSFARSQEMFAEYQKYVKEVPEEARYLDIPDEVKVALGDIISYITWHYRRSYTAIQSDSVKKAEARSMQLEEEVTQLLQRLEQSATDMDELKLENQALQGRLEIRDSTVKELETRLNVAEAELETCHHQLDSTRHELSLAQQSNDSLSQQLAERKTEIAGHLEYQKKLNEEINTQRSDNAGLSRQCDQLSQTVSDTKAERDRFEQELIAAQNLCAELKSALSGKEGDLVAVNAELTELHKLNESLSADLKKVTLVSQGYEAEVAEQSSELKTLQSKVMKLEATLEAEKTISESLKGTIDTLTGAMAGGGTGKSKQPRSRKTS

SEQ ID NO: 7318 - protein, 254 aa, Enterobacter cloacae
  UNSURE (20)
FSPKTRKLGRLKVHQQLHVXGLVPQDVHLFVTVPLSQFYTALGETNIENIQRKKDNLMKPVERYLDGKRYSFNVLSVTVFPESLPAVTRADEIEDIASFESSLVIDLGGTTLDVASITGQLEQISKVKGFDRIGCSIVYDEISRYLESEKLNTSNAYIHHLVDNRHDKSALKVAEDKRDGVFDAVNSAVQKLQSKVIRAVTQVEERPHNVFLVGGGSYLIETAIRKHFETAKVIMVDNPQFALSLAIADTIYSE

SEQ ID NO: 7319 - protein, 471 aa, Enterobacter cloacae
VTIYRPTVAQEMGGDHSINKAAVMLTVWWLSSFILISTLNGYFDNQDRDFLTGKLQLTEEFLKTETFRNKTDIKSLSEKINDAMVGHNGLFISIKNMENEKIVELYAKNSVVPAVLLNKSGDILDYMIQTEENNTVYRSISRRVAVTPEQGKSKHVIITVATDTGYHTLFMDKLSTWLFWFNIGLVFISVFLGWLTTRIGLKPLREMTSLASSMTVHSLDQRLNPDLAPPEISETMQEFNNMFDRLEGSFRKLSDFSSDIAHELRTAVSNLMMQTQFALAKERDVSHYREILFAYLEELKRLSRMTSDMLFLARSEHGLLQLDKHDVDLAAELNELRELFEPLADETGKTITVEGEGVVAGDSDMLRRAFSNLLSNAIKYSPDNTCTAIHLERDSDCVNVMITNTMSGQVPANLERLFDRFYRADSSRVHNTEGAGLGLSITRSIIHAHGGELSAEQQGREIVFSVRLLMD

SEQ ID NO: 7320 - protein, 274 aa, Enterobacter cloacae
VIVVSYQGSEPVPASRTGQLISARDMAMQKFEEGMRLISEASELCGLSLFTSRIMQPNAFGLPSSLDRTIEEGRKEIDRKTWKRLFEEIGMDRYWNHKQKEAFNESLRTDPPVASLEIVKGTLQHALANRRDTLAEGFVDVLNKLDRSFKSNARQYTMPKKLVLRGIFPGVNVLRYNGFSQDNHFCLRDFENIVCICSDTPTPATGGGLSMVDRLTAMRNTDFTGEVCDENGWRCRLFENGNVHICIDSISLLNALNDLISIYFANQLPAAGKK

SEQ ID NO: 7321 - protein, 148 aa, Enterobacter cloacae
VAAKTNKDDTFTVLGSEMTAIDDFRIIRARAFAVCDVVAKLIERFHDDVKGITLIVTLQIFYVFQNKNCRLFCPDDPGHIKEERTLSVALETVFATHRVLFTDTGDAEWLAWKSRKKNIMIRDRGIDKFVCLVISNLGPVAKSDVTDV

SEQ ID NO: 7322 - protein, 84 aa, Enterobacter cloacae
VRNVVQRQVCTDDFMCVAVNCQMQLTPYTAAFLAMLFDFPLAFTEDLQPGGINYQVCDFTPGGRFETDINRLCPPADTAVIRAA

SEQ ID NO: 7323 - protein, 155 aa, Enterobacter cloacae
LFGYENTGDPTMKKILVSFVAIMAVASSAMAAETMNMHDQVNNAQAPAHQMQSTSEKSAVQGDSMTMMDMSGHDQAAMSHEMMQNGNASAHQDMAEMHKKMMKGKPGATNESATSFSEMNEHEKAAVVHEKANNGQSSVIHQQQAEKHRSQITQN

SEQ ID NO: 7324 - protein, 194 aa, Enterobacter cloacae
LVKILPVNRLVDTCLYSTNSGEMMFFFTKLLLPIMIVVFPVASWGNSTTFEAKVVKIVDGDTITALDAQNTTIKIRMYGIDAPESKQAFGQKAKQALTTAIATKIVTVIDHGTDIYGRMLGTIWLDGYDINASMVDSGYAWVYRFEDNAIVPGYIKYESAAQKEAKGLWADTNPVPPWQWRQANEKPRKVKGKK

SEQ ID NO: 7325 - protein, 511 aa, Enterobacter cloacae
SECHVHAPTGNGVTLNTSQVSYYMTQRKKGATQHISAMKAGISVRSGRRIEKDQWSKAGERHWRTRKDPLEAVWDSELVPLLKERPALMPTTLLEMLQDKYPGQYPNNLRRTMQRRVREWKLQYGAEQEVMFRQRHQPGLRGLSDFTELKGVVVTIAGKLLAHKLYHFRLEWSHWSWMRVVLGGESFSALAEGLQEALGQLGGVPSEHKTDSLRAAWKHRGEDGQRELTERYAELCRHYGMQGVHNNAGRGHENGSVESAHGHLKRRIRQALILRGSNDFSTLEEYQAFITQQVMRHNRNNQDLVKEEQPHLKPLPLRRSADYDELTVRVSSSSTINVRHVIYSVPSRLVGQLLRVRLWDDRLSCYVGSNEVMNCPRVRPEKGKTRARRIDFRHVIDSLAKKPGAFCHATLRNDILPDDEWRKLWRRLCNHLEPEMAGRLMVHALKLAAGYDDISVVARGMEQMLNTPGELDLNRLMRFLGIKEKELPPVSVVQHNLSSYEQLLRGKGGLQ

SEQ ID NO: 7326 - protein, 366 aa, Enterobacter cloacae
WNGRLPSLVPQWDDKSSLIERSAAIMNVKTIGIDLAKNVFQIHGVDEHGKRLFNKQLRRAQMASFFANIPPCLIGMEACASAHFWANKLISMGHNVKLMAPQFVKPYVKTNKHDAADAEAICEAVTRPNMRFVPVKTAEQQAVLALHRSRQSFIKQRTAQANQIRGLLAEFGIVVPRGIQQLQRRLPELVEDADNPLPVLFRTQLSLLQHHMAYLFDVIATLDKQIEQCYRQNALCQRIGKIPGIGPVTASALIATIGKANNFENGRQLAAWLGLVPRQHSSGGKQVLLGISKRGDTYLRTLLIHGARAVLQSAKHKQDAVSSWANQLMARRNNNIASVALANKNARTVWALLAKEREYCAPIISA

SEQ ID NO: 7327 - protein, 329 aa, Enterobacter cloacae
INRTFAELKDQITHLPDNADRSVAKQKFKITNWPTYNKALINRGSITFWLDDEAIQAWYESATPSSRGRPQRYSDLAITTVLVIKRVFRLTLRAAQGFIDSIFSLMNVPLRCPDYSCVSRRAKSVNVSFKTPTRGEIAHLVIDSTGLKVFGEGEWKVKKHGQERRRIWRKLHLAVDSNTHEIICADLSLNNVTDSEAFPGLIRQTHRKIRSAAADGAYDTRLCHDELRRKKISALIPPRKGAGYWPGEYADRNRAVANQRMTGSNARWKWTTDYNRRSIAETAMYRVKQLFGGSLTLRDYDGQVAEAMALVRALNKMTKAGMPESVRIA

SEQ ID NO: 7328 - protein, 493 aa, Enterobacter cloacae
SKLSVLIYLKDIIPERVWMKRYTHDLETDLNDVDKTPSLIHKTLLTASTIYDLKYLAQVLNDENGSNWSRASLKRQVTCIPEHCDLSIADGRYLQTLIPSRPADYEDRHFSFIDLFAGIGGLRSGFDAIGGKCLFTSEWNTYSSRTYRANWYCDENEHRFNSDIRDITLSNRPEVTDDEAYKFIDASIPDHDVLLAGFPCQPFSIAGVSKKNSMGRKHGFECDTQGTLFFDVARIIRAKQPAIFVLENVKNLKSHDKGNTFNIIMKTLDELGYDVANSESTGADDPKVIDGRHFRPQHRERIVLIGFRRDLRLKDGFTLRDIKDFYPDKRPSLSDLLDPSVDSKYILSPKLWEYLYNYAKKHAAKGNGFGFGLVDPSNVNSVTRTLSSRYMKDGSEILIDRGWSHELGETDFHNTYNMDRRPRMLTPRECSRLMGFDKPGESVFRIPVSNTQAYRQFGNSVVVDVFAAVAKLLKSRIEFAASQRLRQFYDEVS

SEQ ID NO: 7329 - protein, 261 aa, Enterobacter cloacae
AVAAWKRRSAVSNIHHLERSLRKLRLTRVGAEWHALEKRALAEGWTPSRYLLTLCNEELLWRESEKLRRYKKEARLPVAKTLGEYDFAQVPELNAAQFRQLCETTDWVDAGENVLLFGASGLGKSHLAAAIVDGVVGQGYRARFYSAGELLQELRKARAQLKLNELLLKLDRYRVIVVDDLGYVKRDNAETGVLFELIAHRYERGSLVITSNHPFSTWGSIFVDETMAVAAADRLIHHGYMFELKGESYRKKTAKAVTSAT

SEQ ID NO: 7330 - protein, 376 aa, Enterobacter cloacae
PRMILMNEFTTLLQQGNAWFFIPSAILLGALHGLEPGHSKTMMAAFIIAIKGTVRQAVMLGVAATLSHTAVVWLIAFGGMYISNKFTAESAEPWLQMVSSVIILGTAFWMFWRTWSGEKNWLEGMQENEHHHHDETRLIDTGHGKVELSIFEEGQLPHWRLRTLSGQRWASEDISLTTLRENSTISQTFEFVDHGDYLESTSPIPEPHSFNVRLSLGHRGHVHDYDVAFAEHDHDHDHSELDGLDVNSKEYQDAHELAHANDIKRRFDGKEVTNGQILIFGLTGGLIPCPAAITVLLICLQLKALTLGATLVVCFSIGLALTLVTVGVGAAISVRQVAKRWSGFNTIARRAPYISSALIAAVGIYMGIHGWNGLVH

SEQ ID NO: 7331 - protein, 341 aa, Enterobacter cloacae
NSCAVDQRVYLKKGLLMLLATALLIIGLLLVVYSADRLVFAASILCRLIGMPPIIIGMTVVSVGTSLPEIIVSVSASLHGQVDLAIGTAIGSNIVNILLILGLAALLHPFRVHSDVLRRELPLMLVVSLLAGYVLYDGVLSVGDGIFLLALAVIWLLYSVKIARLAEKQGNDSLTREHLAELPREGTLPVALLWLGVALIIMPMATRMVVDNATVLANAFAMSELTIGLTVIAIGTSLPELATAIAGARKGEDDIAIGNIIGSNIFNIAIVTGLPALISPGPFNPMVFTRDYGVMLLVSVIFALLCWRRKEQIGKGAGALLTGGFIVWLAMLYWLSPLLSG

SEQ ID NO: 7332 - protein, 201 aa, Enterobacter cloacae
SAARWRSVMKDKTMSNAGASLATCYGPVSAHMMSKAENIRLLILDVDGVLSDGLIYMGNNGEELKAFNVRDGYGIRCALTSGIEVAIITGRKAKLVEDRCETLGITHLYQGQSDKMVAFRDLLGKLAIAPENVAYVGDDLIDWPVMAEVGLSIAVADAHPLLIPRADYVTHIHGGRGAVREVCDLLLLAQGKLDEAKGQSI

SEQ ID NO: 7333 - protein, 191 aa, Enterobacter cloacae
LKRLEPPMKFKTNKLSLKVVIASALLAASLPALAVTGDTEQPIHIESDTQSLDMQGNVVTFTGNVVVTQGTIKINADKVVVTRPGGEQGKEIIDGYGNPATFYQMQDNGKPVKGHASHMHYELAKDLVILTGNVYLEQLDSNIKGDKITYLVKEQKMQASSEKGKRVTTVLVPSQLQDKNNGQAPAKKKSN

SEQ ID NO: 7334 - protein, 243 aa, Enterobacter cloacae
FVMATLTAKNLAKAYKGRRVVEDVSLTVNSGEIVGLLGPNGAGKTTTFYMVVGIVPRDAGNIIIDDEDISLLPLHARARRGIGYLPQEASIFRRLSVFDNLMAVLQIRDDLTSEQRTDRANELMEEFHIEHLRDSLGQALSGGERRRVEIARALAANPKFILLDEPFAGVDPISVIDIKRIIEHLRDSGLGVLITDHNVRETLAVCERAYIVSQGHLIAHGTPQQILEDEHVKRVYLGEDFRL

SEQ ID NO: 7335 - protein, 138 aa, Enterobacter cloacae
PPCCPIRVLWWHVVLSRSIESLYPFRRLTSVNNWFDTTDKEDTMQLNITGHNVEITEALRDFVNTKFAKLEQYFERINQVYVVLKVEKVTHISDATLHVNGGELHASAEGQDMYAAIDGLIDKLARQLNKHKDKLKQH

SEQ ID NO: 7336 - protein, 123 aa, Enterobacter cloacae
TSFGLHCRTAGRLLPLTRKERSVPSSHAGKTQNMTVKQTVEITNKLGMHARPAMKLFELMQGFDAEVLLRNDEGTEAEANSVIALLMLDSAKGRQIEVEATGPQEEEALAAVIALFNAGFDED

SEQ ID NO: 7337 - protein, 296 aa, Enterobacter cloacae
RRWPRIRPAPWVKTGGGKRIRPMIAILAARAVGYQGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCSEAEEKGLQDYGRYLGTAFQLIDDLLDYSADGETLGKNVGDDLNEGKPTLPLLHAMRNGTPEQAKMIREAIEQGNGRHLLEPVLETMAICGSLEWTRQRAEEEADKAIAAIQVIPDSPWRDALIGLAHIAVQRDR

SEQ ID NO: 7338 - protein, 113 aa, Enterobacter cloacae
CCLFTRNDVDDNEHKDSIMDTKFIDWHSADIIAALRKKGTSLAAESRRHGLSSSTLANALTRPWPKGELIIATALDTHPWVIWPSRYHDPITHEFIDRTRMMRQSKTKKAHQD

SEQ ID NO: 7339 - protein, 353 aa, Enterobacter cloacae
RVDLSYGWRCCTGSRHFSLGKRKRIMSQIELQPGFDFQKAGKDVLEIEREGLAQLDQYINQDFSLACEKMFYCAGKVVVMGMGKSGHIGRKMAATFASTGTSSFFVHPGEAAHGDLGMVTPQDVVIALSNSGESNEILALIPVLKRLHVPLICMTSRPESSMARAADIHLCVKVPKEACPLGLAPTSSTTAALVMGDALAVALLEARGFTPEDFALSHPGGALGRKLLLRVNDIMHTGDEIPHVSKEASLRDALLEITRKNLGMTVICDDLMKIQGIFTDGDLRRVFDMGVDVRTLGIADVMTPGGIRVRPGTLAVDVLNLMQSRHITSVMVADGDQLLGVVHMHDLLRAGVV

SEQ ID NO: 7340 - protein, 168 aa, Enterobacter cloacae
RLGEIMINNDSALQLSNVLNQDCTRSGVHCQSKKRALEIISELAAKQLGLPPQIVFEAILTREKMGSTGIGNGIAIPHGKLEEDTLRAVGVFVQLETPIAFDAIDNQPVDLLFALLVPADQTKTHLHTLSLVAKRLADKTICRRLRSAQSDEELYQIITEAEGNQDEA

SEQ ID NO: 7341 - protein, 299 aa, Enterobacter cloacae
SGKGLQNGCPEEKRNMVLMIVSGRSGSGKSVALRALEDMGFYCVDNLPVVLLPDLARTLADRQISAAVSIDVRNMPESPEIFEQAMNSLPECFSPQLLFLDADRNTLIRRYSDTRRLHPLSSKNLSLESAIDKESDLLEPLRSRADLIVDTSEMSVHELAEMLRTRLLGKRERELTMVFESFGFKHGIPIDADYVFDVRFLPNPHWDPKLRPMTGLDKPVAAFLDRHTEVHNFIYQTRSYLELWLPMLETNNRSYLTVAIGCTGGKHRSVYIAEQLADYFRSRGKNVQSRHRTLEKRKT

SEQ ID NO: 7342 - protein, 197 aa, Enterobacter cloacae
GERAIDMSKTRRWVIILLALVALILIGVNLADRDDTQAEVVNTSDPTYKSDHSDTVVYSPEGALNYRLVAQHVEYFSDDGTSWFTQPVLTTFDTDKVPTWSIKSDRAKLTNDRMLYLYGHVEVNALTADAQLRKITTDNAQINLVTQDVTSQDLVTLYGTTFNSSGLRMRGNLRSKNAELIEKVRTSYEIQNKQTQP

SEQ ID NO: 7343 - protein, 490 aa, Enterobacter cloacae
RLSHAEPEKNALNMKQGLQLRLSQQLAMTPQLQQAIRLLQLSTLELQQELQQALDSNPLLEQTDLHDEVDAQQTQDTETLDSVDALEQKEMPDELPLDASWDEIYTAGTPSGTRADYQDDELPVYQGETTQSLQDYLMWQVELTPFSDTDRAIATSIVDAVDDTGYLTVTLDEILESIGDDEIELEEIEAVLKRVQRFDPIGVAAKDLRDCLLIQLSQFAKETPWIDEARLIISDHLDLLANHDFRTLMRVTRLKEEVLKEAVNLIQSLDPRPGQSIQTSEPEYVIPDVLVRKHNGRWVVELNADSIPRLQINQQYASMCTSARNDADNQYIRSNLQEARWLIKSLESRNDTLLRVSRCIVEQQQAFFEQGEEFMKPMVLADIAQAVEMHESTISRVTTQKYLHSPRGIFELKYFFSSHVNTEGGGEASSTAIRALVKKLIAAENPAKPLSDSKLTTMLSDQGIMVARRTVAKYRESLSIPPSNQRKQLV

SEQ ID NO: 7344 - protein, 277 aa, Enterobacter cloacae
IDLSADSGSSLMKTPVMQVALSVMKTAIPLVLLTMAIGEWVAPQGEQMARNYRAQAMYGGSLLSTQQGLWAKDGQNFVYIERVKGDDELGGVSIYAFNNDRRLQSVRYAASAKFDANNKLWRLSQVDESDLTNPKQITGSQTVSGTWKTNLTPDKLGVVALDPDALSISGLHNYVKYLKSSGQDAGRYQLNMWSKIFQPLSVAVMMLMALSFIFGPLRSVPMGVRVVTGISFGFVFYVLDQIFGPLTLVYGIPPIIGALLPSASFFLISLWMLLKRS

SEQ ID NO: 7345 - protein, 166 aa, Enterobacter cloacae
KIKKSTSRPEWTMCSASRWRYLPLTAMIKKFWDTCDEEESTMTSVDSAKAQTILDTAMLEQYIDLVGPKLITDGLAVFEKMMPGYLNVLESNLTARDQKGIVEEGHKIKGAAGSVGLRHLQQLGQQIQSPDLPAWEDNVGDWVEEMKQEWQNDVAVLKAWVDARKK

SEQ ID NO: 7346 - protein, 252 aa, Enterobacter cloacae
KAGGQSAGSYRMSRKLSPGGWLKRILLRIVLVLAVFWGGGIALFSILPVPFSAVMAERQISAWLSGDFGYVAHSDWVGMDEISPWMGLAVIAAEDQKFPEHWGFDVAAIEKALDHNERHENRVRGASTLSQQTVKNLFLWDGRSWVRKGLEAGLTLGVETVWSKKRILTVYLNIAEFGDGVFGVEAASQRYFGKPASRLTMSEAALLAAVLPNPLRFKASTPSGYVRSRQAWIMRQMRQLGGEGFMERNNLM

SEQ ID NO: 7347 - protein, 265 aa, Enterobacter cloacae
GVKPLMLLNALAGLGHRGLKTISTFGRAGLMLFNALVGKPEFRKHAPLLVRQLYNVGVLSMLIIIVSGLFIGMVLGLQGYLVLTTYSAETSLGMLVALSLLRELGPVVAALLFAGRAGSALTAEIGLMRATEQLSSMEMMAVDPLRRVISPRFWAGVISLPLLTILFVAVGIWGGALVGVNWKGIDAGFFWSAMQDAIDLRMDLVNCLIKSVVFAVTVTWIALFNGYDAIPTSAGISRATTRTVVHSSLAVLGLDFVLTALMFGN

SEQ ID NO: 7348 - protein, 118 aa, Enterobacter cloacae
WPDGSASVHLSSENYPGREEVMSQQLSWARDGETLTLTGELDQDLLNPLWDARHNAMQGVTLIDLHGVTRVDTAGIALLAHLVATGKKQGSSVTLTGVSDNVITLAQLYNLPEDVLPR

SEQ ID NO: 7349 - protein, 126 aa, Enterobacter cloacae
FFQYVTSESPDSLRVGAFCLFKTAPLCSKMLSLFSLSDDVDPMENNEIQTVLMNALSLQEAHVSGDGSHFQVIAVGEMFDGMSRVKKQQAVYAPLMEYIADNRIHALSIKAFTPQEWARDRKLNGF

SEQ ID NO: 7350 - protein, 233 aa, Enterobacter cloacae
SEFLMCFSELLRRIVRMKKVGVVLSGCGVYDGSEIHETVLTLLALSRQGADVICFAPDKTQADVMNHLTGEPMAESRNVLIEAARIVRGDIHPLAQADAAELDALIVPGGFGAAKNLSTFATEGAACHVDPDLKALSLAMHAAGKPQGFICIAPAMLPKIFDFPLRLTIGTDIDTAEIIEDMGGEHVPCPVDDIVVDEDNKIITTPAYMLAQNIAEAAAGIEKLVDRVLVLTE

SEQ ID NO: 7351 - protein, 188 aa, Enterobacter cloacae
CLGIEFMQTRKNEIWVGVFLLLALLAALFICLRAADITSVRAEPTYRIYATFDNIGGLKARSPVRIGGVVIGRVADITLDEKTYLPRVAMDIEERYNHIPDTSSLSIRTSGLLGEQYLALNVGFEDPELGTTILKDGSVIQDTKSAMVLEDMIGQFLYNSKGDDKKSDDAPAQSEDHTNVEPTPGATN

SEQ ID NO: 7352 - protein, 217 aa, Enterobacter cloacae
FQEKLFMFKRLLMVAMLVIAPLTAAHAADQSNPYKLMNEAAKKTFDRLKNEQPKIRSNPDYLRDVVDQELLPYVQIKYAGALVLGRYYKDATPAQREAYFAAFREYLKQAYGQALAMYHGQTYQIAPEQPLGDATIIPIRVTIIDPNGRPPVRLDFQWRKNSQTGNWQAYDMIAEGVSMITTKQNEWSDLLRTKGIDGLTAQLQSISRQKITLDEKK

SEQ ID NO: 7353 - protein, 658 aa, Enterobacter cloacae
VLLSDKVVKGSSMKQIRMLAQYYVDLMMKLGLVRFSMLLALALVVLAIVVQMAVTMVLHGQVESIDVIRSIFFGLLITPWAVYFLSVVVEQLEESRQRLSKLVDKLEEMRERDLKLNVQLKDNIAQLNQEISDREKAEAERQTTLEQLKIEMKEREVTQIQLEQQSSFLRSFLDASPDLVFYRNEDKEFSGCNRAMELLTGKSEKQLIHLKPQDVYSEEAAAKVMETDEKVFRHNVSLTYEQWLDYPDGRKACFEIRKVPYYDRVGKRHGLMGFGRDITERKRYQDALERASRDKTTFISTISHELRTPLNGIVGLSRILLDTELTSEQEKYLKTIHVSAVTLGNIFNDIIDMDKMERRKVQLDNQPVDFTGFLADLENLSGLQAQQKGLSFVMEPTLPLPHKVVTDGTRLRQILWNLISNAVKFTQKGQVAVRIRYDEGDMLHFEVEDSGIGIPQEEQDKIFAMYYQVKDSHGGKPATGTGIGLAVSKRLAKSMGGDITVASQPGKGSTFTLTVHAPAVAEEVEDTFENDDMPLPALHVLLVEDIELNVIVARSVLEKLGNSVDVAMTGKAALEMFTPGEYDLVLLDIQLPDMTGLDISRELTRKYAPDELPPLVALTANVLKDKKEYLEAGMDDVLSKPLAVPAPDGDDQEVLGYL

SEQ ID NO: 7354 - protein, 270 aa, Enterobacter cloacae
MSQTMANIVDVRGVSFSRGNRLIFDDISLTVPRGKITAIMGPSGIGKTTLLRLIGGQIPPDSGEILFDGENVPAMSRSRLYTVRKRMSMLFQSGALFTDMNVFDNVAYPLREHTHLPPALLHSTVMMKLEAVGLRGAAKLMPSELSGGMARRAALARAIALEPDLIMFDEPFVGQDPITMGVLVKLISELNSALGVTCVVVSHDVPEVLSIADYAYIVADKKIVAHGSAQALQENGDPRVRQFLDGIADGPVPFRYPAGDYHDDLLGIGS

SEQ ID NO: 7355 - protein, 434 aa, Enterobacter cloacae
GRNARSTVEFIREQTMDKFRVQGPTRLQGEVTISGAKNAALPILFAALLAEEPVEIQNVPKLKDIDTTMKLLGQLGTKVERNGSVWIDASNVNNFSAPYELVKTMRASIWALGPLVARFGQGQVSLPGGCAIGARPVDLHIFGLEKLGAEIKLEEGYVKASVNGRLKGAHIVMDKVSVGATVTIMSAATLAEGTTIIENAAREPEIVDTANFLVALGAKISGQGTDRITIEGVERLGGGVYRVLPDRIETGTFLVAAAISGGKIVCRNAQPDTLDAVLAKLRDAGADIEIGEDWISLDMHGQRPKAVNVRTAPHPAFPTDMQAQFTLLNLVAEGTGFITETIFENRFMHVPELIRMGAHAEIESNTVICHGVEKLSGAQVMATDLRASASLVLAGCIAEGTTVVDRIYHIDRGYERIEDKLRALGANIERVKGE

SEQ ID NO: 7356 - protein, 339 aa, Enterobacter cloacae
EDHSVIHGAAFAPPPRRYRAELEYLMKLSRQTTSDTSVDGRSRAYAWGRVHYFIIEHAPMAELVAIDELLEKAGWSNDGCPNYEKDDEFGNAGYSCGYWIDIDSVGSFKADYKRLKGEISAHIASKAAEVEIRVLDSMSDKECKDVASVACTVRRDLRTQSESLHSLRTIVTVDHYNPYVITSRPLSISAWTLIHDCLKTGTINDVCSRLSSLILHSEAAIARCKGSSDYSSEHAQLSFFAGNDYVTRRTLVDAAHEEALRMNRRFDERIAMNADSDARRLQCEFNLSNHVVQRRTVESAHIQAINEDVTRSQAEPRCPGKLLLKMTSHEEVRDSLSTC

SEQ ID NO: 7357 - protein, 66 aa, Enterobacter cloacae
LQMSLQVSHYNMLRASHEVSQKVVVRTVITVRFVPEADFLKILRAQQLGAGHIKYPQNYREYLKFL

SEQ ID NO: 7358 - protein, 99 aa, Enterobacter cloacae
AVGQATLGIDTNVGLHAKVPLIAFLGLMHLRIALLLFVLGRAGCLNDGGIDQGALSHHDACFGQPAIDGLEQLAGQLMLLQQVAEIHDGGAVRQGAIQG

SEQ ID NO: 7359 - protein, 83 aa, Enterobacter cloacae
HGFQRIRSPAITSLGVKRLDDFHHVLPWQNLLHTGQENLFSGLTALTAEFTVGEGKLMTHDEPCSMAPDDKHDLISGTCSHLP

SEQ ID NO: 7360 - protein, 284 aa, Enterobacter cloacae
NVPRQFSGGFFMIKETVTMSHKELDRLHIIQESLNRHITQEQAAARIGISIRQVKRLVQRYRNEGPSGLVSRRRGKRPNNSFSTEFRATVISLLKGRYADFGPTLACEKLREIHGLCLSIETLRKWMVEEGIWRERRRKFARIYQRRMRRPSYGELIQIDGSPHDWFEGRGPKCTLIVFFDDATSALMALRFAPAETTRAYMETLRGYLNDHGVPLALYSDRHSIFRVNNPERERRVDSVHTCDKDTGHRANPCQQPAGKRAGRACQSDTAGQAGQRNAASGYQ

SEQ ID NO: 7361 - protein, 213 aa, Enterobacter cloacae
RGFMLIIGACTRFITSVAWALNRRRRRKGLATERLPCFLPAAPNLTWSMDFVMDALSTGRRIKCLTCVDDFTKECLTVTVAFGISGVQVTRILDSIALFRGYPATIRTDQGPEFTCRALDQWAFEHGVELRLIQPGKPTQNGFIESFNGRFRDECLNEHWFSDIVHARKIINDWRQDYNECRPHSTLNYQTPSEFAAGWRKGHSENEDSDVTN

SEQ ID NO: 7362 - protein, 350 aa, Enterobacter cloacae
VLYLIVGAGHGDSLNNANMWGGEILNRVQQCTSYTLALTGTPWRTDNNPIVLSNYTDPQGKICCDYVYGLHEAIVDGVCRKPKIALINSNNLLYSSGEVVQHFDSIAGFLSETITSYQSIIWHPDAMKYLLKSGCKKLCEIRKVNSDAGGLVVASSVEHAYQLLNILENEFAQTATIVTYHDRDALVKIENYRQSTTEWIVSVGMISEGTDIPRLQVCCHLSSVKTELYFRQVLGRILRVNQSENQEAWLFTIATDELTLFSNRLAEDLPEDYKILQKQSDEWSLSIHETESTSPEIVRRNGMSKIGEFNLKMNFSEITISPPAVLDKTKQLNMGSLYQQVIDAFLFSVI

SEQ ID NO: 7363 - protein, 92 aa, Enterobacter cloacae
SAAWRGAICLSRCRLPRGATARGAGRGGCGLADRRAPRQGKNLETASTQEQNGHQHRIHESQHPGQGGAPISHHQATVRLRESQIQGVAEKR

SEQ ID NO: 7364 - protein, 229 aa, Enterobacter cloacae
ITRSGKGELTQFTRAIKTLGIEPIHANSPQAKGRVERANQTLQDRLVKEMRLQGISDIETANAWLPTFIEAYNNRFATPPRIADNAHLDVHHSEEELGYIFSLQAKRVLSKNLTFQYKSSAFQIRSEGRGYRLRHSVVTVCESFNGEIKVLYDGKALGWEKYVDGPEPIPLDDEKSVHERVDNARFDLRSKFYVKPKADHPWLTRRTQSNQQVKPPKLPRKKADPDKMD

SEQ ID NO: 7365 - protein, 315 aa, Enterobacter cloacae
SSYFRKLIMTKTKGLPRPLTHYAWLSIATAIATIGLKGVAWKMTGSVGLLSDAIESVVNLAGALMALWMLTLAALPADENHAYGHGKAEYFSSAFEGFLILLAAASIAYTAVERMLTPQPLEEIGLGLLVSTVASILNFVTARILLRAGRQHNSITLEADAHHLLTDVWTSVGVIFGVGLVYLTGWFWVDPIVALLVAANIVWTGYQLMSRSAAGLMDVSLPTEELKKIESLLAGYREQGLDFHALRTRQAGGRAFMTMHILVPGRWTVQYGHDWAERIENDIRTALPFIHITTHVEPLEDPASMNDQTLDISDH

SEQ ID NO: 7366 - protein, 97 aa, Enterobacter cloacae
TLMAYFLDFDERALKEWRKLGSTVREQLKKKLVEVLESPRIEANKLRGMPDCYKIKLRSSGYRLVYQVIDEKVVVFVISVGKRERSEVYSEAVKRIL

SEQ ID NO: 7367 - protein, 341 aa, Enterobacter cloacae
YEIMFVIWSHGTGFIMSHQLTFADSEFSSKRRQTRKEIFLSRMEQILPWQNMVEVIEPFYPKAGNGRRPYPLETMLRIHCMQHWYNLSDGAMEDALYEIASMRRFARLSLDSALPDRTTIMNFRHLLEQHQLARQLFKTINRWLAEAGVMMTQGTLVDATIIEAPSSTKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVRTLKQHPRKNKTAINIEYMKASIRAKVEHPFRIIKRQFGFVKARYKGLLKNDNQLAMLFTLANLFRADQMIRQWERSH

SEQ ID NO: 7368 - protein, 457 aa, Enterobacter cloacae
SPLFFRASRCSTFANEYSGHADKLLAIFLSKSVECIPIPDKKELVMTVTNQFAAHVGLDWADKKHDVCVQFKNGERVFDVIEHTAEALDAWLTELHQKVKGRIAIALELKKGPVVYALQKYPFITVFPVHALSLARYRQAFSPSGAKDDPQDAELALELMLRYPQKIKAIEPDNADIRLLQQLVEQRRQLVEDKRRFVNRIINTLKQYYPQPLEWFSHRGSLLLCELIIRWPSLQQLKRARRDTIRNFLNAKGGRAMALTEQRVASIDNAIPLTTDPSVIEANALMAAALATQIKVVSEIIKTYDERIETLFDTLPDAGLFKSLPGMGPCMGPRMLAALGDNRDRFNSAEEIQNYAGIAPVTERSGQKSWVHWRWQCAKFVRQTFVEWAAKTVNSSYWAKLYYQGLREKGKSHQSAIRALAFKWIRIIYRCWKARTCYDEAKYLLALEARHSPLLKP

SEQ ID NO: 7369 - protein, 80 aa, Enterobacter cloacae
DMGSINLRIDDELKARSYAALEKMGVTPSEALRLMLEYIADNERLPFKQTLLSDEDAELVEIVKERLRNPKPVRVTLDEL

SEQ ID NO: 7370 - protein, 62 aa, Enterobacter cloacae
HFCFALTGEEGHENAEPTHCFVHINSLFNAVDIHLAHTKLALRVADERRNKGGICYPGLRIR

SEQ ID NO: 7371 - protein, 403 aa, Enterobacter cloacae
LCYGHQKLKRVEVKQMKITISGTGYVGLSNGILIAQNHEVVALDIVQAKVDMLNQKKSPIVDKEIEEYLATKPLNFRATTDKEDAYRDADFVIIATPTDYDPKTNYFNTSTVEAVIKDVTAINPNAVMIIKSTIPVGFTKSIKEELGIDNVFFSPEFLREGRALYDNLHPSRIVIGERSERAERFAALLQEGAIKKDIPVLFTDSTEAEAIKLFANTYLAMRVAYFNELDSYAESLGLNTRQIIEGVCLDPRIGNHYNNPSFGYGGYCLPKDTKQLLANYQAVPNNLISAIVDANRTRKDFISDSILARQPKVVGVYRLIMKSGSDNFRASSIQGIMKRIKAKGVQVIIYEPAMQEDEFFHSRVIRDLDAFKKEADVIISNRMAEELADVKDKVYTRDLFGSD

SEQ ID NO: 7372 - protein, 155 aa, Enterobacter cloacae
RAQTSSYSETLEPASVPSREISVHRTCFSPTGRYIPTSSSSVTPEFSCQPLTATCLLPCSSMRTSSASTSASAPKRRNQPLTLSGSFTAVEPTTTRATPASSKAATSASVRTPPPTCTGTSTPATSVLSSGIWRFAGSFAPVRSTRCNTSAPSAA

SEQ ID NO: 7373 - protein, 116 aa, Enterobacter cloacae
EWILSRTPGQKSPAHRPLYRSPARRTASPRTGSHRQLVEESRAPPSDNRQYVPGWPASGRSKTAEQSRREYRGRRTPPVASPAGSARRAGFPHPPPAISARCGRYQYFSPRRPSPV

SEQ ID NO: 7374 - protein, 380 aa, Enterobacter cloacae
RYRAFLSYPIHLLFNGIDCVKILVTGGAGFIGSAVIRHIISNTRDSVVNVDKLTYAGNLESLREVSDSERYVFEHADICDKEAMARIFATHQPDAVMHLAAESHVDRSITGPAAFIETNIFGTYILLETSRAYWSSLDEAAKSAFRFHHISTDEVYGDLPHPDEHSDSTPLPLFTEKTAYQPSSPYSASKASSDHLVRAWIRTYGLPGIVTNCSNNYGPYHFPEKLIPLVILNALDNKPLPIYGKGDQIRDWLYVEDHARALYTVLTTGKPGETYNIGGHNEKKNIEVVQTICDLLDDMVPKETSYRAQITYVADRPGHDRRYAIDAHKISDELGWTPVETFESGIRKTVKWYLNNQEWVSNVKSGAYKSWIEQNYGERK

SEQ ID NO: 7375 - protein, 293 aa, Enterobacter cloacae
MTKRKGIILAGGSGTRLYPVTMAVSKQLLPIYDKPMIYYPLSTLMLAGIRDILIISTPQDTPRFEQLLGNGSQWGLHIQYKVQPSPDGLAQAFILGEEFIGEDNCALVLGDNIFYGHDLPRLLEGAASQQEGATVFAYHVSDPERYGVVEFDKDGTAIGLEEKPQQPKSNYAITGLYFYDNDVVEMAKSLTPSERGELEITDINRIYMQQGRLSVAMMRRGYAWLDTGTHQSMIEASNFIATIEERQGLKVSCPEEIAFRRGFIDAEQLRVLAEPLKKTGYGQYLLNLTKGLV

SEQ ID NO: 7376 - protein, 292 aa, Enterobacter cloacae
AENVMKKVAIVGLGWLGMPLAMSLAAKGWQVTGSKTTRDGVEAARMCGIDGVELRLEPELICDTDELDELMNVDALVITLPARRSGPSETFYLQAVQEIVDSALAHHIPRIIFTSSTSVYGAIDGTAKENTERRPVTASGRVLKELEDWLHNLPGTQVDILRLAGLVGPGRHPGRFFAGKSAPDGQHGVNLVHLEDVIGAIELLLQAPKGGHIYNICAPSHPPRSTFYPLMARQLGLAPPVFSDAQGERKGKIIDGNRICHELGFEYQYPDPLVMPTEYFSLTKRPGPALNA

SEQ ID NO: 7377 - protein, 482 aa, Enterobacter cloacae
CLARLLPTPLGEDGMSRQQIGVIGMAVMGRNLALNIESRGYTVSIFNRSRDKTEEVIAENPGKKLVPFYTVKEFVESLETPRRILLMVKAGAGTDAAIDSLKPYLDKGDIIIDGGNTFFHDTIRRNRELSAEGFNFIGTGVSGGEEGALKGPSIMPGGQKEAYELVAPILTKIAAVAEDGEPCVTYIGPDGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKAEFVEKVRRALYLGKIVSYAQGFSQLRAASDENNWDLNYGEIAKIFRAGCIIRAQFLQKITDAYAENAGIANLLLAPYFKQIADDYQQALRDVVAYAVQNGIPVPTFSAAVAYYDSYRAAVLPANLIQAQRDYFGAHTYKRTDKEGVFHTEWLD

SEQ ID NO: 7378 - protein, 380 aa, Enterobacter cloacae
CPRTSESAYDSASYFTYITHLSDITHRILIEKSPATDTLRKQDYFCPFSSVRDCMTQNNNSLVTRNNDPEQIDLLDLVLQLWRGKWVIGAFVAAFIVLAVVYITVAKEKWTSSAIIAQPDAAQIATYSNALNILYGGAAPSMLDIQNRAIGRFNSSFSALAQALENQEDPEKLTIEPTVKGQSLPLTVSYQGESADAAQKQLAQYIQQVDEQTAKELTLDLRDNLKQQITTLNDSLQNQEKVAQEQKDLRIKQISEAYKNAEAANISTPQLQQTQDVTQETMFLLGTVALKSMIDNEASRPLVFSGAYYQTKQNLLDIQNLNVNPDTIHVYRYVMKPNLPIRRDSPKKAITLILAVLLGGIIGSAVVLGRNALRNYKPRA

SEQ ID NO: 7379 - protein, 327 aa, Enterobacter cloacae
KSPRKIFFRGLFFGPHSDRLKQVNEEHRMLDNSRLRIAIQKSGRLSDDSRELLARCGIKINLHTQRLIALAENMPIDILRVRDDDIPGLVMDGVVDLGIIGENVLEEELLTRRAQGEDPRYFTLRRLDFGGCRLSLATPVDEAWDGPAALNGKRIATSYPHLLKRYLDQKGVQFKSCLLNGSVEVAPRAGLADAICDLVSTGATLEANGLREVEVIYRSKACLIQRDGEMADAKQHLIDKLLTRIQGVIQARESKYIMMHAPTERLEEVIALLPGAERPTILPLAGDQQRVAMHMVSSETLFWETMEKLKALGASSILVLPIEKMME

SEQ ID NO: 7380 - protein, 362 aa, Enterobacter cloacae
RPESGESMSQKYLFIDRDGTIISEPPSDFQVDRFDKLAFEPDVIPVLLKLQKAGYKLVMITNQDGLGTDSFPQADFDGPHNLMMQVLTSQGIAFDEVLICPHMPADKCDCRKPKLKLVERYLAEEALDKANSYVIGDRVTDITLAENMGIAGLRYNRDTLNWAMIGEQLTRRDRYSHVERNTKETQIDVKVWLDREGGSKIHTGVGFFDHMLDQIATHGGFRMEITVKGDLYIDDHHTVEDTGLALGEALKLALGDKRGINRFGFVLPMDECLARCAMDISGRPHLEYKADFTYQRVGDLSTEMVEHFFRSLSYTMGLTLHLKTKGKNDHHRVESLFKAFGRTLRQAIRVEGDALPSSKGVL

SEQ ID NO: 7381 - protein, 310 aa, Enterobacter cloacae
RGLRALSAGGVSVLWRYRRPGGYRRSARNRCTWRDRGSRAAGRQIYGKGGDSMLAKRIIPCLDVRDGQVVKGVQFRNHEIIGDIVPLAKRYAEEGADELVFYDITASSDGRVVDKSWVARVAEVIDIPFCVAGGIKSADDAAKILSFGADKISINSPALADPALITRLADRFGVQCIVVGIDTWFDTATGKYHVNQYTGDESRTRVTQWETLDWVQEVQKRGAGEIVLNMMNQDGVRNGYDLEQLKKVRAVCQVPLIASGGAGTMEHFLQAFRDANVDGALAASVFHKQIINIGELKTYLADQGVEIRVC

SEQ ID NO: 7382 - protein, 379 aa, Enterobacter cloacae
NPGRRRTSDCPQKCRDAARCRPEGASMNIEELARENVRRLTPYQSARRLGGNGDVWLNANEYPTPVAFELSQQTLNRYPECQPKAVIENYAQYAGVKPEQVLVSRGADEGIELLIRAFCEPGKDAVMYCQPTYGMYSVSAETFGVACRNVQALDNWQLDLQGIADNLDGVKVVFVCSPNNPTGQIINPQDIRALLEMTRGKALVVADEAYIEFCPQATLAGWLEEYPHLVVLRTLSKAFALAGLRCGFTLANKAIIDLLLKVIAPYPLSTPVADIAAQALAPQGISAMRERVAQILEERQYLVDALKTIPCVEKVFDSETNYILVRFTASSAIFKSLWDQGIILRDQNKQPTLSGCLRITVGTRAESQRVIDALKAEKV

SEQ ID NO: 7383 - protein, 271 aa, Enterobacter cloacae
LLRRAVSPGTLRCRRCATAEKFPGDVMIIPALDLIDGTVVRLHQGDYGQQRDYGNDPLPRLQAYAAEGAEVLHLVDLTGAKDPAKRQIPLLKTLVAGVDVPVQVGGGVRTEADVAALLDAGVARVVVGSTAVKDPESVKGWFRRFGADALVLALDVRIDEQGNKQVAVSGWQENSGVTLEELVGMYLPVGLKHVLCTDISRDGTLAGSNVSLYEEVCARYPQVAFQSSGGIGDLADIAALRGTGVRGVIVGRALLEGKFTVKEAIQCWQNG

SEQ ID NO: 7384 - protein, 109 aa, Enterobacter cloacae
RITAGGCTACRFRRSADAGIHEPGGTDKNARQRQGNVFLAHQTAPVDERGNLGSLPECGQHYARLRQRHPAGAGQPDWAYLPQRHQQLLRRDEPPVAVPLSAGTAAGRA

SEQ ID NO: 7385 - protein, 338 aa, Enterobacter cloacae
MREAMKFLVTGAAGFIGSHVSKRLLDAGHEVVGIDNLNDYYDPNLKLARLELLKSESFTFHKLDLADRKGMAVLFANEKFDRVIHLAAQAGVRYSLENPHAYADANLVGHLNVLEGCRHNKVQHLLYASSSSVYGLNRKMPFSTDDSVDHPVSLYAATKKANELMSHTYSHLYNLPTTGLRFFTVYGPWGRPDMALFKFTKAMIEGNSIDVYNYGKMKRDFTYIDDIAEAIIRLQDVIPQADADWTVETGSPATSSAPYRVYNIGNSSPVELMDYITALEEALGKEAVKNMMPIQPGDVLETSADTKALYDVIGFKPQTSVKEGVKNFVDWYRNFYNV

SEQ ID NO: 7386 - protein, 441 aa, Enterobacter cloacae
EDDGVTTMSFNTIIDWNTCSDAQQRELLMRPAISASESITRTVAEILDNVKARGDDALREYSAKFDKTEVGALQVTEQEIIDASNRLGDDIKQAMAVAVKNIDTFHTAQKLQAVDVETLPGVRCQQVTRPVASVGLYIPGGSAPLFSTVLMLATPARIAGCQKVVLCSPPPIADEILYAAKLCGVQAIYKVGGAQAISALAFGTVSIPKVDKIFGPGNAYVTEAKRQVSQRLDGAAIDMPAGPSEVLVIADSGATPDFVASDLLSQAEHGPDSQVILLTPDADMAKRVGDAVERQLADLPRAETARQALLASRLIVARDLDQCIAISNQYGPEHLIIQTRNARDLVDSITSAGSVFLGDWSPESAGDYASGTNHVLPTYGYTSTCSSLGLADFQKRMTVQELSREGFASLASTIETLAAAERLTAHKNAVTLRVAALKEQA

SEQ ID NO: 7387 - protein, 206 aa, Enterobacter cloacae
RPALVERSAVMNVVILDTGCANLNSVQSAIMRHGYEPVVSRDPDVVLRADKLFLPGVGTAQAAMDQIHERELVDLIKACTQPVLGICLGMQLLGRRSEESNGVDLLGIIEEDVPKMTDHGLPLPHMGWNRVYPKAGNRLFQGIEDGAYFYFVHSYAMPVNTYTIAQCNYGEAFTAAVQKDNFYGVQFHPERSGAAGAQLLKNFLEM

SEQ ID NO: 7388 - protein, 217 aa, Enterobacter cloacae
VKNVPGRPGRGDQGMLTEQQQAQLDWEKTDGLLPVVVQHAVSGEVLMLGYMNQEALTKTLDSGKVTFFSRTKQRLWTKGETSGHFLNVVSITPDCDNDTLLVLVNPIGPTCHKGTSSCFGETSHQWLFLYQLEQLLAERKSADPESSYTAKLYASGTKRIAQKVGEEGVETALAATVHDREELTNEASDLMYHLLVLLQDQELDLTTVIENLRKRHK

SEQ ID NO: 7389 - protein, 176 aa, Enterobacter cloacae
VSVIWYLLNSASTLERLYFPKVQHATDKMSKAESEYQDAVESRSVLINQKTAEYLANPSERHGFIVKQVYPTNQQQVIQSMAEQGYMVHRVSVGMVTFIRMPKNAKDNPLQEITDKAKAEAESTIDKMIERLKVRAGEAVHQRNKIVTEARKALDSIKSFESYLNVIVTDSEEVTE

SEQ ID NO: 7390 - protein, 852 aa, Enterobacter cloacae
NRGQNCRSAVFPQPRARHHADSGYPRPAAGRPLRPPPAAGERYSSGGSMIARWFWREWRSPSLLIVWLALSLAVACVLALGSVSDRMEKGLSQQSREFMAGDRALQSSRPVPPGWIEEARKEGLKVGEQITFQTMTFAGDTPQLASVKAVDDIYPMYGDLQTSPPGLKPTAGTVLLASRLMALLNLKPGDSIDVGDATLKIAGEVVQEPDSGFNPFQLAPRLLMNTADVAKTHAVQPGSRVTWRYKFGGTPAQLEAYEKWLLPQLKPEHRWYGLEQDDGALGKSLERSQQFLLLSALLTLLLAIAAVAVAMGHYCRSRYDLVAILKTLGAGRAQLRKLIVGQWLMVLALSALTGGAIGLLFEKLLMVLLKPVLPAALPPASLWPWLWAIGAMTTISLLVGLRPYRLLLATQPLRVLRRDVVASVWPLKFYLPVIIAVAVGLLAWLMGGSTLLWAVLAGAVVLALLCGVVGWILLNVLRKLTVKSLPIRLAVNRLLHQPWSTLSQLSAFSLSFMLLALLLVLRGDLLDRWQQQLPPESPNYFLINIAPEQVTPLKGFLSEHHIIPESFYPIVRARLTQINGQSTEGNKDESLNRELNLTWQAKRPDHNPIVAGTWPPKAGEVSMEEGLATRLNVNLGDSVTFTGDTQDFTAKVTSLRKVDWESLRPNFFFIFPPGALDGQPQSWLTSFRWENGNGMLTQLNREFPTVSLLDIGAILKQVGQVLEQVSRALEVMVVLVTICGILLLLAQVQVGMRQRHQELVVYRTLGASKRLLRATLWSEFALLGLVAGLVAAIGAETALAVLQSKVFDFPWEPDWRLWLTLPVCGAVLLSLCGGWLGSRLLKGKALFRQFVS

SEQ ID NO: 7391 - protein, 244 aa, Enterobacter cloacae
RCVAERIMLKALLITAVNGIGMNNKKNLLDIRDVGFRVGDNTILQHVDFCLSPGEFKLITGPSGCGKSTLLKIVASLLSPTEGTILFAGKDIATFSSESYRQQVSYCVQTPSLFGDTVYDNLVFPWHIRNQTPDPKKFTDDLTRFGLSPETLTKSIAELSGGEKQRVSLIRNLQFLPKALLLDEITSALDDANKRNVNDIIHRYAREQNIAVLWVTHDSNEITHADDVITLRPQGGKMEEAHRG

SEQ ID NO: 7392 - protein, 246 aa, Enterobacter cloacae
RVRSRRAEGHQHQKQEGQMPAENIVEVHRLKKSVGQGEHELSILTGVELVVKRAETIALIGESGSGKSTLLAILAGLDDGSSGEVNLVGQPLHALDEEARAALRARHIGFVFQSFMLIPTLNALENVELPGLLRGENTRESRDHAKALLEQLGLGKRLDHLPAQLSGGEQQRVALARAFNGRPEVLFADEPTGNLDRKTGDKIADLLFSLNREHGTTLILVTHDPQLAARCDRRLRLVNGILQEEA

SEQ ID NO: 7393 - protein, 213 aa, Enterobacter cloacae
KTQKTGGYRRFFCLQMQIRNKECRHELLADGHACNHNVFFRNVLVHTAAASRNGFDLVDHVHPFNHFCEYAVAPALQTFAREVQEVVVRYVDEELCGCRMWRLSTGHCQRTTGVFQAVVRFVFDRFFRLFLAHARLETAALDHKAVDHTVENSVVVETFAAVVQEVFNCFRRFVIKGFDYDIAMISVESNHFCILFRYCGASTRARVTYRGLL

SEQ ID NO: 7394 - protein, 287 aa, Enterobacter cloacae
RMIQMKLPMRMMSSRSGRRAGKWRRLTVGEHNITNESLALSMVLVLVAIVVSYREKLGLEKDILWSIARAVIQLIIVGYVLKYIFNVNHAVLTLLMVLFICFNAAWNAQKRSKYIDKAFISSLIAITTGTALTLAVLVLSGSIEFTPMQVIPISGMIAGNAMVAVGLCYNNLGQRFSSEQQQLQEKLSLGATPKVASARLIRDSIRSSLIPTVDSAKTVGLVSLPGMMSGLIFAGIDPVKAIKYQIMVTFMLLSTASLSTIIACYLTYRKFYNARHQLVVTQLKKTG

SEQ ID NO: 7395 - protein, 388 aa, Enterobacter cloacae
RVYQGKRMTIRKTALATTIGAAVALASFASQAEITLLKQDPQAGNPLSRLNFTVGGSIRPQFQNMTGDDGKNGYKRNGFDGGTRFRFAADYYLFDDISWITYYELGVNIPAQFNWDNHYADGAHDTSRRMLYTGLKSDTWGTLTFGQQNSVYYDVVGAKTDIWDYDMIGQAPGNGINGDYDGSYRSRQMLKYKKTVGDADIYASYLFEDSEYLPGNGLRYKRKGGGSLGIDYHLTTDLTWGAAWNYTRADMRNPDNGDSKSYDQNILGTALSWTPDNWTFSAGGGWYQNFLTTKKVSVNDYFAGDAWGIEYFAGYKFPVGQYAVKSIQPYFMGDRIEYVNGRNYQRIDNGVGISFQLDYGFRVDYEHVFTSCTDNLGDMNLVRLRYDF

SEQ ID NO: 7396 - protein, 526 aa, Enterobacter cloacae
LVWKVTIFASCSVIVVRRPVLGSHIGACYSITTGHDHLALCADRTPNYGYYKEQTIHTRVYMESSMLKIFNTMTRQKEEFKPIHAGEVGMYVCGITVYDLCHIGHGRTFVAFDVVSRYLRFLGYNLKYVRNITDIDDKIIKRANENGESFVALVDRMIAEMHKDFDALNILRPDSEPRATHHIHEIIDITQKLIERGHAYVADNGDVMFSVPTDPTYGALSRQDLDQLQAGARVDVVDVKRNPMDFVLWKMSKAGEPSWPSPWGEGRPGWHIECSAMNCKQLGNHFDIHGGGSDLMFPHHENEIAQSTCAHGGEYVNYWMHSGMVMVDREKMSKSLGNFFTVRDVLKYYDAETVRYFLMSGHYRSQLNYSEENLKQARAALERLYTALRGTDKSVPAAGGEAFEARFVEVMNDDFNTPEAYSVLFDMAREVNRLKSEDMAAANALASHLRKLSSVLGLLEQEPDVFLQSGAQADDGEVAEIEALIKARLEARQAKDWAAADAARNRLTEMGIILEDGPQGTTWRRK

SEQ ID NO: 7397 - protein, 517 aa, Enterobacter cloacae
NVLLTITAQKKRYSGEISMSLISGFVKSLSKLSMIGRALMLPISLLPAAGLLLAFGDKFHLPLMMNAGGVIFDNLPMLFAIGSAVGLASESGIAALSAAVSVFVTNITISTVLSITPEMASQGGKYAMVVGIPTLQMGVFGGLICGILAAWCYNRFHTMQLPEFLGFFSGKRFVAIATAFLSFLLGLLLPYVWQHIQSGIDALSVVVNGDNQAASTFIFGLVERALIPLGLHHIWYPSFWYSFGDYTTQAGQVIHGDQTIWFKMLEEGVKSFSSDTYQNAGKFMQGEFPLMLFALPAACLAMYHEAHTKNKKIAAGILFSAALTCFLTGITEPVEFTFIFVAPILYVFNAIMAGLAYMTMYLLHAHIAKSFSAGFIDYLSFGILPSFNGYQTNFLSAIIVGIPMALIYYFTFRFVIRRFDVKTPGRTEVTASANDKSDSELATEIIGLLGGAQNIDSVGSCITRLRLEVANSEAVDRDGLNGLGARGVVFVGDNGIQVIFGARAQFIAQTMSTMIGK

SEQ ID NO: 7398 - protein, 187 aa, Enterobacter cloacae
LLYFHDLPWINAMPTVITHAAVPLCLGLGLGTNVIPPRLLFAGIVLAMLPDADVLAFKFGVAYGNIFGHRGFTHSLLFALVVPILCVLAGRRWFRASLTRCWLFLTVSLLSHSLLDSITTGGKGVGWLWPWSDERFFAPWQVIKVAPFALSRYTTPYGHEVIISELLWVWLPGMVLMGMLWWRKRAR

SEQ ID NO: 7399 - protein, 214 aa, Enterobacter cloacae
SPSRFNPPRLFAHFPTTQPFSLPVLHAILCALESSVFRTTGVLRRMSSRNNPARVAIVMGSKSDWATMQFAAEIFEILNVPHHVEVVSAHRTPDKLFSFAESAEENGYEVIIAGAGGAAHLPGMIAAKTLVPVLGVPVQSAALSGVDSLYSIVQMPRGIPVGTLAIGKAGAANAALLAAQILATHDKELHQRLAEWRKAQTDEVLDNPDPRGAA

SEQ ID NO: 7400 - protein, 98 aa, Enterobacter cloacae
RIPFTSRRRRSQRAASCGSWVTRISVVPCSRLRENSRSAILSPVLRSRLPVGSSANSTSGRPLNALASATRCCSPPESCAGRWSRRFPSPSCSSNAFA

SEQ ID NO: 7401 - protein, 270 aa, Enterobacter cloacae
IMTRQTAENLTGKVMQKSVLITGCSSGIGLESALELKRQGFWVLAACRKPEDVERMRGLGFTGILLDLDSPESVEQAADEVIALTNNRLYGLFNNAGYGVYGPLQTLSREQLEQQFSANFFGAHQLTMRLLPAMLPHGEGRIVMTSSVMGLISTPGRGAYAASKYALEAWSDALRMELRHSGIKVSLIEPGPIRTRFTENVNQTQADKPVENPGIAARFTLGPEAVVAKVRHAFESDTPKMRYPVTLVTHAVGWLKRLLPGRMMDKILQG

SEQ ID NO: 7402 - protein, 176 aa, Enterobacter cloacae
RFAPRIPNGAFYFCQSGSHLFTGAKSCSLADILTFNKYAVFSLRHAKQEVFMLIVVPVIIFVALLFVGAGVKIVPQGYQWTVERFGRYTNTLQPGLSLIVPFMDRIGRKINMMEQVLDIPSQEVISKDNANVTIDAVCFIQVIDAPKAAYEVSNLELAIVNLTMTNVHNKYASLKY

SEQ ID NO: 7403 - protein, 113 aa, Enterobacter cloacae
RCRSARILYYSGPGRRWPDDGSNTDSEYLAGVRGVSRRRGRVIMATFSLGKHPHVELCDLLKLEGWSESGAQAKIVIADGQVTVDGAVETRKRCKIVAGQTVSFAGQSVTVTA

SEQ ID NO: 7404 - protein, 291 aa, Enterobacter cloacae
TDKRECRMSVQNIVNITEANLQQTLEQSMTKPVLFYFWSERSQHCLQLTPVLESLAAQYNGQFILAKLDCDAEPMVASQFGLRAIPTVYLFQNGQPVDGFQGPQPEEAIRALLDKVLPREEELKAQEAMALMQEGKYDEALPLLKDAWQLSNQNSQIGLLLAETQIALHRPEDAEAVLKTVPMQDQDTRYQGLVAQIDLLKQAADTPEIQQLQQQVADNPQDAALASQLALQLHQVGRNEEALELLFSHLQKDLGAADGQARKMFQEILAALGTGDALASKYRRQLYALLY

SEQ ID NO: 7405 - protein, 82 aa, Enterobacter cloacae
SLGSANRVLFGGEWIKEGALVVDVGINRLENGKVVGDVVYEDAAARASYITPVPGGVGPMTVATLIQNTLQACEEYHDVEDA

SEQ ID NO: 7406 - protein, 390 aa, Enterobacter cloacae
RDTGDFRGQSTVYRPDDVYDDWQIIRCLKEASPVRWGSPLIWLIIGKFQGAVLKKVSIIDVAKHAGVSVSTVSLVLRQKGKISEATIGKVNAAITTLGYVHNVAAANLRANTSNLIGLILRDFSDSFSIKVMASIVQELEKQGYMVFLGQPLNDGEHLERTLLTFKQQGVAGVIYLASDTRTASLPEHIRHCPLPLVAVSQSLLEEKCNLVMRDNRQAANLAARYLIERGHRTIAYIGGRDGCRIREQRLLGFRSAMTQNGLIWREEYSPACTDDTQAAAMATRQLLEKNNTITALLCHSPDAMIGSISGIHQVGRTVGKDVFLTQQVALIGFEDMLHVNLTSPSLTYVSSASEETGRQAAGLMIRRLKEPDLQTQRITLSGQLIARESA

SEQ ID NO: 7407 - protein, 185 aa, Enterobacter cloacae
QAPICDPSTGRRTTITEQDAKMVTFHTNHGDIVIKTFDDKAPETVKNFLDYCREGFYNNTIFHRVINGFMIQGGGFEPGMRQKETKEAIKNEANNGLKNTRGTLAMARTQAPHSATAQFFINVADNDFLNFSGESLQGWGYCVFAEVVEGMDVVDKIKAVSTGRSGMHQDVPKEDVVITSVTVSE

SEQ ID NO: 7408 - protein, 241 aa, Enterobacter cloacae
FVATLFIADLHLQTEEPAITAGFLRFLRGEAKNADALYILGDLFEAWIGDDDPNPLHREMAAAIKTLVDSGVPCYFIHGNRDFLIGQRYARESGMTLLPEEQVLNLYGRNILIMHGDTLCTDDTGYLAFRAKVHTPWIQKVFLALPLFIRNRIAARMRAGSKAANSSKSMTIMDVNPQAVVKVMEKHRVQWLIHGHTHRPDVHSLIANGEPAHRVVLGAWHSEGSMVKVTPEGVELIAFPF

SEQ ID NO: 7409 - protein, 362 aa, Enterobacter cloacae
PGSAGCSMKQVCVLGNGQLGRMLRQAGEPLGIAVWPVGLDAEPEAVPFHQSVITAEIERWPETALTRELARHNAFVNRDVFPIIADRLTQKQLFDKLGLATAPWQLLSDKREWDDVFAMLGDLAIVKRRVGGYDGRGQWRLRANDTAELPDDCYGECIVEQGINFSGEVSLVGARGHDGHTVFYPLTHNLHQDGILRTSVAFPQANADQQAQAEEMLSAIMHELGYVGVMAMECFVTPSGLLINELAPRVHNSGHWTQNGASISQFELHLRAITDLPLPQPVVTSPSVMINLIGTDLNYNWLKLPLVHLHWYDKEVRPGRKVGHLNLNDTDTDRLSATLEAIVPLLPPEYASGIVWAQSKLK

SEQ ID NO: 7410 - protein, 384 aa, Enterobacter cloacae
VSPAGELTFPFPGVQFPPIAAQFSSGITMNDGTDYRAILASDTPLIDVRAPIEFAQGAMPAALNLPLMNDDERAAVGTCYKRQGPDAALALGHSLVNGETREARINAWREASLAHPEGYLCCARGGQRSHISQAWLKEAGIDYPLIRGGYKALRQTAIQVTIEQSQKPMVLIGGCTGNGKTLLVKQHAQGIDLEGLAHHRGSSFGRTLTPQLSQASFENHLAVELLKKDAARWVLEDEGRMIGSNHLPECLRDRMVDAPVVVVEDPFEVRLERLREEYFDHMWADFSAAYGEKAGWKAYSEYLHHGLYAIRRRLGLQRFAEFTALLDAALVEQQRTGSTDAHFSWLVPLLKDYYDPMYGYQLEKKAEKIVYRGTYEEIAEWLDR

SEQ ID NO: 7411 - protein, 295 aa, Enterobacter cloacae
LKDKPDMPGSQRGAGLFIKRVEGLADQVHFPTAAIVQTGENGQQRGLTGTGFTNQGDGFGTFDNEFNSGEDGKLVFPLTDRLLKTMNFNNVFRWHLPFLFLMLMTFRAAAADTLLILGDSLSAGYRMAASAAWPALLNDKWQSRASVVNGSISGDTSQQGLSRLPALLKQHQPRWVLVELGGNDGLRGFQPQQTEQTLRTILQTIKAADAQPLLMQIRLPANYGRRYNEAFSAIYPKLAKEFDIPLLPFFMEEVYLKPQWMQDDGIHPNRDAQPFIADWMATRLAPLVNHDSSNS

SEQ ID NO: 7412 - protein, 209 aa, Enterobacter cloacae
RHQTGRHAAQVAGRDPSASAGLVSRGLTGAGAGQHLPVVPGKPAPLPGVMMFLSQEDFATVVRSTPLISIDLIVENERGEFLLGKRTNRPAQGFWFVPGGRVQKDETLTDAFERLTLAELGLQLPMAAGQFYGVWQHFYDDNFSGTGFTTHYVVLGFRLKVSEADLRLPDSQHDDYRWLTPEALLASDNVHDNSRAYFLAERQAEVPGL

SEQ ID NO: 7413 - protein, 473 aa, Enterobacter cloacae
IWPLHGQGQLLPEKGVIMEKLTCFKAYDIRGKLGEELNEDIAWRIGRAYGEYLKPQTIVLGGDVRLTSESLKLALAKGLQDAGVDVLDIGLSGTEEIYFATFHLGVDGGIEVTASHNPMDYNGMKLVRKGARPISGDTGLRDVQRLAEANDFPPVNEAKRGSYKQINLQKEYIDHLLGYINVANLKPLKLVINSGNGAAGPVVDALEARFKALNVPVTFVKVHNTPDGNFPNGIPNPLLPECRDDTRNAVIEHGADMGIAFDGDFDRCFLFDEKGQFIEGYYIVGLLAEAFLEKNPGAKIIHDPRLSWNTVDVVKAAGGEPVMSKTGHAFIKERMREEDAIYGGEMSAHHYFRDFAYCDSGMIPWLLVTELLCLKGQSLGELVRDRMAAFPASGEINSKLAQPAEAIARVEQHFAIHALEIDRTDGISMAFPQWRFNLRSSNTEPVVRLNVESRADTALMEARTKDILALLNQ

SEQ ID NO: 7414 - protein, 498 aa, Enterobacter cloacae
TKRRTKMSLREKTISGAKWSAMATIVIIGLGLVQMTVLARIIDNHQFGLLTVSLVIIALADTLSDFGIANSIIQRKEISHLELTTLYWLNVGLGIFVFVLVFLLSDVIAGVLHNPDLAPLMRTLSFAFVVIPHGQQFRALMQKELEFNKIGMIETSAVLAGFTFTVVSAHFWPLAMTAILGYLVNSAVRTLLFGFFGRKIYRPGLHFSLASVSSNLRFGAWLTADSIINYVNTNLSTLVLARILGASVAGGYNLAYNVAVVPPMKLNPIITRVLFPAFAKIQDDTEKLRVNFYKLLSVVGIINFPVLLGLMVVASNFVPLVFGEKWNSIIPILQLLCVVGLLRSVGNPIGSLLMAKARVDISFKFNVFKTFLFIPAIIVGGHMAGAIGVTLGFLLVQIVNTVLSYFVMIKPVLGSSYRQYILSLWLPFYLSLPTLAVSYGLGVVLNGHLPLAALLAVQVAAGALAFGVMIVLSRNALVVEMKRQFCRNEKMKTLLRAG

SEQ ID NO: 7415 - protein, 431 aa, Enterobacter cloacae
FYEAIMKLLILGNHTCGNRGDSAILRGLLDAINTLKPETEVDVMSRYPVSSSWLLNRPVMGDPLYSQMKQHNNAAGVMGRVKKVLRRRYQHQVLLSRVTDTGKLRNIAIAQGFTDFVRLLSGYDAIIQVGGSFFVDLYGVPQFEHALCTFMAKKPLFMIGHSVGPFQDPQFNQLANYVFGHCDALILRESVSLDMMKRSEIDTTKVEHGVDTAWLVDHQDDSFQASYAVQHWLDVAAKQKTVAITLRELAPFDKRLGTTQAAYEKAFADVVNRVLDSGYQVLALSTCTGIDSYNKDDRMVALNLRNLVNDPSRYHVVMDELNDLEMGKLLSACDLTVGTRLHSAIISMNFGTPAIAINYEHKSAGIMQQLGMPEMAVDIRHLLDGSLGAMVGDTLGQLPAINERLAVAVKAEREKGIGMVKSVLDRVREGK

SEQ ID NO: 7416 - protein, 344 aa, Enterobacter cloacae
SSEKTLPAQVSWLRGCHRAGVLRMTKQRIFVAGHRGMVGSAIVRQLEQRGDVEVIVRTRDELNLLDSKAVQDFFASERIDQVYLAAAKVGGIVANNTYPADFIYENMMIESNIIHAAHMHNVNKLLFLGSSCIYPKMAKQPIAESELLQGTLEATNEPYAIAKIAGIKLCESYNRQYNRDYRSVMPTNLYGPHDNFHPSNSHVIPALLRRFHEATAENAPDVVVWGSGTPMREFLHVDDMAAASIHVMELDREVWQENTEPMLSHINVGTGVDCTIRELAQTIAQVVGYKGRVVFDATKPDGTPRKLLDVTRLHQLGWYHEVSLEQGLASTYQWFLENQHRFRG

SEQ ID NO: 7417 - protein, 311 aa, Enterobacter cloacae
LGLYFVNHFKVEDKMTNLKAVIPVAGLGMHMLPATKAIPKEMLPIVDKPMIQYIVDEIVAAGIKEIVLVTHSSKNAVENHFDTSYELEALLEQRVKRQLLAEVQSICPPGVTIMNVRQAQPLGLGHSILCARPVVGDNPFIVVLPDIIIDNASADPLRYNLAAMVARFNETGRSQVLAKRMKGDLSEYSVIQTKEPLETEGQVSRIVEFIEKPDQPQTLDSDLMAVGRYVLNADIWAELEKTKPGAWERIQLTDAIAELGKKQSVDAMLMTGDSYDCGKKMGYMQAFVNTGLRNLKEGAKFRKCIENLLHE

SEQ ID NO: 7418 - protein, 377 aa, Enterobacter cloacae
RNINMSKVALITGVTGQDGSYLAELLLEKGYEVHGIKRRASSFNTERVDHIYQDPHAANPKFHLHYGDLTDTSNLTRILQEVQPDEVYNLGAMSHVAVSFESPEYTADVDAMGTLRLLEAIRFLGLEKKTRFYQASTSELYGLVQEIPQKETTPFYPRSPYAVAKLYAYWITVNYRESYGMYACNGILFNHESPRRGETFVTRKITRAIANIAQGLESCLHLGNMDSLRDWGHAKDYVKMQWMMLQQEQPEDFVIATGVQYSVRQFVEMAAAQLGIKLRFEGTGVEEKGIVVSVTGHDAPGVKPGDVIVQVDPRYFRPAEVETLLGDPTKAHEKLGWKPETTLQEMVSEMVAKDLEAAKKHSLLKSHGYEVAIALES

SEQ ID NO: 7419 - protein, 424 aa, Enterobacter cloacae
QQSGVLPCGTSGRGARSMKILVYGINYSPELTGIGKYTGEMVEWMASQGHDVRVITAPPYYPEWKVGERYSSWRYRREEGAATVWRCPLYVPKQPSTLKRLIHLGSFALSSFFPLMAQRRWKPDRIIGVVPTLFCTPGMRLLGKLSGARTLLHIQDYEVDAMLGLGMAGKGKGGKVAKLASAFERSGLHNVDYVSTISRSMMNKAQEKGVPAEKVIFFPNWSEVARFRDVTDQDAQALRAQLGLPAEQKIILYSGNIGEKQGLESVIDAALQLSEHPWMFVIVGQGGGKARLEKMASERGLTNIRFFPLQSYDALPALLKMADCHLVVQKRGAADAVLPSKLTNILAVGGNAVITAEAATELGQLCNSYPGIAVCVEPESVPALVTGIEQALAMPKENTVAREYAERTLEKENVLSQFIADIRG

SEQ ID NO: 7420 - protein, 479 aa, Enterobacter cloacae
IMSQTTLYPVVMAGGSGSRLWPLSRVLYPKQFLCLKGDLTMLQTTVNRLHGVECESPVVICNEQHRFIVAEQLRQLNKLTENIILEPAGRNTAPAIALAALAAKRSSPDCDPLMLVLAADHVIQQEEAFRDAVRAAIPYAENGKLVTFGIVPDLPETGYGYIRRGSVTPGEGDSVAFDVAQFVEKPNLETAQAYVASGEYYWNSGMFLFRAGRYLEELEKYRPDILSACEKAMAVVDPDLDFIRVDEEAFLACPEESIDYAVMERTADAVVVPMDAGWSDVGSWSSLWEISAHTPEGNVHHGDVISHKTENSYVYAESGLVTTVGVKDLVVVQTKDAVLIADRNAVQDVKKVVEKIKADGRHEHHIHREVYRPWGKYDSIDAGERYQVKRITVKPGEGLSVQMHHHRAEHWVVVAGTAKVTIDGEVKLLGENESIYIPLGATHCLENPGKIPLDLIEVRSGSYLEEDDIIRFQDRYGRV

SEQ ID NO: 7421 - protein, 488 aa, Enterobacter cloacae
TPSPLWGEGRGEGRGVRFRTKGTTMTNLKKRERARTNASLISMVQRFSDITIMVGGLWAVCWVSGQSFLYMHLLMALIALVVFQMIGGMTDFYRSWRGVKMTTELMLLLQNWTLSLVFSAGLVAFSHDFDNRLVTYLCWYLLTSIGMVVCRSLIRFGAGWLRNRGYNRRFVAVAGDLPVGQVLLDSFRKEPWLGFEVVGIYHDAKPGGVPSDWAGNYEQLIDDAKAGKIHNVYIAMQMKDESRIKKLMRELADTTCSVILIPDVFTFNILHSRIEEVNGVPVVPLYDTPLSGINRVLKRAEDIVLSSLILLLISPVLCCIALAVKLSSPGPIIFRQTRYGMDGKPIMVWKFRSMKVMENDKVVTQATQNDPRVTRVGNFLRRTSLDELPQFINVFTGGMSIVGPRPHAVAHNEQYRTLIEGYMLRHKVKPGITGWAQINGWRGETDTLEKMEKRIEFDLEYIREWSLWFDIKIVFLTIFKGFVNKAAY

SEQ ID NO: 7422 - protein, 463 aa, Enterobacter cloacae
NGRRYSSSAGRIAGCDGGRHARPAACDQRTSGGGGKSRTRKRYWHGEIRTRPRPGGEMKFGFFLLKFPLSSETFVLNQITAFIDMGYDVEIIALQKGDTQNTHAAYTRYGLEAKTRWLQDEPAGRMNKLRHRAGQTLRGLHRASTWRALNMSRYGAEARNLILSAICGQTAQPYRADVFIAHFGPAGVTAAKLRELGVIDGKIATIFHGIDISSREVLNHYTPEYQQLFRRGDMMLPISNLWAGRLKTMGCPSEKITVSRMGVDMERFTQRPVKVPGKPLQIISVARLTEKKGLHVAIEACRQLKARGVDFHYRILGIGPWERRLRTLIEQYQLEDVVEMPGFKPSHEVKAMLDDADVFLLPSVTGADGDMEGIPVALMEAMAVGIPVVSTLHSGIPELITSEHSGWLVPENNALALADRLAAFSDIDQQTLIPVLQNARQKVEAEFNQQVINRQLASLLQTL

SEQ ID NO: 7423 - protein, 465 aa, Enterobacter cloacae
GCMLKKITRRRFVSSLSVLAAMPLLSPRAARAATGKTVSVDRYNNNDWIAAFKQAFTEGDTVVVPAGLTCENINTGIFIPDGKTLLIRGALKGNGRGRFVLQEGCKVIGEGEGRTHNITLDVRGSDCVIKGLAMSGFGPVTQIYIGGKKPRVMRNLLIDRIAVSQANYAILRQGFHNQVDGARITNSKFSHLQGDAIEWNVAINDRNILISDHVIDNINCTNGKINWGIGIGLAGSTYDNDYPEQQTVKNFVVANITGSNCRQLVHVENGKHFVIRNIKASNITPDFSKKAGIDNATVAIYGCDNFVIDNIDMVNSAGMLIGYGVIKGDYLSIPQNFKLNDIRLDNRQLAYKLRGIQISSGNATSFVAITNVEMQRATLELHNKPQHLFLRNINVMQESTTGPALKMNFDLRKDVRGKFMAKNETLLSLANIKAVNEKGQSSVDIDRVDQHVVNTERLNFALPHR

SEQ ID NO: 7424 - protein, 336 aa, Enterobacter cloacae
RIEWIMNDKVLFIGASGFVGTRLIEISKTDFDVTNFDKQQSHFYPDITVSGDVRNQDQLDQALAGFETVVLLAAEHRDDVSPTSLYYDVNVQGTRNVLSAMEKNNVKNIIFTSSVAVYGLNKVNPDESHPHDPFNHYGKSKWQAEEVLREWFNKAPEERSLTIVRPTVIFGERNRGNVYNLLKQIAGGKFAMVGAGTNYKSMAYVGNIVEFIKFKLTNVKPGYDVYNYVDKPDLNMNQLVSEVEKSLNKKIPSVHLPYPLGMLGGYCFDILSKVTGKKYAISSVRVKKFCATTQFDATKVHSSGFKAPYTLSQGLDRTLKYEFVHEKKDDITFVSE

SEQ ID NO: 7425 - protein, 145 aa, Enterobacter cloacae
SVKASPMRVWLNWRACAKRRSASCATSMTCIRFTSAWTPVRQSSRPIPRTCTPPMKTSAKRTRPSTATRLWCWAAVQTVSARASSLTTAAYTPLWRCAKTVTRLLWSTVTRKRSLPIMTPPTASTSSRLPWKTCWKSCASRSQKA

SEQ ID NO: 7426 - protein, 231 aa, Enterobacter cloacae
FVASVVLLLSRQSRLYGDKGCQSLRFTLKRSLASFSWGGNCLHSLLQEKQKTGIFMVLIIYAHPYPQHSHANKRMLEQARTLENVEIRSLYQLYPDFNIDVAAEQEALSRADLIVWQHPMQWYSTPPLLKLWIDKVFSHGWAYGHNGNALHGKSLMWAVTTGGGESHFEIGAFPGFDVLAQPLQATALYCGLNWLPPFAMHCTFVCDDETLQAQARHYKQRLLEWQETHNG

SEQ ID NO: 7427 - protein, 95 aa, Enterobacter cloacae
PKIVRSITKIQLRAGEYTMQNKLLIASVLAATAMFTVAGCSSNQAVKTTDGKTIVTDGKPQVDDDTGLVSYKNAETGQTEQINRDQVKSMGELDN

SEQ ID NO: 7428 - protein, 658 aa, Enterobacter cloacae
TGFRLLRCTVPLSATMKPCRRRLVTTNNAYLSGRRRTMDSHTLIQALIYLGAAALIVPVAVRLGLGSVLGYLIAGCVIGPWGFRLVTDAESILHFAEIGVVLMLFVIGLELDPQRLWKLRASVFGGGALQMLACGLLLGGFCILLGMEWKVAELIGMTLALSSTAIAMQAMNERNLTVSQMGRSTFSVLLFQDIAAIPLVAMIPLLATSGASTTLGAFALSALKVVGALALVVLLGRYVTRPLLRFVARSGLREVFSAVALFLVFGFGLLLEEAGLSMAMGAFLAGVLLASSEYRHALESDIEPFKGLLLGLFFIGVGMSIDFGTLVTHPLRIIILLVGFLVIKMAMLWLIARPLNVPKPQRRWFAVLLGQGSEFAFVVFGAAQMANVLDPEWAKALTLAVALSMAATPILLVLLTRLEKTGSEQEREADEIDEEQPRVIIAGFGRFGQITGRLLLSSGVKMVILDHDPDHVDTLRKFDMKVFYGDATRVDLLESAGAAKAEVLINAIDDPETSMQMVELVKEHFPHLTIISRARDVDHYIQLRQAGVAAPERETFEGALKSGRMALESLGLGAYEARERADLFRRFNHEMVEEMVAMASSTATERAAVFKRTSTMLTEIINEDRNHLSLVQRHGWQGTEEGKHTGDPEDEPESKPSA

SEQ ID NO: 7429 - protein, 170 aa, Enterobacter cloacae
WRQFFASGKFSMISLIAALAVDRVIGMENAMPWNLPADLAWFKRTTLNKPVVMGRLTWESIGRPLPGRKNIVISSQPGTDDRVQWVKSVDEAIAACGDAEEIMVIGGGRVYEQFLPKAQKLYLTHIDAEVEGDTHFPDYDPDEWESVFSEFHDADEQNSHSYCFEILERR

SEQ ID NO: 7430 - protein, 277 aa, Enterobacter cloacae
GGGYACPSSRLVKTRLLREKGAQNGCIIAGDNLDATLALEKAKAFPGLNGMDLAKEVTTAEAYSWTQGSWTLEGDLPEAKPESELPFHVVAYDFGAKRNILRMLVDRGCRLTMVPAQTSAEDVLKMNPDGIFLSNGPGDPAPCDYAIAAIKSFLETDIPVFGICLGHQLLALASGANTVKMKFGHHGGNHPVKDIDNNTVMITAQNHGFAVDEASMPANLRVTHKSLFDGTLQGIHRTDKPAFSFQGHPEASPGPHDAAPLFDHFIELIEQYRKIAK

SEQ ID NO: 7431 - protein, 1080 aa, Enterobacter cloacae
SGAEKTMPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDVAMKKIGLDTARSGIAHNMEEALAVAAEVGYPCIIRPSFTMGGTGGGIAYNREEFEEICERGLDLSPTKELLIDESLIGWKEYEMEVVRDKNDNCIIVCSIENFDAMGIHTGDSITVAPAQTLTDKEYQIMRNASMAVLREIGVETGGSNVQFSVNPKTGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGAERIWYIADAFRAGLSVDGVFNLTNIDRWFLVQIEELVRLEEKVAELGINGLDADFLRMLKRKGFADARLAKLAGVREAEIRKLRDQYDLHPVYKRVDTCAAEFSTDTAYMYSTYEDECEANPSVDRDKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQQAVDRLKLKQPANATVTAIEMAVEKAKEIGYPLVVRPSYVLGGRAMEIVYDEADLRRYFQTAVSVSNDAPVLLDRFLDDAVEVDVDAICDGEMVLIGGIMEHIEQAGVHSGDSACSLPAYTLSQEIQDVMRQQVQKLAFELQVRGLMNVQFAVKDNEVYLIEVNPRAARTVPFVSKATGIPLAKVAARVMAGQTLAQQGVTKEIIPPYYSVKEVVLPFNKFPGVDPLLGPEMRSTGEVMGVGRTFAEAFAKAQLGSSSTMRKSGRALLSVREGDKERVVDLAAKLLKQGFELDATHGTAIVLGEAGINPRLVNKVHEGRPHIQDRIKNGEYTYIINTTAGRQAIEDSKLIRRSALQYKVHYDTTLNGGFATAMALNADATEKVISVQEMHAQISK

SEQ ID NO: 7432 - protein, 432 aa, Enterobacter cloacae
NGKSMKNWKTLLLGVAMVANTSFAAPQVVDKVAAVVNNGVVLESDVDGLMKSVKLNSGQAGQQLPDDATLRHQILERLIMDQIVLQMGQKMGVKISDEQLDQAIANIAKQNNITPDQMRSRLAYDGISYATYRNQIRKEMLISEVRNNEVRRRVTILPQEVDALAKQVGNQNDASTELNLSHILIPLPENPTSDQAAEAESQARAIVEQARNGDDFGKLAITYSADQQALKGGQMGWGRIQELPSLFAQALSTAKKGDIVGPIRSGVGFHILKVNDLRGQSQNISVTEVHARHILLKPSPIMTDDQARAKLEQIAADIKSGKTTFDKAAKEFSQDPGSANQGGDLGWAAADIYDPAFRDALMKLNKGQMSAPVHSSFGWHLIQLMDTRNVDKTDAAQKDRAYRMLFNRKFSEEAATWMQEQRASAYVKVLSN

SEQ ID NO: 7433 - protein, 166 aa, Enterobacter cloacae
RPSRTTSASAPTTFSADKANAPSVVDAPLVASSGIIATSGMAAISWNNSTEKVLRPICDTVRLRSFIACMAIAVEESASVMPINSATFHSIPSRMQNPPNSRPQASICRAPPPNTEARSFHSRCGSNSRPITNSISTTPISAKCRIDSASVTSRKPQGPITHPAIR

SEQ ID NO: 7434 - protein, 478 aa, Enterobacter cloacae
FGLLADRKLQGTARVLDQVWRFNIDYTKVSDPYYFNDFDSKYGSSTDGYATQKFSVGYAIENFDATVSTKQFQVFDTQSRSTYGAEPQLDVNWYQNDVGPFDTRVYAQAVHFVNTNSDMPESTRLHIEPTINLPWSNDWASLNTEAKVMATHYQQKNLDWYNKRYGTDLEESVNRTLPQFKMDGKLIFERDMALLADGYTQTLEPRMQYLYVPYRDQSKIQNYDSSFLQSDYSGLFRDRTYGGLDRIASANQLTTGVTTRVYDDAAVERFNVSVGQIYYFTESRTGDDDINWEKDNKTGSLVWAGDTYWRMTDRWGLRGGVQYDTRLDNIATGSAAIEYRRDEDRMLQLTYRYASPEYIQATLPNYANTDQYKDGISQVGTAASWPIADRWSVVGAYYYDTNAQKPADQMLGLQYNSCCYAIRVGYERKLNGWDTQNSQGKYDNVIGFNIELRGLSSNYGLGTQQMLRSNILPYRSSL

SEQ ID NO: 7435 - protein, 275 aa, Enterobacter cloacae
YSMTNRVHQGHLARKRFGQNFLNDQFVIDSIVSAINPQKGQAMVEIGPGLAALTEPVGERLDELTVIELDRDLAARLQTHPFLGPKLTIYQQDAMTMNFGELSEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHKTMPYPVKDLRVLSRITTEAFNQRRKTIRNSLGNLFTVDVLAELGIDPAMRAENISVEQYCKLANYISDNAPPKES

SEQ ID NO: 7436 - protein, 126 aa, Enterobacter cloacae
AMIDSPRVCVQVQSVYIESQSTPDEERFVFAYTVTIRNLGRMPVQLLGRYWLITNGNGREIEVQGEGVVGEQPHIAPGEEYQYTSGAVIETPLGTMQGHYEMVDADGNAFRIAIPVFRLAVPTLIH

SEQ ID NO: 7437 - protein, 349 aa, Enterobacter cloacae
RSRNLDAGTTRQRLRESVEQLMKPHRVVITPGEPAGIGPDLVVQLAQCSWPVELVVCADATLLQDRAALLGLPLTLLPYVEGQQPAPQQSGTLTLLSVPLRAPVVPGELHTENGHYVVETLARACDGCLQGEFAALITGPVHKGVINDAGIPFTGHTEFFEERSHSPKVVMMLATEAMRVALVTTHLPIKAIPDAITPELLREIIGILHHDLQTKFGIPQPHVLVCGLNPHAGEGGHMGTEEIDTIIPVLEEMRAKGMNLSGPLPADTLFQPKYLDNADAVLAMYHDQGLPVLKYQGFGRGVNITLGLPFIRTSVDHGTALDLAGQGKADVGSFITALNLAIKMIVNTQ

SEQ ID NO: 7438 - protein, 322 aa, Enterobacter cloacae
LKLRWVPCRAITKWSMPTVMLSALLFPYSVSPYLHLFINLMSTYLIGDVHGCYDELIALLKQVDFTPGQDTLWLTGDLVARGPGSLDVLRYVKSLGDSVRMVLGNHDLHLLAVYAGISRNKPKDRITPLLEAPDADELLNWLRRQPLLQIDEEKKLVMAHAGITPQWDLETAKTCARDTEAVLASDSYPFFLDAMYGDMPNNWSDDLSGLARLRFITNAFTRMRYCFPNGQLDMYCKDTPENAPAPLKPWFAIPGPVTNEYSVVFGHWASLEGKGTPENIYALDTGCCWGGDLTCLRWEDKTYFVQPSNRQLDLGEGEAVAS

SEQ ID NO: 7439 - protein, 156 aa, Enterobacter cloacae
CAAGCQQRDHRHQRDGSNILEQQYGEGAAPHLRHRQVTLVHSLHGNSRRGERQRHADQLRDFPLHPEQNAEPAQQQTAGQHLQSTSAKHRGAQFPQPLRIQLQANHEQHKHHADLRKMQDRLGIRHQPKTPGANYTPGNQIAEHRAQPQTNRHGHN

SEQ ID NO: 7440 - protein, 1033 aa, Enterobacter cloacae
KNNNFMLFCFELNLKDSQYTFYTRYLMFLLTQMDVYMSKKFFKLNNTTKTLGKIFPALLICTPAVAFSAIIDQSTSVPQDFSADAEYVINKDVTISSAGSEAAVSVTGFTTTTTTNYGNISGTGNGLDINTGEQRILINNDIGATISSTTANAVNIQSMLGDFNNSGNIIGAENGMFVGENSSAVNIINTSTGMIKGKTGLSTRYGIGINNSGAIIGTNGDAITATNGNTKLTNNALVQGTENGINVKDTAKLDIKNSGTISGNTAAIMFASNKNNTLVLDTGSVLVGDVISTNSTGNTLTLIGTGTEDSNFVGLNEGDGFASVTMNGENWALSGDIDIIGSVDSLMIDKGALTLAGEVSNTGNTRVAKHASLQLGDGEKTATLSGGITNNGTVIFNQGSDFTFATDMTGSGNVEKVDSNTLTLTGKNSYKGDTVLHGGTTLVSTGATLGVKGSNATVTVENGATFATAGEVNNNIAVLSGGTLAAWNAVQGNSTLSASDVDTINGNVTNGGTLLLSAADNSVGNNFSINGDYTGSDGSQIVMNSTLGEDNSPTDHLTITGSSFGQSGVSITNIGGAGAQTINGMEIVSIGGSSEAQLTLAKPVVAGAWEYNLYQHSDGNWYLESKATPSDDPSDDTDDGGNTDDGGNTDNGGNTDNGGNTDNGGNTDNGGNTDNGGNTDNGGNTDNGGNTDNGGNTDNGGNTDNGGNTDNGGSTDNGGNNAPEVMAPEVGAYLGNYLAAQGMFLHKRDDRDQITFRNEDDLNTWMYVKGRYHENDAGGNKVSYDTTTTVLQVGSDFMSKPMDNGILRAGGMFGAGQAKTHSDAKHNVRDAQGKVDGFNVGLYATWQEDQKLRLGSYVDTWAAYSWYNNKVTSNRNDEDYDSEGFAASVEVGHAWVIQSENERTWKIEPQAQVIYSYLDQENHTDRDGVRVTTLDNDSVFGRLGVKASYFQQKDVKAWQPYVAVNWLKGAGQNDLAFNDETVSNDTPEDRGQLELGVTGNLNETTTISLRASGEWGENSYAAYGGHILLNHRW

SEQ ID NO: 7441 - protein, 406 aa, Enterobacter cloacae
RFMSPIEKSSKLDNVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDAAQHHSIAALAPDLLTVTFNGLSKTYRVAGFRQGWMVLNGPKKHAKGYIEGLEMLASMRLCANVPAQHAIQTALGGYQSISEFIVPGGRLYEQRNRAWELINDIPGVSCVKPNGALYMFPKIDAKRFNIHDDQKMVLDFLLQEKVLLVQGTAFNWPWPDHVRIVTLPREDDLEMAISRFGRFLSGYHQ

SEQ ID NO: 7442 - protein, 200 aa, Enterobacter cloacae
PMSQSHFFAHLSRLKLINRWPLMRNVRTENVSEHSLQVAMVAHALAAIKNRKFNGQVNAERIALLAMYHDASEVLTGDLPTPVKYFNSQIAQEYKAIEKIAQQKLIDMVPEELRDIFGPLIDEHQYTEEEKSLVKQADALCAYLKCLEELSAGNNEFLLAKTRLEKTLESRRSEEMDYFMRMFVPSFHLSLDEISQDSPL

SEQ ID NO: 7443 - protein, 144 aa, Enterobacter cloacae
RMKLNRVLSAGRCMSLTRKRRSTGKVTLADVAQLAGVGTMTVSRALRTPEQVSDKLREKIEAAVQELGYMPNLAASALASASSWTIAMVVPNLSEAGCSEMFAGLQQVLQPAGYQIMLAESQHRLEQEEKLLETLLASNIAAAI

SEQ ID NO: 7444 - protein, 207 aa, Enterobacter cloacae
LSVEHFDTVRHWLKNAYIPVMEMGAMRADPIDMNIGIDNVAAMYELTEMVIQRGYQNIGVLCANQEQWIFQQHLQGWYKAMLRHHLAPNRVINAAMPPNFSTGAAQLPEFLLAWPELDALVCVSDELACGALYECQRRRIKVPDDLAVVGFGDSDVSRVCQPPLTTMAVPHRKIGIEAGKALLERLNDGDWRDHKPIASSLCLRESC

SEQ ID NO: 7445 - protein, 412 aa, Enterobacter cloacae
RFFSHVSIIGTSMSSKLVLVLNCGSSSLKFAIIDALNGDEYLSGLAECFHLPEARIKWKMDGSKQEAALGAGAAHSEALNFIVNTILAQKPELSAQLTAIGHRIVHGGEKYTSSVVIDDSVIQGIKDSASFAPLHNPAHLIGIAEALKSFPSLKDKNVAVFDTAFHQTMPEESYLYALPYSLYKEHGVRRYGAHGTSHFYVTQEAAKVLNKPVEEVNIITCHLGNGGSVSAIRNGKCVDTSMGLTPLEGLVMGTRSGDIDPAIIFHLHDTLGMSVDDINKMLTKESGLLGLTEVTSDCRYVEDNYAEKADAKRAMDVYCHRLAKYIGSYTALMEGRLDAVIFTGGIGENAAMVRELSLGKLGVLGFEVDHERNLAARFGKSGFINKEGTRPAIVIPTNEELVIAQDAHRLTA

SEQ ID NO: 7446 - protein, 714 aa, Enterobacter cloacae
TVSRTIMLIPTGTSVGLTSVSLGVIRAMERKGVRLSVFKPIAQPRAGGDAPDQTTTIVRKNSNLPAAEPLKMSHVESLLSSNQKDVLMEEIIANYHANAQDAEVVLVEGLVPTRKHQFAQSLNFEIAKTLNAEIVFVMSQGTDTPEQLKERIELTRSSFGGAKNTSITGVIVNKLNAPVDEQGRTRPDLSEIFDDSSKAKVIKVDPAKLQDSSPLPVLGAVPWSFDLIATRAIDMARHLNATVINEGDINTRRVKSVTFCARSIPHMLEHFRAGSLLVTSADRPDVLVAACLAAMNGVEIGAILLTGGYEMDARISKLCERAFATGLPVFMVNTNTWQTSLSLQSFNLEVPVDDHERIEKVQEYVAGYINADWIESLTATSERSRRLSPPAFRYQLTELARKAGKRVVLPEGDEPRTVKAAAICAERGIATCVLLGNPDEINRVAASQGVELGAGIEIVDPEVVRESYVARLVELRKNKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRIAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSSQQQ

SEQ ID NO: 7447 - protein, 211 aa, Enterobacter cloacae
RLIRKLHHNCKRAERALRREGFPMVEQNHLASTEWVDIVSEENEVIAQASREQMRAERLRHRATYIVVHDGMGKILVQRRTDTKDFLPGMLDATAGGVVQADEVLLDSARREAEEELGIAGVPFAEHGQFYFEDEHCRVWGGLFSCVSHGPFALQEEEVSEVSWMTPEEITARCDEFTPDSLKALALWMTRNAKNESAKPENKAEKEEEAE

SEQ ID NO: 7448 - protein, 101 aa, Enterobacter cloacae
WGVLYSKKGITMKIMAICGSGLGSSFMVEMNIKKVLKKLEIEAEVEHSDLSSATPGAADLFVMAKDIAASASVPESQLVVINNIIDINELEAQLRAWFERQ

SEQ ID NO: 7449 - protein, 467 aa, Enterobacter cloacae
GEVDMFILETLNFVVDILKVPSVLVGLIALIGLVAQKKAFSDVVKGTIKTILGFIVLGGGATVLVGSLNPLGGMFEHAFNIQGIIPNNEAIVSIALEKYGASTALIMAFGMVANIIVARFTRLKYIFLTGHHTFYMACMIGVILTVAGFEGVGLVFTGSLILGLIMAFFPAIAQRYMKRITGNDEIAFGHFGTLGYVLSGWIGSKVGKGSRSTEEMNLPKNLSFLRDSSISISLTMMIIYLIMAVSAGREYVEATFSGGQNYLVYAIIMAITFAAGVFIILQGVRLILAEIVPAFTGFSEKLVPNARPALDCPVVYPYAPNAVLIGFLFSFLGGIVGLFICGQFSWVLILPGVVPHFFTGATAGVFGNATGGRRGAMIGAFANGLLITFLPVLLLPVLGAIGFANTTFSDADFGAVGIVLGNLARFLSPFAITGLVVVLFALLVAYNVFAKNKPASGNAQENPGAKS

SEQ ID NO: 7450 - protein, 335 aa, Enterobacter cloacae
LRRAKRRSTRRFANWRLHMIKVAPTGQKDAVEMRKVYAGFVAKQIEAGSEIIALEADLMSSMAMDGVARDYPQHVINCGIMEANVIGTAAGLSLTGRKPFVHTFTAFASRRCFDQLFMSLDYQRNNVKVIASDAGVTACHNGGTHMSFEDMGIVRGLAHSVVLEVTDAVMFEDVLRQLIDLEGFYWVRTIRKQAPSVYAPGSTFTIGKGNVLREGTDITLIANGIMVAEALEAARQLEQEGVSAAVIDMFTLKPIDRMLVKNYAEKTGRIVTCENHSIHNGLGSAVAEVLVETCPVPLRRVGVKERYGQVGTQDFLQKEYGLTAHDIVSAARELL

SEQ ID NO: 7451 - protein, 154 aa, Enterobacter cloacae
GTAMSTPEIPSVNFFSLFRRGQHYAKTWPMEKRLAPMFIENRTIRATRYAIRFMPPIAVFTLCWQIALGGQLGPAVATALFALSLPMQGLWWLGKRSVTPLPPSILHWFYEVRGKLEEAGQALAPVEGKPDYQALADTLKRAFKQLDKTFLDDL

SEQ ID NO: 7452 - protein, 225 aa, Enterobacter cloacae
CLTEVRVQCKGFLFDLDGTLVDSLPVVERSWCHWADRHGIDHQDVLNFIHGKQAITSLRHFLAGRSEEEIQAEFRYLEQIEATDTEGITALPGARELLEHLNEAQIPWAIVTSGSVPVAHARHKAAGLPTPDVFITAERVKRGKPEPDAFLLGAELLGLAPAECVVVEDAAAGVLAGLNAGSHVIAVNVPAGSPRLEEADFVLNTLTAIDVSKASDGVVTVSLKM

SEQ ID NO: 7453 - protein, 614 aa, Enterobacter cloacae
QGHVVNGELIWVLSLLLIAIILFATGKVRMDAVALFVIVAFVLSGTLSLPEAFSGFSDPNVILIAALFIIGDGLVRTGVATMMGSWLVKVAGSSETKMLIYLMLTVAGLGAFMSSTGVVAIFIPVVLSVCMRMQISPSRLMMPLSFAGLISGMMTLVATPPNLVVNSELIREGLEGFSFFSVTPIGLVVLVMGIIYMLLTRFALKGEKQDKAKEGWKRRSFRDLIKEYRLTGRARRLAIRPGSPMVGQRLDDLKLRERYGANVIGVERWRRFRRVIVNVNGVSEFRARDVLLIDMSTADVDLREFCSEQLLEPMVLRGEYFSDQALDVGMAEVSLIPESELLGKTVREIGFRTRYGLNVVGLKRDGVALEGAVVDEPILLGDIFLVVGNWKLISQLGQKGRDFVVLNMPIEESDASPAHSQAPHAIFCLVLMVALMLTDEIPNPVAAIIACLLMGKFRCIDAESAYKAIHWPSIILIVGMMPFALALQKTGGVDLIVKGLMDAGGGYGPYLMMVCLFVMCATIGLFISNTATAVLMAPIALAMAKSMGVSPYPFAMMVAMAASAAFMTPVSSPVNTLVLGPGNYRFSDFVKLGVPFTVLVMVVCVVLIPVLFPF

SEQ ID NO: 7454 - protein, 298 aa, Enterobacter cloacae
KDMINANRPIMNLDLDLLRTFVAVADLNTFAAAAAAVCRTQSAVSQQMQRLEQLVGKELFARHGRNKLLTEHGIQLLGYARKILRFNDEACMSLMFSNLQGVLTLGASDESADTILPFLLNRISSVYPKLALDVSVKRNAFMVEMLTENEVDLVVTTHRPGQFDSLTLRTSPTHWYCAAEYVLQKGEPIPLVLLDDPSPFRDMVLAALNEASIPWRLAYVASTLPAVRAAVKAGLGVTARPVEMMSPDLRVLGQSEGLPSLPDTEYLLCHNAASNNELAKVVFEAMENYHNPWQYAAV

SEQ ID NO: 7455 - protein, 184 aa, Enterobacter cloacae
LMKLMFASDIHGSLPATERVLSLFAQSGAQWLVILGDVLNHGPRNALPEGYAPAQVAEKLNHFASRIIAVRGNCDSEVDQMLLHFPITAPWQQVLMENSRLFLTHGHLFGPDNLPSLAAGDVLVYGHTHIPVAEKRGAFYHFNPGSVSIPKGGNPASYGMYEDGTLSVIALNDQQVIAQIAINP

SEQ ID NO: 7456 - protein, 148 aa, Enterobacter cloacae
KMLKKWIYDTTIILQDSVESWPQALELCAKPLLDLQVIAPEYVTAIIEKHHTLGPYYVLAPGLAMPHARPEEGAKGLGLSLLKLKQGVSFGAGEFDPVDVIVMLAAPDKHSHIEMISALAELFSSDEDMAELHRANTLEEIKTIIDRF

SEQ ID NO: 7457 - protein, 285 aa, Enterobacter cloacae
RAGKPRSQIMNENEITELARQIRLETLKSLTQLGFGHYGGSMSVVETLAVLYGAVMKIDPADPDWPERDYFVLSKGHAGPALYSTLAIKGYFPIDELSTLNQNGTRLPSHPDRLKTRGVDATTGSLGQGISIAGGMALSHKLAGRPNRVFCIVGDGELNEGQCWEAFQFIAHHRLNNLTVFVDWNKQQLDGELDEIISAFDLEGKFRAFGFDVVTVKGDDIPALLEVTAPIPAADARPRVVILDSIKGQGVPYLEQLSNSHHLRLTEESKAALNETIRQLEASHD

SEQ ID NO: 7458 - protein, 182 aa, Enterobacter cloacae
QSVTVSFFYSAMRYRSRKMEMTHAQRLILSNQYKMMTMLDPDNAARYSRLQTIVERGFGLQMRELDREFGELKEETCRIVIDIMEMYHALHVSWTNLKDQQTIDERRVTFLGFDAATEARYLSYVRFMVNTEGRYTHFDAGTHGFNAQTPMWDKYQRMLSAWHACPRQYHLSSNEIQQIINA

SEQ ID NO: 7459 - protein, 71 aa, Enterobacter cloacae
PVKGITGAVLRLIVLFTDSVDLDAAFLSADQGCSGAYGLLLLNNASATGEQYRYRQAKNHIFHRGYIPGHS

SEQ ID NO: 7460 - protein, 460 aa, Enterobacter cloacae
IVLKQVPGNALTGPTKCPALTDAASWQMQYGGYMTWFIDRRLNGKNKSTVNRQRFLRRYKAQIKQSISEAINKRSVTDVDSGESVSIPNDDISEPMFHQGRGGLRHRVHPGNDHFVQNDRIERPQGGGGGSGSGQGQASQDGEGQDEFVFQISKDEYLDLLFEDLALPNLRKNQHRQLNEYKTHRAGYTANGVPANISVVRSLQNSLARRTAMTAGKRRELRELETSLKVVENTEPAQLLEEERLRKEIAELRAKIDRVPFIDTFDLRYKNYEKRPEPSSQAVMFCLMDVSGSMDQATKDMAKRFYILLYLFLSRTYKNVEVVYIRHHTQAKEVDEHEFFYSQETGGTIVSSALKLMDEVVKERYDPAQWNIYAAQASDGDNWADDSPLCHEILAKKILPVVRYYSYIEITRRAHQTLWREYEHLQAMFDNFAMQHIRDQDDIYPVFRELFQKQSSTTSN

SEQ ID NO: 7461 - protein, 87 aa, Enterobacter cloacae
VKTVRARAHNNGRNPNWTSYEKLRTVIEKKMFSNTEELLPVISFNAKTSTDEQKKHDDFVDRMMEKGYTRKQVRLLCEWYLRVRKSS

SEQ ID NO: 7462 - protein, 1120 aa, Enterobacter cloacae
RSVCGSNESVNVMADVASLAVGLHLNAANFKSQLMGAYGDAENSSKRFNRNAQEDAKRTDEAYSRMGKTIAGVAGRLAGFAGAGLSLGAIITTTREYGQALSDLSAITGATGAQLKSLDEAAQEMGRSTEYSASQAVEALKLMASAKPELLQTADGLTEATKSALTLAQAAGSTLPDATRTLALSLNQFGAGAQEADRYINVLAAGAKFGASEIADTAAAIKNGGVAAAQAGVGFETLNAAIQVLAEREIKGGEAGTALRNVILALEKGTDKTLKPSVVGLSGALDNLSKKNLSTAQAVKLFGVENINAASVLVDNRSKLNALTLALTGTQTAHEQAAIRVNNLNGDIMGLTSAFEGMIIKIGQSSTGPLRSGIQSVTDGINLLTDNFNAVASVALYTLIPVLSTKLTAGLRENISAWQQNQAAVKAAAAAQADGARKTLEATSATLKRNDAEFGYYRQLEKTARQHGLNVNYQGEFNRLIREETEQTNLATRAKMQLAAANRQVSLTARAASVAVGLARGALALVGGPFGAAMLAGSALLYFHQQAKDARQSAINLKDAVIETTAALMQMSDKQLAVKQIDLQDQYENQVTQRNQLIKEIQDADSRLDSLGGFDPFRQKKGVEDSKKRAEADLEAVNKGLETTQSNLENVSKARFLVQTGIADQAKSLANDIKNITAQTAKAGEGVTTPWTGEDTQKARKETVNQYLQLRREIEEAHATSLGKIDLQEKASQEKLIAAARKNGASQQDLQRALLMNAENYQKQRNELAEQYSPARSAINKEKEASQELKSLLDARLLTEKEYMAARVTLSQETSRQILQAQANALSAPRLELAGDVDPLAQQRNQLAQQQSLVETYYRNGALSKQQYEMLMQKSSKDSADAQYQTALELYRSQSEFNNLAIGLVEATRERTTNVLTGLLTKTQTFKEGVINLFSTLTQSIIQNLVDMAAQALVTNTILSSIMGVGSSVLGGVGGSTAGSSGTAIADYGSNFQFNAKGGVYSSSDLSAYSGQVVDNPTFFAFAKGAGVMGEAGPEAIMPLTRAADGSLGVRAVSGGASEGAAPQVFITINGDGSTASQSSGGLEKFGKSVGNFVRDEYRKLIQADLRPGGAIWNSTNGRR

SEQ ID NO: 7463 - protein, 1339 aa, Enterobacter cloacae
PCIVCVWRGDKYRRTGLPGSAPLRPPANRRGNYFRRDLCRRSAVDNKPFYKPPSGGFFYGRDMANKITGRKGGSSSSRTPTEQPDDLQSVAKAKILVALGEGEFAGQLTGKDIYLDGTALENADGSQNFSGVTWEFRSGTQAQKYIQGIPGTENEISVGTEVTSATAWTRTFTNTQLSAVRLRLKWPSLFKQEDDGDLVGYSVNYAIDLQTDGGTWQTVLNTSVTGKTTSGYERSHRIDLPQAGSTWTIRLRKITADANSAKIGDTMTLQSFTEVIDAKLRYPNTALLYIEFDSSQFNGSIPQISCEPRGRVIRVPDTYDPETRSYSGTWTGAFKWAWTDNPAWIFYDLVVSDRFGLGHRLTAANIDKWTLYQVAQYCDQMVPDGKGGDGTEPRYTCNVYIQDRNDAYTVLRDFAAIFRGMTYWGGDQIVALADMPRDVDYSYTRANVVGGRFTYSSSTTKTRYTTALVSWSDPGNAYADAMEPVFEQALVARYGFNQLEMTAIGCTRQSEANRKGRWGILTNNKDRVVSFDVGLDGNIPQPGYIIAVADELLSGKVMGGRISAVNGRVIKLDRVADAAAGDRLILNLPSGASQSRTIQAVNGESVTVTTAYSETPQAEAVWVVESNELYAQQYRVVSVADNDDGTFTITGAWHDPDKYARIDTGAIIDQRPVSVIPPGNQTPPANIVISSFSVVQQNISVETMRVSWDQAQNAVAYEAQWRRNDGNWVNVPRSSTTSYDVPGIYAGRYLVRVRAINAAEISSGWGYSEEKTLTGKVGNPPKPVGFIASDNVVFGIELSWGFPANTDDTLKTEIQYSLTGREDDAMLLADVPYPQRKYQQMGLKAGQTFWYRAQLVDRSGNESGYTDFVRGQASIDVSDITDAILEDMKGSDTFKDLIENAVDSSGKLAELADAIKENADGLAAAVGSNKQTAEAIIGNALAIADVVVRQTAQQGANSATFEQLREVIATETEARVTDVTRLEAKTAQNEAGVTEVRQALSDEAQARATAVDQLTASTQVISDKADSASSKADAASGKADAAEQASSQNTADITTLRQVVTDTTSSMASRLEELGARTDTASGGIQNNAIALITSTLAQVDQRVRLSAQYGDSKASIDRIDNVMASDREATARSLLSLQTDVNGNKASINSLNQTFSDYQQATATQINGITATINGHTSAITTNAQAIANVNGDLKAMYSIKVGLASNGQYYAAGMGIGVENTPSGMQSQVIFVADRFAVTHQAGATVTLPFVIQNGQVFIRDALIGDGTINNNKIGKYIQSNNFVAGSVGWRLDKGGTFENYGSTAGEGAMKQTNQTISVKDANNVLRVQIGRITGTW

SEQ ID NO: 7464 - protein, 253 aa, Enterobacter cloacae
TMSLNADYQKLESGNDVRLIEVDGSSFGLTEVLRFHNYNIPHTEEEIVAAGGDEAKLPAKPIWWQGNEYSAWPYQLEGLEKSTSGSNATPSLTVANIESSISALCLAYDDLLQAKVTIHDTKAKYLDAKNFAGGNPTADPTQEKLQVWYIDGKTTELAGETIEFVLSSPMDLQGQMIPTRQLHSLCTWCIRNKYRTGDGCDYAGTRYFDKNNNPVSDPSLDECNGTLTACKLRFGESNELSFGGFPGTSLIRS

SEQ ID NO: 7465 - protein, 202 aa, Enterobacter cloacae
KVEGTMQEVMTRIELGGEPGKIFGKIHHRLINKVSEAGTALAKTIPGFESYMISSKSRGLTFAIFKGKKNIGVDDLGFPVTGEVIRIVPVIIGSKKDGLLQTILGAVIIAASAIGSYFAPGNPISAFGYKFGAAMMLGGVVQMLSPQPTGLASKQSADNRASYAFGGVTNTAAQGYPVPLLYGRRRIGGAIISAGIYVEDQQ

SEQ ID NO: 7466 - protein, 223 aa, Enterobacter cloacae
MAEYGVLLTTTSGEVWVTANSSPIALQARKTAALQGTSGFNTKVTHTFPAGQPVVAFVHCTVEVEITQTISGNTITIDFLRPNATGTAYVYFFSIFPQTKPDYGLAVWDASGTLILTNETRTLSDVVTLGTAGVDASSGYNINTTLVGKWACMPAMLGLITGVISAGGQPQPYSAIYKSMAKLEGSNTRIFARPQTTPGGNLQNVTYSNLRNVIMAINCANYD

SEQ ID NO: 7467 - protein, 119 aa, Enterobacter cloacae
PVLDSEKHGECPLMGFASPATDYVERQLSPSVLCNIGAESRVLETDVGFAVIEPATKKRPGDVLLILCDGHTQFAKLMGKSLITDDGEAIEGTALEEVEVLGRVTFFINRALDDDCPAI

SEQ ID NO: 7468 - protein, 373 aa, Enterobacter cloacae
KEGQKSGRLSEETKAAVDKMASEFNALREAEKTLKAAMGELEQHVAQMPLANAKQVIESVGHQVISAEALKTFASSVEGGKRISIPVKAALTSVDVPDGVVEPQRLPGIDTAPKQRLFIRDLIAPGRTSSSAIFWVQQTGFTNNAKVVPENTQKPYSEIEFTPKITGVSTIAHLFKASKQILDDFAQLQSTVDAEMRYGLKYAEEQEILFGDGTGVHLHGIVPQASAFNPAFTVEQQSGIDDLRLAMLQAQLARFPASGHVLHFIDWARIELTKDSLGRYILANPAALTGPTLWGLPVVATEAAAFQGKFLTGAFNAGAQIFDREDANVVISTENADDFEKNMITIRCEERLALAVKRPEAFVYGSFSTGAGS

SEQ ID NO: 7469 - protein, 128 aa, Enterobacter cloacae
SSSRRGNLEQYKREAVMALETFNWSPRVNPSQDVTMRTREAQFGDGYTQTSGDGLNPRSQSWDLTFVGLEPYIKSIKDFLDRHEGTKAFAWKPPLEDLGLYRCKQYKPSPMGGGNWSLTATFIQAFKP

SEQ ID NO: 7470 - protein, 240 aa, Enterobacter cloacae
SGADMRQKTIDAIMAHAAAEYPRECCGVVAQKSRVERYFPCRNLAATPEDNFVLCPEDYAAAEDWGTVIAIVHSHPDATTQPSELDKAQCDATLLPWHIVSWPEGDLRTIQPRGELPLLERPFVLGHFDCWGLVMSYFRQTHGIELHDYRVDYPWWEKDYPDNFYQDCWYECGFREFDGPPKPGDMVIMQVQADKWNHAGILLEGNMLLHHLYGHLSQRVPYGGYWQERTMKILRYKSLC

SEQ ID NO: 7471 - protein, 465 aa, Enterobacter cloacae
PAVSLRMGGAVCRHRHRHQHLNVFISLRNASRKNGHQSVTLSVTIKTHEEKGMRKALLAVAVAGTLSVTFGAQAQDTPDGYQLEQVLIMSRHNLRAPLANNGSVLEQSTPKQWPEWDVPGGQLTTKGGVLEVYMGHYMREWLAEQGMVKTGECPPADTVYAYANSLQRTVATAQFFITGAFPGCDVPVHHQEKMGTMDPTFNPVITDNSPEFREKALKAMETERQKMQLDESYKLLEQLTNYSDSPSCKEKKVCSLTEAKDTFSADYEKEPGVSGPLKVGNSLVDAFTLQYYEGFPTDQVAWGEIKTDQQWRVLSKLKNGYQDSLFTSTEVAQNVAKPLVKYIDKALVTDQAKAPKITLLVGHDSNIASLLTALDFRPYQLHDQQERTPIGGKIVFQRWHDKNTNQELMKIEYVYQSSDQLRNASVLSLQSPAQRVTLELKGCPVDGNGFCPVDKFNAVMDNAAK

SEQ ID NO: 7472 - protein, 64 aa, Enterobacter cloacae
CFTLWRLEMANHRGGSGNFAEDRERASEAGRKGGQSSGGNFKNDPQRASEAGKKGGKNSHGSNK

SEQ ID NO: 7473 - protein, 221 aa, Enterobacter cloacae
AQDRKWRAKMTQGAVKTPGKRSQAVSAKKQAILSAALETFSQFGIHGTRLEQVAEQAGVSKTNLLYYYPSKEALYVAVMQQILDIWLAPLKAFREELAPLVAIEEYIRLKLEVSRDYPQASRLFCLEMLQGAPLLQAELTGDLKQLVDDKSAIIAGWVASGKLAPVDPHQLIFMIWASTQHYADFAAQVEAVTGKTLQDEAFFQSTLENVQRMIIEGIRVR

SEQ ID NO: 7474 - protein, 216 aa, Enterobacter cloacae
MWFSMLALASASITGPMSVVRRPGLPMRHSAIAPRSIFSVWSATSSCKHSTRRAEQRWPALSKAEASTSTTTCSVSAEESTIMAFMPPVSAISGVGRPCASRRVAMLRCSREATSVEPVNITPRTRLSEVSLAPTVSPRPGSSCTTPAGTPASSRMLMPWAAISGVCSAGFASTLLPAARAAAIWPVKIASGKFHGLIHTTGPSGRWVSLSKSSRT

SEQ ID NO: 7475 - protein, 177 aa, Enterobacter cloacae
MENSFVTGESKMAWLDTLLDHFAHYPTHLFALLVVMALSKSTVLVSSVLPPASVMLMAGIAVSQSSLHPGMTWLAVVMGATAGSVLNYHIGQLMGHTRLVSRLTAKHADKILRVQHQLQKNGVVALFTSRFLAVLRYIVPLAAGMLRMSAMKVYVVSLLSACAWAALYVGIVTGISI

SEQ ID NO: 7476 - protein, 502 aa, Enterobacter cloacae
MAISTPMLVTFLVYIFGMILIGFLAWRSTKNFDDYILGGRSLGPMVTALSAGASDMSGWLLMGLPGAIFISGISESWIAIGLTVGAWINWKLVAGRLRVHTEANNNALTLPDYFTGRFEDNSRILRIISAVVILLFFTIYCASGIVAGARLFESTFGMSYETALWAGAAATILYTFVGGFLAVSWTDTVQASLMIFALILTPVIVIFTVGGFGESLEVIKQKSIENVDMLKGLNFVAIVSLMGWGLGYFGQPHILARFMAADSHHTIVHARRISMTWMILCLAGACAVGFFGIAYFNNNPAQAGAVNQNAERVFIELAQILFNPWIAGILLSAILAAVMSTLSCQLLVCSSAITEDLYKAFLRKGASQKELVWVGRFMVLLVALVAIALAANPENRVLGLVSYAWAGFGAAFGPVVLFSVMWSRMTRNGALAGMIIGAVTVIVWKQFAWLGLYEIIPGFIFGSIGIVVFSLLGKAPSASMQKRFAEADAHYHTAPPTKLQAE

SEQ ID NO: 7477 - protein, 324 aa, Enterobacter cloacae
TVIKGIAHYRIDSSCWCPMSVSRFTLSIKPQEAILILITMFWGGTFLAVQYAVTMSDPFFFVGLRFATAAVAVALISLKTLRGLTLRELKAGVAIGVAIAMGYSLQTWGLQSISSSKSAFITAMYVPLVPLLQWLCLGRMPGLMSCIGIVLAFIGLILLAGPENNLLALGPGEIITLVGAVAIAAEIILISAWAGKVDVKRVTVVQLATASLVAFATMVPAGESVPPMSTGLIVVALGLGIFSAIIQVTMNWAQRSVSPTRATVIYTGEPVWAGIFGRLAGERLPLLALVGAAFIIAGVLVSELKLKKRRKATAGLSAEQRADS

SEQ ID NO: 7478 - protein, 363 aa, Enterobacter cloacae
DVLQLIVIEIALAFFFLHAESGLFIIKYVSGFFESLLKFAAEGTNFVFGGMGEKGLAFIFLGVLCPIIFISALIGILQHWRILPIFIRVIGTLLSKLNGMGKLESFNAVSSLILGQSENFIAYKGVLGDLSSRRLFTMAATAMSTVSLSIVGAYMTMLDAKFVVAALILNMFSTFIILSVINPTRPEAEPDIKLEKLHESQSFFEMLGEYILAGFKVAMIILAMLIGFIALISAVNALFSSIFGMSFQQILGYVFYPLAWLIGIPLSDALNAGSIMATKLVANEFVAMIELQKIAHQMSPRGLGILSVFLVSFANFASIGIVAGAIKGLNEQQGNVVSRFGLRLVYGATLVSLLSASFAGLVL

SEQ ID NO: 7479 - protein, 107 aa, Enterobacter cloacae
PGQPQPSPPDDPSGEGRLLGQRNQTRPDGRSGRLSGLYPQGLHRRLLPRLREKTARRAEPDLSAVRHPQRPHPGGDLQPGGSELLSGPVRVPVSARHGRTAVRAGDR

SEQ ID NO: 7480 - protein, 146 aa, Enterobacter cloacae
FLRRAGSPARPYRLRRTAMPKSVIIPPGTSTPIAPFVPGTLADGVVYVSGTLPFDKDNNVVFINDPKGQTRHVLETIKTVIETAGGTMEDVTFNSIFITDWKNYAAINEIYAEFFPGDKPARFCIQCGLVKPEALVEIATVAHIAK

SEQ ID NO: 7481 - protein, 371 aa, Enterobacter cloacae
LPLRDTVYSAEPRTWGSPFRHALSCSPLRDFIIQREFTMSYAIHNQNLAFNDSAIAQYMNTDFIVIDISLCVALAREQFFEKLKDDDIPSHIFIEDNGRIAGLIAVRKLLQATDTVQPVKGLMISDFIQLKPEDERADVAGLLAHAGADVVPVVTHGKLVGCLTEREIAHLLEDDVTEDAQLQGATLPLEKPYLETSAFSLWKKRSVWLLLLFVAEAYTSSVIQHFEEALESAIALAFFIPLLIGTGGNSGTQITSTLVRAMALGEVHLRDVGRVLRKEMSTSLMIAATLGLAGCVRAWMMGIGMEITLIVSLTLVCITLWSAIVSSVIPMVLKRCKIDPAVVSAPFIATLIDGTGLIIYFKIAQYTLGLE

SEQ ID NO: 7482 - protein, 178 aa, Enterobacter cloacae
LCLTTIMNFLFISDNYYLCHGVSSSLTSTHLIRDDADIHDLDGVDQAMDFIIAIEQDKLRNKTIRQVKKVKCDYIVLMHEIEANSAVRIDNIIYSSMHFTAHPFQQLMRFYRALRTHSFTRREYDVLKLFHLENHEIAKKLQLSQKTTSTYRVRILEKLNMRSKNILAMTRVKSAIVD

SEQ ID NO: 7483 - protein, 1363 aa, Enterobacter cloacae
SLTIHSFSSLQTRSHLTRLHKVATWWIFHAINRTLLQNNRSFGMGMTTMGVKLDDATRERIKTAATRIDRTPHWLIKQAIFNYLERLESEEGLPELPALLAGAANESEEAATAVEENHQPFLEFAEQILPQSVSRAAITGAYRRAETDAVPMLLEQARLPEAVAAQAHSLAYQLADKLRNQKTASGRAGMVQGLLQEFSLSSQEGVALMCLAEALLRIPDKATRDALIRDKISNGNWHSHIGRSPSLFVNAATWGLLFTGKLVSTHNEANLSRSLNRIIGKSGEPLIRKGVDMAMRLMGEQFVTGETIAEALANARKLEDKGFRYSYDMLGEAALTAADAQAYMVSYQQAIHAIGKASNGRGIYEGPGISIKLSALHPRYSRAQYDRVMEELYPRLKSLTLLARQYDIGINIDAEDADRLEISLDLLEKLCFEPELAGWNGIGFVIQAYQKRCPFVIDYLIDLASRSRRRLMIRLVKGAYWDSEIKRAQMEGLEGYPVYTRKVYTDVSYLACAKKLLGVPNLIYPQFATHNAHTLAAIYSLAGQNYYPGQYEFQCLHGMGEPLYEQVTGKVADGKLNRPCRIYAPVGTHETLLAYLVRRLLENGANTSFVNRIADTTLPLDELVADPVQAVEKMAAQEGQIGLPHPKIALPRELYGAGRVNSAGLDLANEHRLASLSSALLNSALQKWQARPILEQSVEDGEMQPVINPAEPKDIVGYVREATETEVEQALESAVNNAPIWFATPPQERAAILERAAVLMEDQMQQLIGILVREAGKTLSNAIAEVREAVDFLHYYAGQVRDDFDNETHRPLGPVVCISPWNFPLAIFTGQIAAALAAGNSVLAKPAEQTPLIAAQGINILLEAGVPAGVVQLLPGRGETVGAKLTSDNRVRGVMFTGSTEVASLLQRNIATRLDAQGRPTPLIAETGGMNAMIVDSSALTEQVVVDVLASAFDSAGQRCSALRVLCLQDDVADHTLKMLRGAMAECRMGNPGRLTTDIGPVIDAEAKANIENHIQTMRAKGRPVFQAVRENSEDAREWQTGTFVPPTLIELASFDELKKEVFGPVLHVVRYNRNNLNELIDQINASGYGLTLGVHTRIDETIAQVTGNAKVGNLYVNRNMVGAVVGVQPFGGEGLSGTGPKAGGPLYLYRLLANRPENALGVTLARQDAEYPVDAQVKAVLTQPLDALIKWAENRPELRAIAQQYGELAQAGTQRLLPGPTGERNTWTLMPRERVLCVADNEQDALVQLAAATATGCEVLWPEDALHRDLAKQLPKAVSARIRFAKADALLTQPFDAVIYHGDSDQLRELCEQVAARSGAIVSVQGFARGETNLLLERLYVERSLSVNTAAAGGNASLMTIG

SEQ ID NO: 7484 - protein, 148 aa, Enterobacter cloacae
RCANKAPETEPYFIGECMKRYLIAGAALLLSASALADECDKATTQTELSACAAEQYQAADKKLNQTYQAAIKRAAAPQRDLLKKAQQAWIALRDADCKLMGSGTEGGTIQPMIINQCLTEKTAEREAFLASLMQCEEGNLSCPFQPAD

SEQ ID NO: 7485 - protein, 260 aa, Enterobacter cloacae
FSHRRGNLRRAHSAADAVPRPHPCRDEGGGVMTTLNARPEAITFDAQRSALIVVDMQNAYASKGGYLDLAGFDVSTTQPVIENIKTAVHAARAAGMLIVWFQNGWDDQYVEAGGPGSPNFHKSNALKTMRQRPELQGTLLAKGGWDYQLVDELVPEASDIVLPKPRYSGFFNTPLDSLLRSRGIRHLVFTGIATNVCVESTLRDGFFLEYFGVVLEDATHQAGPDFAQKAALFNIETFFGWVSNVNDFCDALDPPLARIA

SEQ ID NO: 7486 - protein, 285 aa, Enterobacter cloacae
SPKRWLKLPPLRTSRSEAAMKLSISPPPFAGAPVVVLIAGLGGSGSYWLPQLAVLGQEYQVVCYDQRGTGDNPDTLPEDYTLAHMADELALALAGAGIARYCVVGHALGALVGLRLAIDKPDALTALVCVNGWLTLNAHTRRCFDVRERLLHAGGAQAWVEAQPLFLYPADWMAARAPRLEAEDALALAHFQGKANLLRRLHALKQADFSRHAARVRCPVQIICSTDDLLVPSVCSDELHAALPHARKTVMRQGGHACNVTAPDIFNTLLLNGLASLLHSPEPAL

SEQ ID NO: 7487 - protein, 196 aa, Enterobacter cloacae
MSEAITPAALETLFTGARTHNGWLDIPVSDETLREIYDLMKWGPTSANCSPARIVFVRSPEGKEKLRPALSSGNLEKTLTAPVTAIVAWDSEFYERLPELFPHGDARSWFTASPALAEETAFRNSSMQAAFLIFACRALGLDTGPMSGFDREKVDAAFFTGTLLKSNLLINIGYGDTTELYGRLPRLTFEDACGLA

SEQ ID NO: 7488 - protein, 200 aa, Enterobacter cloacae
CKMAKVLVLYYSMYGHIETMAHAVAEGANRVDGVEVVVKRVPETMQAEAFAKAGGKTQNAPVATPQELADYDAIIFGTPTRFGNMSGQMRTFLDQTGGLWASGALYGKLASVFSSTGTGGGQEQTITSTWTTLAHHGMVIVPIGYGAQELFDVSQVRGGTPYGATTIAGGDGSRQPSNEELSIARYQGEYVAGLAKKLNG

SEQ ID NO: 7489 - protein, 81 aa, Enterobacter cloacae
PNRRTSMPTQESKAHHVGEWASLRNTSPEIAEAIFEVANYDEKLAEQIWEEGNDEVLVRAFKKTDKDSLFWGEQTIERKNV

SEQ ID NO: 7490 - protein, 60 aa, Enterobacter cloacae
PCWRASMISALTSTPKMRTVWRSPSICWKNCASSRSWRAGTGLVSLSRPTRNAARSSLTT

SEQ ID NO: 7491 - protein, 392 aa, Enterobacter cloacae
HPNNKVIFKTGTAFAKTPLHLRRNEERFVMKIGVFVPIGNNGWLISTTAPQYMPTFELNKAIVQKAEHYHFDFALSMIKLRGFGGKTEFWDHNLESFTLMAGLAAVTSRIQIYATAATLTLPPAIVARMASTIDSISGGRFGVNLVTGWQKPEYEQMGLWPGDDYFSRRYDYLTEYVQVLRDLWGTGKSDFKGDFFTMNDCRVSPQPSVPMKVICAGQSDAGMEFSAKYADFNFCFGKGVNTPAAFAPTAARMKEAADKTGRDVGSYVLFMVIADETDEAARAKWQRYKDGADEEALSWLTEQSQKDTRSGADTNVRQMADPTSAVNINMGTLVGSYASVARMLDEVAAVPGAEGVLLTFDDFLTGVETFGERIQPLMQCRAHIPAVTKEVA

SEQ ID NO: 7492 - protein, 167 aa, Enterobacter cloacae
GAIMTTLDQQTFRDAMACVGAAVNIITTDGPAGMAGFTASAVCSVTDTPPTLLVCLNRGASVWPIFSENRTLCVNTLSAGQEPLSSLFGGKTPMADRFAAARWQTGETGCPRLEAALASFDCRISQVVSVGTHDILFCDIVSIIRHPAPQGLVWFDRGYHALMRPAC

SEQ ID NO: 7493 - protein, 447 aa, Enterobacter cloacae
SAFRRQIMFGLPHWQLKSTSTEEGVVAPDERLPLGQTMVMGVQHAVAMFGATVLMPMLMGLDPNLAILMSGMGTLLFFFVTGGRVPSYLGSSAAFVGVVIAATGFNGQGINPNLSVALGGIIACGLVYTLTGLVVMKVGTRWIERMMPPVVTGAVVMAIGLNLAPIAVKSVSGSPFESWMAVITVLCIGVVAVFTRGMIQRLLILVGLIAACLVYALLANVFGLGKPVDFTLIHQAAWFGMPHITSPTFNVQAMMLIAPVAVILVAENLGHLKAVAGMTGRNMDPYMGRAFVGDGLATMLSGSVGGSGVTTYAENIGVMAVTKVYSTLVFVAAAVMAMLLGFSPKFGALIHTIPAPVIGGASIVVFGLIAVAGARIWVQNHVDLSQNGNLIMVAVTLVLGAGDFALTLGGFTVGGIGTATFGAILLNALLSRRKRDVPQGKAITPST

SEQ ID NO: 7494 - protein, 893 aa, Enterobacter cloacae
LFLQWNGWTAAYFGTHMSQETPASPTEARIKTKRRISPFWLLPVIALMIAGWLIWTSYEDRGSTITIDFQSADGIVAGRTPVRFQGVEVGTVQDISLGKGLNKIQVRASIKSDMQDALRAETQFWLVTPKASLAGVSGLDALVGGNYIGMMPGKGEPQDHFVALDTQPKYRLNNGDLMIHLRAPDLGSLNSGSLVYFRKIPVGRVYDYAINPNKDGVTIDVLIERRFTNLVKKGSRFWNVSGVDADLSLSGAKVKLESLAALVNGAIAFDSPADSSPAAAEDTFGLYADLAHSQRGVIVKLTLPDAKGLKAGSTPLMYQGLEVGQLTKLTLNAGGSVTGEMTVDPSVVDLLREKTRIELRNPKLSLSDASISSLLTGSTFELIPGEGAPNKNFVIAPADKALLQKPGVLTVTLNAPESYGIEAGQPLILHGVQVGQVLERKLKEKGVSFSAAIDPQYSNLVHGDSKFVVNSRVDVKVGLDGVEFLGASASEWVNGGIRILPGSKGALRESYPLFANLDKAIENSLGDLPTTTLTLSAETLPDVQAGSVVLYRKFEVGEVITVRPRADAFDIELHIKPEYRKLLTPNSVFWAEGGAKVQLNGSGLTVQASPLSRALRGAISFDNLSGAGGNMRKGDKRILFPSETAARAVGGQITLHTFDAGKLAEGMPIRYLGIDIGQIQKLTLITARNEVQATAVLYPEYVQTFARAGSRFSVVTPQISAAGVEHLDTILQPYINVEPGRGNARREFELQEATITDSRYLDGLSIVVEVPEAGSLGIGTPVLFRGIEVGTVTSLTLGNLSDRVMVGLRISQRYQHLVRNNSVFWLASGYSLDFGLTGGVVKTGTFNQFIRGGIAFATPPGTPLAPKAQAGKHFLLLESEPKEWREWGTALPR

SEQ ID NO: 7495 - protein, 94 aa, Enterobacter cloacae
LHWSYQILGNKPESIMTKTSVRIGAFEIDDAELRGESQGERTLSIPCKSDPDLCMQLDAWDADTSVPAILDGEHSVLYREHYDSKTDAWVLRLA

SEQ ID NO: 7496 - protein, 367 aa, Enterobacter cloacae
TGVGFRESKQTINQPEIKIAALLIPYSLAFKIERNKKRDFHVSNIHLQNDVFYPHRTNIISELVRGKRVPGPIWHKRDYRLKFLLRSLLFWSSTHRMLEALSGRDDFDRLLTSQITLPSKTHRQYLMRGLNSNDRADAIVSHYQWIDSLKNIALAHALTSPQEVPVVRFEAKNGEIYTVHASSAGKAEREGESTLWLHDNDNTLLASLTFCVARSNGRTVLVIGGLQGPRRHVSREVIKQATRACHGLFPKRVLMEVIFQLASRSNISAIFAVSDEGHVFRALRYRLSKGRHFHASYDEFWEGLNGKKLSPFCWQLPLQMERKALEEIASKKRAEYRRRFALLDDIAASVQARIDPAVVSGKIQTKI

SEQ ID NO: 7497 - protein, 90 aa, Enterobacter cloacae
TIAVTLPPQKKEKEMNVNLAALPQDEMDKVNVDLAAAGVAFKERYNMPVVAEVVEREQPAHLRDWFRERLIAHRLASVNLSRLPYEPKVK

SEQ ID NO: 7498 - protein, 227 aa, Enterobacter cloacae
NPSDLVYKEVTMSRWNIAAAQYAPRHNCVDEHVKHHLHFIAEAAWHGCDLIVFPELSLTGPGGTSLPPPPDDLQLAPLLHAAQSRFITVIAGITLQQHGQRQKGLALFTPNLSTIRRYPQGNGAGVIPGDKRLTIVDNQADAPELDPEATLFTSSLAVGEHRWRQSIGSLQRFAHKYAIAVLMANARGGSALWDEKGQLIVRADKGELLLTGSLGQQGWQGDIIPLG

SEQ ID NO: 7499 - protein, 225 aa, Enterobacter cloacae
DQERSMLRVIDTETCDLQGGIVEVASVDVIDGKIVNPMSHLVRPDRPISAQAMAIHRITESMVADKPWIEEIIPLYHGSQWYVAHNASFDRRVLPEMPGEWICTMKLARRLWPGIKYSNMALYKSRKLSVRTPEGLHHHRALYDCYITAALLIDIMNTSGWTPDDMATITGRPALLTTFTFGKYRGKPVSEVADKDPGYLRWLYNNLDRMSPELRLTLKHYLGEA

SEQ ID NO: 7500 - protein, 437 aa, Enterobacter cloacae
LSTILICVRLMALKTPQITPTRKIVVRTVSQALPRAHYQRCPQCDTLFMLPKMKSHQSAFCPCCDAKIRDGRDWSLTRLAAMAVTMLLLMPFAWTEPLLKLYLLGVRIDANVLQGIWQMTRQGDPLTAAMVLFCVVGAPLVLVAAIAYLWFGNILGMNLRPVLLMLEKLKEWVMLDIYLVGVGVASIKVQDYAFLQPGIGLFAFISLVLLSILTLIHLNVEQLWERFYPQRPATRPDDNLRVCLGCHYTGFPDKRGRCPRCHIPLRLRRNNSLQKCWAALIASLVFLFPANMLPISVIYVNGARQEDTILSGIISLAHSNVGVAAIVFIASILVPFTKVVVMFTLLISIHFKCEQGLRTRILLLRFVTWIGRWSMLDLFVISLMMSLINRDQLLAFTMGPAAFYFGSAVILTILAVEWLDSRLLWDAHESGNARFAD

SEQ ID NO: 7501 - protein, 487 aa, Enterobacter cloacae
MFPCGVPVAQNSVFLPEQFLAQMREALPAHLSFDDFVAACQRPLRRSIRVNTLKTSVGAFLDLVSPYGWQLTPVPWCEEGFWIERDDEESLPLGSTAEHLSGLFYIQEASSMLPVAALFADGNQPERVMDVAAAPGSKTTQIAARMNNRGAILANEFSASRVKVLHANISRCGIHNVALTHFDGRVFGAALPEAFDAILLDAPCSGEGVVRKDPDALKNWSVESNLQIAATQRELIDSAFHALRPGGTLVYSTCTLNRDENEDVCLWLKQRYVDAVEFLPLDTLFDSASHAATPEGFLHVFPQIYDCEGFFVARLRKTRAVDPLPAPKFKVGNFPFAPVKGREAAQAQAAASKVGLHWDESLRLWMRDKELWLFPVNIEPLIGKVRFSRLGIRLAEIHNKGYRWQHEAVIALAGSENTFALTHQEAEEWYRGRDVYPEDGPLQDEVIVTYQGYPLGLAKKVGSRLKNSYPRELVRDGRLFTGNNRSA

SEQ ID NO: 7502 - protein, 424 aa, Enterobacter cloacae
RSANFPLVRLSPYKTDANVFVYTTRIFFRGIFMTLLGTALRPAATRVMLLGSGELGKEVAIECQRLGVEVIAVDRYANAPAMHVAHRSHVIDMLDGNALRALIAEEKPDFVVPEIEAIATEMLVALEQEGQRVVPCATAAKLTMNREGIRRLAAEELQLPTSSYRFAGDKAAFLQAVEEIGYPCIIKPVMSSSGKGQSFIRDSSTLDQAWDYAQQGGRAGAGRVIVEGVVKFDFEITLLTVSAVDGVYFCDPIGHRQEDGDYRESWQPQQMSALALARAQEIARKTVLALGGYGLFGVELFVCGDEVIFSEVSPRPHDTGMVTLISQDLSEFALHVRAFLGLPVGGIRQYGPAASAVILPQLTSQNVTFDNVEGAVGAGLQVRLFGKPEIDGSRRLGVALATGENVDEAVARAKIAATAVKVTG

SEQ ID NO: 7503 - protein, 94 aa, Enterobacter cloacae
CTGSQSLRRPGETQLYPRQNGSWRSGAVILLPPGDECLPGSWSVLPQWRKALRAGLPAQGQPASQWQWPQFQAPRNPVFPRQLTPAGHCRQAYR

SEQ ID NO: 7504 - protein, 291 aa, Enterobacter cloacae
NSMLALSYVALLFIHFAALMLLFGNALYSVWFAPSSLQRLMTRRFQRQQKLAALISLMAALLMFGLQSGLMGNGWSDVIRPAVWRSVLGTQFGGVWLWQMVLAAVTAGAAWLTPQKGSRLLLLVMGQLVLLAGVGHAAMNGGAPGALHRLNHALHLLCAATWVGGLLPLLFCMRLAKGRWQPAAIFTMMRFSRVGHYAVAGVLLTGIINTLFIVGINVPWHAPYVQLLLLKCALVMMMVAIALANRYFLVPRFRPEAGREQQIFIRMTQAEVVLGALVLAAVSLFATWEPF

SEQ ID NO: 7505 - protein, 228 aa, Enterobacter cloacae
AVKVTHCYVRKNMSGWMNQLQSLLGQKGSSSGEQGLSKLLVPGALGGLAGLLVANKSSRKLLTKYGTGALLAGGGAIAGSVLWNKYKDKVRSAHQDEPQYGKQVSPLDLRTERLILALVFAAKSDGHIDASERAAIEQQMREAGVEEQGRALVAQAIEQPLDPQRLAQGVKNEEEALELYFLSCAAIDIDHFMERSYLNALGDALKIPQDVREGIEQDIQQQKQTLAG

SEQ ID NO: 7506 - protein, 700 aa, Enterobacter cloacae
DVKRKSKNAMPPKARRTPYAITTHGDTRIDNYYWLRDDSRSRPEVLDYLHEENDYGRQVMASQQALQDQLLNEMVQRIPQRDVSAPWCKNGYRYRHIYEPGNEYPIYQRQSVLSAEWDEWEILLDANKRAAHSEFYTLGGMSISPDNAIMALAEDYLSRRQYGLRFRNLETGNWYPEMLDNVSPDFVWGNDSETVYYVKKHASTLLPYQVWRHTVGTDSADDELVYEEKDETFYVSLHKTSSRHYVIIFLSSATTSEVLLLDAELPDAQPLCFLPRRKDHEYSLDHFQHSFYLRSNREGKNFGLYKTKVRDERKWEVLIPARDQVMLEGFTLFTDWLVVEERQRGLTSIRQINRKNREVVGIAFDDPAYVTWIGFNPEPESSRLRYGYSSMTTPDTLFELDMDTGQRQVIKQAEVRGFESENYRSEHLWVTARDGVEVPVSLVYHKAHFNKGKNPILVYGYGSYGSSMDADFSSSRLSLLDRGFVYAIAHIRGGGELGQHWYEDGKFLKKKNTFNDYLDVCDALIAQGYGDPQLCFGMGGSAGGMLMGAVINQRPELFKGVIAQVPFVDVVTTMLDESIPLTTGEFEEWGNPQDETYYRYMKEYSPYDNVEAKAYPHMLVTTGLHDSQVQYWEPAKWVAKLRELKTDDNLLLLCTDMDSGHGGKSGRFKSYEGVALEYAFLIGLAQDTLPGRAGTQASPK

SEQ ID NO: 7507 - protein, 113 aa, Enterobacter cloacae
HMKKTLLSLLLLTCASSALAAPQVITVSRFEVGKDNWAFNREEVMLTCRPGNALYVINPSTLVQYPLNDVAEQQVASGKSNGQPVSVIQVDDPANPGQKKSLAPFIERAEKLC

SEQ ID NO: 7508 - protein, 166 aa, Enterobacter cloacae
IMNKTEFYADLNRDFKALMAGETSFLATLANTSALLFERLSDVNWAGFYLLEGDTLVLGPFQGKLACVRIPVGRGVCGTAVATRQVQRVEDVHAFDGHIACDASSNSEIVLPLVVKNQIIGVLDIDSTVFSRFTAEDEQGLRALAANLENVLADTDYHKFFASVAG

SEQ ID NO: 7509 - protein, 172 aa, Enterobacter cloacae
SGNFMENQPKLNSSKEVIAFLAERFPQCFSAEGEARPLKVGIFQDLVARVEGEMNLSKTQLRSALRLYTSSWRYLYGIKPGATRVDLDGNPCGELDEQHVEHARKQLEEAKARVQAQRAEQQAKKREAAAANGQEDAPRRERKPRPAPRRTENNDRKPRAVFTHGPGRTAIA

SEQ ID NO: 7510 - protein, 129 aa, Enterobacter cloacae
RKGMIVMHFTPSRVACALAFLLSSATATSALAHAHLKQQSPQENTVAVAPEVITLNFSEGIEPAFSGVVVTDAQQHKIQTGAVKRDEKDNAKLIVPLEKPLTTGTYTVDWHVVSVDGHKTKGSYHFSVK

SEQ ID NO: 7511 - protein, 258 aa, Enterobacter cloacae
RPGNKGLIAQRSLFPAGLWFVWIREIRRQFMTFSVAAILLTGGVIYQKIEGEHWRHVWVASDIHGCYQWLMDELKRRHFNPDTDLLISVGDIIDRGPDSVKCLQLMQENWFYAIRGNHEQMALDALINNDFSLWSINGGNWFTGLKDAQQKQAKGLLDACRDLPHIIEITCKNGLNVIAHADYPSAEYGWHKPVDAQRVLWDRDRLMGFMVGKGQGISGADHFWFGHTPVDKRYDFNNLHYIDTGAVFGGFLTLAQLQ

SEQ ID NO: 7512 - protein, 71 aa, Enterobacter cloacae
EQGERAIMNISDIIQLVVLCALIFLPLGYYARHSLRRIRDTVRLLFVKPRYIKPAGTLSRAPNVKANRKHD

SEQ ID NO: 7513 - protein, 528 aa, Enterobacter cloacae
KFDEKRDTVDSIFSIGIQSLWDELRHMPVGGVWWVNTDRNEDAISLVNQTIAAQGKDSRVAIITMGDEPKSIIRLDSNRGPQTVRLFSMPAEADSLYFLPRDIQCSIVPEHYLLVLKCSNNGLQNIPSEKLLKWLERINRWAKNQNCTLLVVNPGSNNDKLFSLLMSEYRSLYGLASIRVQTDSHLYDVAFWCNEKGVSSRQQLTLKHVGDEWHLAQQEETVVQPRSDEKRVLSHIAVLEGAPALSEHWSLFDTNEALFDEARTTQAATIIFSLIQNNQIETLARHIHTLRRQRGSALKIVVRENNTSLRATDERLLLGCGANMVIPWNAPLSRCLTLIESIQGQQFNRHVPEDISTLLSMTQPMKLRGYQKWDTFCDAVGNMMSNTLLPADGKGVMVALRPVPGIRVEQALTLCRPNRIGDIMTIGDNRLVLFLSFCRVNDLDTALNHIFPLPTGDIFSNRMVWFEDNLISAELVQMRALAPEKWAKPLPVTSGAKPVLNAKHDGHVWRRVPEPLRLLDENKESAPL

SEQ ID NO: 7514 - protein, 570 aa, Enterobacter cloacae
VALRTSRQTENMTNSTYTSSAPSPLWQYWRGLSGWNFYFLVKFGLLWAGYLNFHPLLNLVFMAFLLMPIPNLRLHRIRHWVAIPIGFALFWHDTWLPGPESIMSQGSQVAGFSADYMLDLVERFINWQMIGAVFVLLVAWLFLSQWIRVTVFVVAIMIWLNVLTLTGPSFSLWPAGQPTTTVTTTGGSAAATVATAGDTPVVGDIPAQTAPPTSTNLNAWLSSFYAAEDKRQTKFPDALPADAQPFELLVINICSLSWADVDAAGLMSHPLWSHFDIQFKDFNSATSYSGPAAIRLLRASCGQPSHKNLYQPAANQCYLFDNLAKLGFTQHLMMGHNGQFGNFLKEVREQGGMQAPLMDQKGLPVTLLGFDGSPVYDDTAVLQRWLDTVGKEEGTRSATFYNTLPLHDGNHYPGVSKTADYKARAQKFFDELNAFFNELEKSGRKVMVVVVPEHGGALKGDRMQVSGLRDIPSPSITNVPAGIKFFGMKAPHQGAPVEITQPSSYLAISELVARAVDGKLFVEDSVNWDQLTSGLPQTAEVSENANAVVIQYQNKPYVRLNAGDWVPYPQ

SEQ ID NO: 7515 - protein, 337 aa, Enterobacter cloacae
SSLYWPNGRSECRGDHCVKDNTIPLTLIGILADGEFHSGEQLGEQLGMSRAAINKHIQTLRDWGVDVFTVPGKGYSLPEPIQLLNEEIIRSQIGHGNVAVLPVIDSTNQYLLDRLSELKSGDACVAEYQQAGRGRRGRKWFSPFGANLYLSMYWRLAQGPAAAIGLSLVIGIVMAEVLHDLGADQVRVKWPNDLYLNDRKLAGILVELTGKTGDAAQIVIGAGLNMVMRNVQNDVVNQAWTNLQEAGITIDRNTLAVRMINELRSSLTLFEQEGLAPFLSRWEKLDNFINRPVKLLIGDKEIYGTSRGIDAQGALLLEQDGVIKPWVGGEISLRSAE

SEQ ID NO: 7516 - protein, 880 aa, Enterobacter cloacae
TAGACREFSMSRLTNWLLIPPVSSRLSERYRHYRYHGASSLSAALGCLWMILAWMFIPLEHPRWQRIRARHGELYPHINPDKPRPLDPARYAIQSIWLLATSTGAEKKTSRWRSFDRVQNLREHYHQWLDRLPDRVGDKTGHLDNQKELGHLHPGLRRFILGVVVVFSLILALVCITQPFNPLAQFTFLILLWGVALLVRRIPGRFSALMLIVLSLTVSCRYIWWRYTSTLNWDDPVSLVCGLVLLFAETYAWIVLVLGYFQVIWPLNRQPVPLPKDTTQWPTVDLFVPTYNEDLSVVKNTIYAALGIDWPKDKIKIWILDDGGRAEFRQFADEVGVEYIARTTHEHAKAGNINNALKYAKGEFVSIFDCDHVPTRSFLQMTMGWFLKEKELAMMQTPHHFFSPDPFERNLGRFRKTPNEGTLFYGLVQDGNDMWDATFFCGSCAVIRRKPLDEIGGIAVETVTEDAHTSLRLHRLGYTSAYMRIPQAAGLATESLSAHIGQRIRWARGMVQIFRLDNPLMGKGLKLAQRLCYVNAMFHFLSGIPRLIFLTAPLAFLLLHAYIIYAPALMIALFVLPHMIHASLTNSKIQGKYRHSFWSEIYETVLAWYIAPPTMVALINPHKGKFNVTAKGGLVEEEYVDWVISRPYIFLVLLNIVGVIVGIWRYFYGPENEILTVFVSMAWVFYNLIILGGAVAVSVESKQVRRAHRVEISMPAAIARDDGHLFSCTVHDFSDGGLGIKINGQAKVLEGQKVNLLLKRGQQEYVFPTQVVRVRGNEVGLQLMPLTKKQHIDFVQCTFARADTWALWQDSFPEDKPLESLLDILKLGFRGYRHLAEFAPSSVKLIFRSLTSLVSWVVSFIPRRPERDEAKQADPVMAQQ

SEQ ID NO: 7517 - protein, 1168 aa, Enterobacter cloacae
ITTGLGPGMRTFTLNLLTLSLGLALMPLAQAANSPQQRQLLEQVRLGESTQREDLVRQSLYRLELIDPNNPDVIAARFRYLLRQGDTAGAQKELDRLKGMAADSSAYQSSRTTMLLSTPDGRQALQQARLLATTGHTQEAIAAYDKLFDGKPPSGDIATEYWNVVAKEPARRNLAINQLKKINASSPGNVPLQSSLAQLLFQSGRRDEGFAVLQEMAKSNNGRSQASDMWYQQIKDQPVSSASVTALQQYLSVFSDGDNVTAARTQLEAQQKQLADPAFRAKAEGLAAVDAGQGSKAVTELQKAVSANHADSEAVGALGQAYSQKGDRARAVAQFEKAIALDPQSDNRGKWDSLLKVNRYWLLIQQGDNALKANNTAQAERYYQQARNIDNTDSYAVLGLGDAAAARKDNDAAERYYRQALRMDSGNSNAVRGLANIYRAQSPEKATQFIQSLSASQRRSIDDIERSLTNEQLSAQAEQLESEGKYAQAAEIQRRRLALSPGDVWITYRLSRDLYSAGQRSQADNLMRQLASQKPGDPDQVYASGLYLSGNDQDRAALAHLNTLPRDKWNGNIQALADRLQSNQVLETANRLRDSGKEQEAETLLRQQPPSTRIDLTLADWAEQRGDHEAAKTAYNTILQREPQNEDAILGLTEVSLAQGNKDAARAALAKLPAAQNGEPLSINMQRRLAMAQAGLGDPAAAEKTFNAILPQAKSQPPSMESALVMRDAARFQAQNGQPQQALDTWKDAMVSSGITTTRPTDNDSFTRLTRNDEKDDWLKRGVRSDAGDLYRQQDLNVTLQHDYWGSSGTGGYSDLKAHTTMLQVDAPLSDGRMFFRSDLVNMNAGSFDTDNGTYDPTWGTCAETPCHGSTNQSANGASVAVGWQNKTWAWDIGTTPMGFDVVDVVGSLSYSNDLGPIGYTLNAHRRPISSSVLAFAGQKDPNTDTTWGGVRATGGGVSMSYDKGEANGIWSSLSADSLTGKNVEDNWRVRWMTGYYYKLINQNNERLTVGVSNMLWHYDKDLSGYSLGQGGYYSPQEYVSFALPVNWRKRTENWSWELGGSVSWSHSKTKDVMRYPLQGLIPDNEPGRYTDKGVMETGSSSSGTGYTARAIVERRVTSNWFVGLGVDIQEAKDYTPSHALLYVRYSAAGWQGDMDLPPEPLVPYADW

SEQ ID NO: 7518 - protein, 699 aa, Enterobacter cloacae
VCLKSAAIGYTRTHQVYTLVRPALRVLWRVILRVSRSLTIKQMAMVSAVTMLFVFIFCVILLFHSVQQNRYNTASQLGSIARSVREPLSASILKGDIPEAESILKRIQPAGIVSRADVVLPNQFQALRMSFIPERSVPMMVMRLFELPVQISLPLYSLERPANPQPLAYLVLQADSYRMYKFVMSWVATLVTTYLLLTLMLSVALTWCINRLIVHPLRRIARELNDLSPQEHMGHQLPLPRLHHDDEIGMLVRSYNINQQRVLRQQEELSSNATRFPVSDLPNKAFLMALLEQTVARQQTTALMVIACETLQDTAGVLKESQREMLLLTLVEKVKSVLAPRMVLTQVSGYDLVVIAHGVKEPWHAITLGQQVLTVINERLPIQGIQLRPSASIGIAMYYGGLTAEQLYRRAFSAAFTARRKGKNQIQFFDPEQMEKAQQRLTEESDILTAMDNRQFALWLQPQVNLRTGEVTSAEALLRMQQPDGTWELPEGMIERIESCGLMVTVGYWVLEETCRQLAAWQQRGITLPLSVNLSALQLMHPTMVPEMLELIHRYRIQPHTLILEVTESRCIDNPDDAVAILKPLRNAGIRIALDDFGMGYSGLRQLQHMKTLPVDVLKIDKTFVEGLPEDCSLVQAIIQMAHSLNLHVIAEGIETDAQREWLAAAGVESGQGFLFDRAVPTDIFEQRYLADAGNNAKV

SEQ ID NO: 7519 - protein, 189 aa, Enterobacter cloacae
PYKACSFSFQGHPMKTSLFKSLYFQVLTAIAIGILLGHYYPELGAQMKPLGDAFVKLIKMIIAPVIFCTVVTGIAGMESMKAVGRTGAVALLYFEIVSTIALIIGLIIVNVVQPGAGMNVDPATLDAKAVAVYAEQAKDQGIVAFLLDVIPSSVIGAFASGNILQVLLFAVLFGFVLHQQGAEGSAHAR

SEQ ID NO: 7520 - protein, 391 aa, Enterobacter cloacae
GTARHQTSEEAIRKDGLFAFLHLLPFHKQITYPPIYTVNYPGFCIRIASMNHSLKPWNTFGIQRNANQIVRAESAQQLLNAWQNATGNGEPVLILGEGSNVLFLDDFAGTVIVNRIMGIECKESADSWHLHVGAGENWHHLVQYTLEKGMPGLENLALIPGCAGSSPIQNIGAYGIELKHVCEYVDCIELATGTAKRLTAEQCRFGYRDSIFKHDYQDRFVIVAVGLRLAKAWKPVLTYGDLTRLDPATVTPREVFDSVCHMRMTKLPDPKVNGNAGSFFKNPVISSENAKAFLAGWPTAPHYPQADGSVKLAAGWLIDQCELKGTTLGGAAVHRQQALVLINQSNATSEDVVNLAHHVRQRVGEKFNVWLEPEVRFIGRTGEVNAVETIA

SEQ ID NO: 7521 - protein, 260 aa, Enterobacter cloacae
VCPTTIRKPLMAVLGLQGVRGGVGTTSVTAALAWSLQVLGESVLVIDACSDNLLRMSFNVDFTHANGWGRALLDDKDWRDAGLRYTSQLDLLPFGQLTETERGNEAAYQRLFSRFITALQSLKESGHYQWILLDLPHGAASLTRQLLAQCDHVLSIANVDANCHIRLHQQPMPANAHILINDLRIGSQIQDDLYQVWLQSQRRLLPMVIHRDEAMAECLASKQPLGEYRSDSLAAEEILTLANWCLLHFAKRPEPAGSSV

SEQ ID NO: 7522 - protein, 846 aa, Enterobacter cloacae
FSGHLLHWFPGSCRSFRVDLSEMKRSRRTRLWLNNDDNAMKTKLSWLCAVAMGMSALPATVANAAPDNAATTPAPTVPVVAQATDPVVTAAPGQTENVVPNQPTTGNTLPGDNPVVGQVMPGVPGASAPVVAENTPSRDVKLTFAQIAPPPGSMVLRGINPNGGIEFGMRSDEVVSKAMLNLEYTPSPSLLPVQSQLKVYLNDELMDVLPVTKEQLGKKTLAQVPINPLFITDFNRVRLEFVGHYRDVCENPASSTLWLDVGRNSSLQMTYQPLALKNDLSAFPVPFFDPRDNRPLNLPMVFAGSPDVTEQLAASIVASWFGSRSGWRGQSFPVMYDKMPDKNAIVFATNAKRPAFLRDHPEVKAPTIEMISHPDNPYVKLLVIFGRDDKDLVQAAKGIAQGNILFRGNSVVVDEVKPLLARKPYDAPNWVRTDRAITFGELKTYEEQLQSTGLEPSPVSLSLNLPPDLYLLRTNGIDINLNYRYTAPATKDSSRMDISLNNQFLQSFSLTSSQETNRLMLRLPVLQGLLDGKTDVSIPALKLGAVNQLRFNFQYMNPMPGGSVENCITFQPVQNHVVIGDDSTIDFSKYYHFIAMPDLRAFANASFPFSRMADLSESIVVMPKAANEGQVATLLDTMGTVGAQTGLPAINVTVTDDGSQIQNKDADIMVIGNIPDKLKDEKRVDLLVQAAQSWVNTPLRQTEFPSIMPDSGDRQANIRTTVSSTGPMAAIVGFQSPYNDQRSVIALLADSPRGYELLNTAMNDSGKRAAMFGSVSVIRESGVNSLRVGDVYYVGHLPWFERLWYALSNHPVLLAVLAALSVVLLAWVLWRLLRIISRRRLNPDHE

SEQ ID NO: 7523 - protein, 370 aa, Enterobacter cloacae
AVMKIFRGCVVAALMLAAANLHAACRWPAWETFKQDYMSESGRVIDPSDARKITTSEGQSYGLFFALAANDRKAFDLLLAWTRDNLAEGDLAQHLPAWLWGKKDDETWAVIDPNSASDADIWIAWSLLEAGRLWKNPDYTRTGKALLTRIASEEVVKVPGLGSMLLPGKVGFAEESVWRFNPSYLPPQLASYFTRFGAPWTTLRETNLRLLLETAPKGFSPNWVKYQKKGGWQLSQDASLIGSYDAIRVYLWVGMMNDNDPQKARLLARFKPMATTTIKQGLPPEKVDVATGKRTGDGPVGFSASLLPFLQNRDAQAVQRQHVADRFPDNNAYYSYVLTLFGQGWDQHRFRFTVQGELLPDWGQECARSH

SEQ ID NO: 7524 - protein, 82 aa, Enterobacter cloacae
WAGRLAASESYDFTQRDEKRMQNNEPATPVDSSLGYTFQNDFLALTQAFSLPEIDYTDISQREQLAAAIKRWPLLAEFAQQQ

SEQ ID NO: 7525 - protein, 115 aa, Enterobacter cloacae
RNLRSDMGYLCRNAMSRQHEPVGQRRQRGRRLAEQNLGVGYRYNADGLRRGRCGGQPELQQRFRADWLHPERPSPSDFQLGAGLRRAKRSQYRHHLGRRACHRWRREHELRQRRS

SEQ ID NO: 7526 - protein, 339 aa, Enterobacter cloacae
VRCMSPTIYDIARVAGVSKSTVSRVLNKQTNISPEAREKVLKAIEELNYQPNKLARALTSSGFDAIMVISTRSTKTTAGNPFFSDVLHAITAKAEEEGFDVILQTSKSSEDDLQKCVGKIKQKMIKGIIMLSSPANESFFATLDEYGVPVVVIGKVEGNYQNIYSVDTDNFHDSAILTDSFIKHGRTKIACLHAPLDYHVSIDRLAGYKSSLEKHGIAINPDWVIDGGYTHESALQAACQLLSSDNPPDAVFATDSMKLLSLYRAADELNLTIPEQVAMAGYSDPMLSLILTPAPGGFDIPTRKLGEESCDLLFRCIAGKPAPHKVLVETHFSDAASLR

SEQ ID NO: 7527 - protein, 268 aa, Enterobacter cloacae
CQAIFHTHGNYLIKRGFCTTLPEVTLSSGFTMATTRPRTERGAFPPGTEHYGRSFLGAPLIWFPAPEADRNSGLIIAGTHGDENSSVVTLSCALRTLAPDLRRHHVILTVNPDGCQLGLRANARGVDLNRNFPAANWRAGETVYRWNSSAQERDVVLLTGDKPGSEPETQALCQLIHKIHPAWVISFHDPLACIEDPRHTALGQWLADAFALPLVSSVGYETPGSFGSWCADLSLHCITAEFPPISSDEASEKYLRAMTDLLRWQPQR

SEQ ID NO: 7528 - protein, 176 aa, Enterobacter cloacae
LFVNRKISMSQLVHFQGNPVAVAGSIPQSGSKAQPFTLVAKDLSDVTLSQFAGKRKVLNIFPSIDTGVCAASVRKFNQLATEMDNTVVLCISADLPFAQSRFCGAEGLSNVITLSTLRSPDFLEKYGVAISEGALKGLAARAVLVIDENDNVVFSELVNEITTEPDYTAALEALKA

SEQ ID NO: 7529 - protein, 279 aa, Enterobacter cloacae
KLIRANVLPAASCENGDIIGSGADVTEYQIGDSVCCYGPLQETVIVNAVNNYKLRKMPQGASWKNAVCYDPAQFAMSGVRDANVRVGDFVVVVGLGAIGQIAIQLAKKAGASVVIGVDPIEHRCEIARRHGADHCLNPIGTDVGLEIKKLTGKQGADVIIETSGFADALQSALRGLAYGGTISYVAFAKPFAAGFNLGREAHFNNAKIVFSRACSEPNPDYPRWSRKRIEETCWELLMNGYLNCEDLIDPVVTFTTSPESYMKYVDQHPELSIKMGVTF

SEQ ID NO: 7530 - protein, 358 aa, Enterobacter cloacae
MLRMTSVMSASTPLPLRVAIIGAGQVADKVHASYYATRSDVQMVAVMDSRLEQAQAFAERYAIPSAWQDAHEMLQEVKPDVVSVCSPNRFHFEHVMAALEAGCHVMCEKPPAMTPHQADEMRLAARKAGKVLAYDFHHRFALDTQHLRDAVMNGTLGEIYFTSAQALRRCGVPGWGVFTNKSLQGGGPLIDIGIHMLDAAMYVLGFPPVKRVTAHSFQRLGNRKHTGQFGEWDPAQFTVEDALFGTIEFCNGGILRLDTSFALNIREQSIMNVSFCGEKAGATLFPAHIYNDEAGVLQTLTQREEADDRRHLRSMDAFVRHVLGEPVMIADAEQGLVIQQLVAALYEAAETGESVTLC

SEQ ID NO: 7531 - protein, 254 aa, Enterobacter cloacae
RCGVKRCMYQGGRSVNVRTFLYLLMGPLPRRGAMTLNAVVFDLDGVITDTAHLHFLAWRAVAEEIGITFDEVFNEQLKGISRMDSLQRILIHGGKEGMFSDEQRLALARKKNALYVQSLSSLTQDSLLPGIRDVLADIRAAKVKIGLASVSLNAPGILHALGIHQAFDFCADASRISRSKPDPEIFLAACKGLNVRPEEAIGIEDAAAGVDAINAAGMLSVGIGPGLNHAGLQLHSTQELTWERLTAFWASRAY

SEQ ID NO: 7532 - protein, 308 aa, Enterobacter cloacae
RNILMSTLLRSAALVLCAGVSCAQATESAKQWEFNIGAMYEIENVEGQADDKDGLYEPSVWFNATWDAWTISLAMYQEGPVDYSSMTRGTYFDRPEVELRYRIIGTDDFTLGLTGGFRNYSYHFKDEDGAKAGSANMQRYKIQPDWDVKLTDDWRFGGWFAMYQFANDLAKTGYSDSRVETETGFTWTINETVSAKVNYYLERGFNMDSSRNNGEFSTQEIRAYLPISLGQTTLTPYTRLGLDRWSNWDWQDDPEREGHDFNRLGMLYAYDFNNGLSMTLEYAYEWENHDEGESDRFHYAGIGVNYAF

SEQ ID NO: 7533 - protein, 343 aa, Enterobacter cloacae
CMSSAVSTANQFSAFPACKESVMRSVKVYEEAWPLHTPFVISRGSRNEACVVVVECEEDGVKGVGECTPYPRYGESLASVMAQIMTVVPELQAGLTREALQLRLPAGAARNAIDCALWSLEAAKRQKPLPALLDVTLPQSIVTAQTVVIGEPEQMAASAQALYATGATLLKVKLDDRLISERMVAIRAAVPDATLIVDANESWHSEGLAARCQLLADLGVAMLEQPLPAEDDAALANFIHPLPVCADESCHTRESLSALKGRYEMVNIKLDKTGGLTEALALAQDAQAQGFALMLGCMLCTSRAIGAALPLVNSVRFADLDGPTWLAVDVSPALNFTSGVLHL

SEQ ID NO: 7534 - protein, 285 aa, Enterobacter cloacae
SMSISTRNSVSKWASLFKLRTAIMKIATQNQAFFPTAIMEKFEYIKAMGFDGYEIDGRLLVENLDEVKAAIKATGLPVTTACGGYDGWIGDFIEERRLNGLQQIERILEALAEVGGKGIIVPAAWGMFTFRLPPMTSPRSLDGDRKAVSASLRWLDEVAARTGTTVYLEPLNRYQDHMINTLADARRYIEENGLKHVQIIGDFYHMNIEEDSLTEALHQNRDLLGHVHIADNHRYQPGSGSLDFASLFDQLRADNYQGYVVYECRVRADDPAQAYKDSLTYLREC

SEQ ID NO: 7535 - protein, 374 aa, Enterobacter cloacae
RRSGHPGRIDKELIMAQLSLKHIQKIYDNQVHVVKDFNLEIEDKEFIVFVGPSGCGKSTTLRMIAGLEEISAGELIIDGVCMNDVPAKSRDIAMVFQNYALYPHMTVYDNMAFGLKMQKIAPSVIEERVTWAAQILGLRDYLQRKPGALSGGQRQRVALGRAIVREAGVFLMDEPLSNLDAKLRVQMRAEISKLHQKLNTTMIYVTHDQTEAMTMATRIVILKDGIIQQVGAPKQVYNEPANMFVAGFIGSPAMNFIRGAIDDRYFVTETLRLEIPEDKLAVLNAQGYQRKAVVFGIRPEDILTVQRSGENITAKISVAELTGAEFMLYATVGGHELVVRAGAADDYVAGDNIGIQFDMNKCHFFDADTETAIR

SEQ ID NO: 7536 - protein, 352 aa, Enterobacter cloacae
IAMTEPLKPRIDFTGQLEQTPHEAFKTAQTFSGPQADNFAPVLADEPMVEEGQAEAVVDAALRPKRSLWRKMVTAGLALFGVSVIGQGVQWGVNAWQTQDWVALGGCAAGALIVGAGVGSVVSEWRRLWRLRQRAHERDEARDLLHSHGTGKGRAFCEKLAAQAGIDHSHPALQRWYAAIHETQNDQEVVTLYAHIVQPVLDAQARREISRSAAESTLMIAVSPLAMVDMAFIAWRNLRLINRIARLYGIELGYYSRLRLFKLVLLNIAFAGASELVREVGMDWMSQDLAARLSARAAQGIGAGLLTARLGIKAMEVCRPLPWIDGDKPRLGDFRRELIGQLKETLNKKPAQ

SEQ ID NO: 7537 - protein, 545 aa, Enterobacter cloacae
SCGLSIFVDSHLPEHRDLTYHFTVIGLNGEFPMRLEVFCEDRLGLTRELLDLLVLRSIDLRGIEIDPVGRIYLNFAEIEFNTFSSLMAEIRRIAGVTDVRTIPWMPSEREHLALSALLEAMPEPFLSLDLKNKVERVNQASCQLFAQTQEKLIGHHATQLITGFNFQRWLDSNPQNTHSEHVVINGQNFLMEITPVYLKGENAARVLTGAVIMLRSTVRMGRQLQNLSSQDVGAFSQIIAVSPKMRHVIDQARKLANLTAPLLITGDTGTGKDLLAHAVHMASPRAAKPYLALNCASIPEDAVESELFGHAPEGKKGFFEQANGGSVLLDEIGEMSPRMQAKLLRFLNDGTFRRVGEDHEVHVDVRVICATQKNLVELVQKGVFREDLYYRLNVLTLNIPPLRDCPQDIMPLTELFVARFADEQGVPRPKLSADLGTVLTRYGWPGNIRQLKNAVYRALTQLEGYELRPQDILLPDYDAGTVSVGEEAMEGSLDDITSRFERSVLTQLYRSYPSTRKLAKRLGVSHTAIANKLREYGLNQKKGDE

SEQ ID NO: 7538 - protein, 769 aa, Enterobacter cloacae
SRGNRGKRDVMLNQSVLTDPSFCPHSLNKYASIMACGNGYMGIRATHEEDYTQQTRGMYLAGLYHRAGRNETTELINLPDVTGVEVELDGVNFTLLSGEILEWQRELAFANGELHRNVVWRSPDGKRYRLESRRFVSLDQLPLVAMRLSITPLDGAAQAVLKTGIDATQTNSGRQHLDEISVRVFDQHYMQGVYETQDRASEVVVSAFCQLSAQSDSCFTAKNRRLSVHHSLTISQGDTVTLEKIVWLTHRSDKALSQESFARNALADLKVCAARGYDALLESSAYAWEAVWRDARVEVTCAEQQDQLALDYAVWHLTTMTPAHSERSSIAAKGLTGEGYKGHVFWDTEIFLLPFHLFTRPQIARSLLRYRWLNLSGAREKARRNGWPGALFPWESAASGEEETPEFAAINIRTGVRQKVASALAEHHIVADIAWAVVAYWQATHDDAFMRNEGLTLLMETASFWMGRATEINGRLEIHDVIGPDEYTEHVNNNAYTNYLAWHNVACARQFMAKFGREDARFTENAGKFLARLWLPEADAEGVIPQDDTFMAKPAIDLSRYKAKAGKQTILLDYSRAEVNEMQILKQADVVMLNYLLPERFTPQQCAANLAFYEPRTIHDSSLSKAIHGIVLARCGDTEGAYAFWRDGIAIDLGDDPHSSDDGIHAAATGAIWLGAIQGFAGLHISEGELHLAPKLPAHWQKLAFPLRWRGATMHITCEDDLLTIETTAPVTLTLWGKTLHVSGRKVCERKDFLVPVNGTATTEGRHDA

SEQ ID NO: 7539 - protein, 468 aa, Enterobacter cloacae
RTAMKRLKNEFNSLVNRGVDRHLRLAVTGLSRSGKTAFITAMVNQLLNLHAGARLPLLSAVREERLLGVKRVPQRDFGIPRFTYDEGLAQLYGEPPAWPTPTRGVSEIRLALRFRSNESLMRHFKETSTLYLEIVDYPGEWLLDLPMLAQDYLNWSRQMTGLLQGQRAEWSTQWRQLCEGLDPLAPADENRLAVIAEAWTDYLHQCKQEGLHFIQPGRFVLPGDLAGAPALQFFPWPDVDSIGESKLAQADKTTNAGMLRERYNYYCEKVVKGFYKNHFLRFDRQIVLVDCLQPLNSGPQAFNDMRLALTQLMQSFHYGQRTLFRRLFSPVIDKLLFAATKADHVTVDQHANMVSLLQQLVQDAWQNAAFEGISMDCLGLASVQATQSGLIDLNGEKIPALRGNRLSDGEPLTVYPGEVPARLPGQAFWQSQGFQFEAFRPQSMNVDQPLPHIRLDAALEFLIGDKLR

SEQ ID NO: 7540 - protein, 541 aa, Enterobacter cloacae
GDRMKHPVSLLCTALWLCGLSSLSYAAEVPEGTVLAQKQELVRHIKDEPASLDPAKAVGLPEIQVIRDLYEGLVNQNEKGELVPGVATRWQSNDNRVWTFTLRDNAKWSDGTPVTAQDFVYSWRRLVDPKTTSPFAWFAALAGINNAQSIIDGKAAPDTLGVTAVDAKTLRVQLDKPLPWFSNLTANFAFYPVQKANVESGKEWTRPGALIGNGAYVLKDRVVNEKLVVEPNSHYWDNARTVLKKVTFVPINQESSATKRYLAGDIDITESFPKNMYQKLLKDIPGQVYTPPQLGTYYYAFNTQKGPTADARVRLALSMTIDRRIMAEKVLGTGEKPAWHFTPDVTAGFTPETSPFEQMSQQELNAQAKTLLQAAGYGPQRPLKLTLLYNTSENHQKIAIAVASMWKKNLGVDVKLQNQEWKTYIDSRNTGNFDVIRASWVGDYNEPSTFLSLLTSSHSGNISRFNDPAYDKIIHQATLETTEKARNADYNMAEKILTEKAPIAPIYQYTNGRLIKPWVKGYPINNPEDVAYSRTMYIEKH

SEQ ID NO: 7541 - protein, 365 aa, Enterobacter cloacae
LPAAGQPIRPICSRSTSTTPPLSISIWAMARRWRGSCSWWWPSSPVSPLSRRNTGCSTPPIKEAKMADIQQLSTARSVAEREVARTLRREKINASVRYVILLVVGLLMLYPLVWMFSASFKPNHEIFTTLSLWPAHATWDGFVNGWKTGTEYNFGHYMLNTFKYVIPKVILTIISSTIVAYGFARFEIPWKKFWFATLITTMLLPSTVLLIPQYLMFREMGMLNSYMPLYLPLAFATQGFFVFMLIQFLRGVPRDMEEAAQIDGCNSIQVLWYVVVPILKPAIISVALFQFMWSMNDFIGPLIYVYSVDKYPIALALKMSIDVTEGAPWNEILAMASISILPSIIVFFLAQRYFVQGVTSSGIKG

SEQ ID NO: 7542 - protein, 379 aa, Enterobacter cloacae
EGNTMAEVIFNKLEKVYSNGFKAVHAIDLKIAEGEFMVIVGPSGCAKSTTLRMLAGLETISGGEVRIGDKIVNNLAPKERGIAMVFQNYALYPHMTVRENLAFGLKLSKLPKDQIESQVNEAAKILELEELLDRLPRQLSGGQAQRVAVGRAIVKKPDVFLFDEPLSNLDAKLRASMRIRISDLHKQLKKSGKPATTVYVTHDQTEAMTMGDRICVMKLGHIMQVDTPDNLYHKPRNMFVAGFIGAPEMNIRKSVLVEKAGQLHIAIGDETMPLNAEKQEKVAAYAGQEIYYGVRPEFVSLSDEPFPNGGCSGEMVRVENMGHEFFVYLKVADYELTARIPSDEAKPMIDKGLHRKVYFTFEMNKCHIFDAKTEQNLSL

SEQ ID NO: 7543 - protein, 340 aa, Enterobacter cloacae
MATIKDVARLAGVSVATVSRVINNSPKASDASRQAVQDAMENLNYHPNANARALAQQSTETIGLVVGDVSDPFFGAMVKAVEQVSYHTGNFLLIGNGYHNEQKERQAIEQLIRHRCAALVVHAKMIPDAELIHLMKQMPGMVIINRIIPGFETRCVALDDRYGAWLATRHLIQQGHTRIGYLCSNHPISDAEDRLQGYYDALREAGLPCNDRLVAYGEPDESGGEQAMTELLGRGRNFTAVASYNDSMAAGAMGVLNDNGIDVPAEISLIGFDDVLVSRYVRPRLTTVRYPIVTMATQAAELALALAEHRPPPEITHLFSPTLVRRHSVVSPAEAVSEQR

SEQ ID NO: 7544 - protein, 318 aa, Enterobacter cloacae
YGTRSAIRCPMPAVNLRHIEIFHAVMTTGNLTEAAHMLHTSQPTVSRELARFEKVLGLKLFERTRGRLHPTVQGLRLFEEVQRSWYGLDRIVSAAESLREFRQGELSIVCLPVFSQSFLPVLLQPFLARYPEVSLTIVPQESPLLEEWLSAQRHDLGLTETLVTPAGTERTELLSLDEVCVLPASHPLAHKTVLTPADFHGENYISLSQTDSYRQLLDGLFAEHQVKRRMVMETHSAASICAMVRAGVGISVVNPLTAMDYASSGVVLRRFSVSVPFTVSLIRPLHRPASALVDAFSEHLIAHARQVALRLPDLQKPL

SEQ ID NO: 7545 - protein, 111 aa, Enterobacter cloacae
QGENMFIFHKETTLEDLGNGVTRRILAHDGRMMAVEVNFEEGAIGPMHNHPHEQLTYVLSGEFEFTIGEEKHVVTAGDTLYKAPHVMHGCVCLKPGTLLDTFTPVREDFLK

SEQ ID NO: 7546 - protein, 449 aa, Enterobacter cloacae
TSVIFLTQKLNRTSLSDGVIKMKKVLLSAAISATLGLTALPSMAQNVDLRMSWWGGNGRHQVTLKALEEFHKQNPDINVKAEYTGWDGHLSRLTTQIAGGTEPDVMQTNWNWLPIFSKTGDGFYDLNKMKDVIDLSQFDPKELQTTTVDGKLNGIPISVTARVFYFNDETWKKAGIAYPKTWDELMAAGKTFESKLGKQYYPVILEHQDTLALLNSYMIQKYNIPAVDEKTKKFSYTKEQWVEFFQTYKKLIDSHVMPDTKYYASFGKSNMYEMKPWIQGEWGGTYMWNSTINKYSDNLKPPAKLELGNYPMLPGATDAGLFFKPAQMLSIGKTTKNPEAAAKLINFLLNSKEGVDTLGLERGVPLSKVAVQYLTEDGTIKEDDPSVAGLRLAQSLPAKLTVSPYFDDPQIVAQFGTSLQYIDYGQKTVEETAADFQRQAERILRRAMR

SEQ ID NO: 7547 - protein, 372 aa, Enterobacter cloacae
GFALPTSLMRRMVCVKLQTITWKQEFRMATMLDVSLRAGVSKATVSRVLNGTGQVKESTRQQVFRAMEELGYRPNFLARSLANQTSNSIGLVVSTFDGFYFGRLLQQASRQTEKHGKQLIVTDGHDAPEQEEQAVQMLADRKCDAIVLYTRYMSEKTILKLINSVQTPLVIINREVSQAADRCVFFEQQDAAFKAVDYLISQGHREIACITVPIHTPTGKARLMGYRKALEKHGIRLDERRIKYGDAGMTRGYELCKELIAEKTSFSALFACNDDMALGASKALHQAGLKIPQDISLFGFDDAPSAKWLEPALSSVYLPIDNMIVTAIDQAIRLTKNQPVEAIPPFTGTLVLRDSVTTGPWFNQTSSNASSS

SEQ ID NO: 7548 - protein, 298 aa, Enterobacter cloacae
VCMNENKLLGLAWISPYIIGLILFTAFPFVSSFFLSFTDYDLMSPPVFNGIENYRYMFTEDTLFWKSMGVTFAYVFLTIPLKLAFALGIAFVLNFKLRGIGFFRTAYYIPSILGSSVAIAVLWRALFAIDGLLNSFIGVFGFDPVNWLGEPSLALMSVTLLRVWQFGSAMVIFLAALQNVPQSQYEAAMIDGASKWQMFMKVTVPLITPVIFFNFIMQTTQAFQEFTGPYVITGGGPTYSTYLFSLYIYDTAFKYFDMGYGAALAWILFLVVAVFAGIAFKSSKYWVFYSADKGGKNG

SEQ ID NO: 7549 - protein, 474 aa, Enterobacter cloacae
SQNKAPVGAIFGIPIVSGCPSYSIKALLLRYYPMAFQEKLIDALGSFATTFNSYRYIQAIKSAFITLMPVIIVGAFSVLISNMVLDPKNGLASFQSLSFLAALKPITSALNYATLNFLNIGAVFLIGIELGRINGIKSLFPGLLAVICFICVTPTTVEMLVDGEMHVVKDVLLRQFSDTRSLFLGMFIAILSVEIYCWLENRRGLKIRMPDTVPPNVAASFSALIPAIITTTAIATFGFVFHQITGMYLYDAVYQVVQQPLERVVQSLPGILLLMFVAQLFWVIGIHGNQMIKPIREPLLLGAITVNMSAFEQGKEVPNIITMPFWDVYMSIGGSGLTIGLLIAVMIATKRKEMKEIAKLSIGPGIFNINEPVIFGMPIMLNPILAIPFIITPLVTGSIGYFATVTGFAGKAVVMVPWTTPPLINAWLSTAGSMGAVITQFICIVTAVIIYLPFVKIASRRAEQAALQQATDNA

SEQ ID NO: 7550 - protein, 497 aa, Enterobacter cloacae
KLPHAAQSRPRCNKPPITHEDRMSIKQITIPQDFMLGAAASAWQTEGWSGKKPGQDSWIDLWYKNDRHVWHNGYGPAVATDFINRFREDVALMKQAGLTHYRTSINWSRFLTDYENATVDEEYAAYYDALFDEMHRQGIEPMICLEHYELPGVQLETYGGWASKHVVELFVRYAEKVFERFHGKVTRWFTFNEPIVVQTRVYLDALRWPYEQNTSTWMQWNHHKVLATAKVVKLFREKGYDGSVGCILNPEVTYPRSRAPHDERAAEMYDLFYNRVFLDPLVHGRYPQALFTLLAQHQVQWDYTADELALIADNTVDELGINLYYPHRVKAPSRAWHPETPFHPAYYYEPFELPGRRMNTSRGWEIFPRIIYDMAMRIKNDYRNIDWFVAESGMGVENEAQFRNRDGIIDDTYRIAFISEHLYYTLLAREAGANCHGYMLWAFTDNVSPMNAFKNRYGLIEIDLENQRARRAKKSASWFRQLRDERVLTLRVDDEWK

SEQ ID NO: 7551 - protein, 264 aa, Enterobacter cloacae
LKNTGENVDKAVILPEKKQYQEIGEDLRAQIIQGHYPVGSRLPPERNIAETYGVSRTIVREALLMLELQGTVDIRQGSGVYVMRIPEEHENEEERFLNSDVGPFEILQARQLLESNIAAFAAKMATRADIDNLRRIIEQEQRAIAADDRSQDNNKMFHLVLAGATQNQMLLATVESVWHHMDSSPLWQQFNGHIASRAWRLKWLGDRQTILAALRRRDVMGAWQAMFQHLENVKKSLLELSDEDAPDFDGYLFESVPLFQGKLV

SEQ ID NO: 7552 - protein, 773 aa, Enterobacter cloacae
LVRIPGTFSYSSLAPTCADAQVFFRLCFCYRSLTTSRVICHHLYLSHWLAKGVEMLFGFFRTLFRVLFRIRVTGDTQALYGERVLITPNHVSFLDGVLLALFLPVRPVFAVYSSISEKWYMRWLKPLIDFVPLDPTKPMMIKHLVRLIGQGRPVVIFPEGRISVTGSLMKIYDGAGFVAAKSQATVVPLRIDGAELTFFSRLKGLVKQRLFPKITLHILPPTSLPMPEAPRARDRRKIAGEMLHQIMMEARMAVRPRETLYESLLSAQYRYGAKKNCIEDINFTPDTYRKLLTKTLFVGRILEKYSKQGEKIGLMLPNAGISAAVIFGAVSRGRIPAMMNYTAGVKGLSSAITAAQINTVFTSRQFLDKGKLWHLPEQLTQVRWVFLEDLKADVTTADKLWIFAHLLMPRLAQVKQQPEDDAIILFTSGSEGNPKGVVHSHKSILANVEQIKTIADFTANDRFMSALPLFHSFGLTVGLFTPLLTGAEVFLYPSPLHYRIVPELVYDRNCTVLFGTSTFLGNYARFANPYDFFRVRYVVAGAEKLQDSTRQIWQDKFGLRILEGYGVTECAPVVSINVPMAAKPGTVGRILPGLDARLLAVPGIEDGGRLQLKGPNVMNGYLRVENPGVLEAPTAENVNGEVETGWYDTGDIVRFDDQGFVQIQGRAKRFAKIAGEMVSLEMVETLATAVSAEKMHATVVKSDASKGEALVLFTTDGELKRDALLRYAREHGIPELAVPRDIRYLKQLPVLGSGKPDFVTLKGMVEEAEQQNA

SEQ ID NO: 7553 - protein, 404 aa, Enterobacter cloacae
FLHSCMICYTGTSQAEFHCILKRRTVMSAMDFKKHTDLNFPHYAPPAVSAKEIDLLGLLDVLLAAKKRIITIVFAFALVGLAIAFLIPQKWTSKAVITPAEQTQWSSLRQMMVALQVLDVDVKITRADVCNLFIKKFQSQSLLEEYMKSSPYVMAQLDGADVDPLELHRAVVNIAEKMKAVDNTQEKNADKAPYLSWTLSFTAPTAEDAQKVLNGYIQYISRIVEQETMQNIRDQLILKTKTVQQQLESDRVRLTNIHNTNLQRLNYSLEVANAAGIKKPVYSNGQAVKDDPDYSVALGADGIAQKLQIEKNLKDVSELNADFQNREYYLAQLQKLSFEDVSLEPFKYQLSPSMPVKKDGPGKALIVLLACILGGLFACGSVLLREAMSTRNPLPEQLPEPVTE

SEQ ID NO: 7554 - protein, 394 aa, Enterobacter cloacae
HQKRRSTERLFLFQEIFAYRRKGIQQGAGFQANAAVHHVRRFIEGVARGHHMLLLANGELKFPRENVGELLMRVVMHRANRAFLEIHFHRHHPAVVRQNTTRHAVAQILKRGLFMENKHIFALLCNETLFQLTYLTRREKETFSQITGKAITSLLHWVKRTGGKMKTIGLLGGMSWESTIPYYRLINEGVKQRLGGLHSASLLLHSVDFHEIEACQSSGEWDKAGQILADAALGLERAGAQGILLCTNTMHKVASHIEDRCSLPFLHIADATGRAIRTAGMTRVALLGTRYTMEQDFYRGRLSSQFGIESLIPEEADRARINQIIFDELCLGTFSEASRAWYVSVIEKLAQQGAEGVIFGCTEIGLLVPADRSPISVFDTAAIHAADAVEFMLS

SEQ ID NO: 7555 - protein, 454 aa, Enterobacter cloacae
ACSISFLHRLTIKRYFLFSSGYGVMIKNRFPETTMPRPLNQTETDLNADNLLRLPAEFGCPVWVYDAQIVREKIAALHQFDVVRFAQKACSNIHILRLMREQGVKVDSVSLGEIERALVAGFDPKADSDAIVFTADLIDDATLARVHELQIPVNAGSVDMLEQLGQVSPGHRVWLRVNPGFGHGHSQKTNTGGENSKHGIWYADMPAALEVLQRYNLKLVGIHMHIGSGVDYGHLEQVCGAMVRQVIDFGQDLEAISAGGGLSIPYREGEEAIDTDHYYGLWSAARDRIAAHLGHAVKLEIEPGRFLVAEAGVLVAQVRSVKEMGSRHFVLIDAGFNDLMRPSMYGSYHHITALAADGRDLVNAPRIETVVAGPLCESGDVFTQQEGGKVETRSLPEVKPGDYLVLHDTGAYGASMSSNYNSRPLLPEVLFDNGVARLIRRRQTIQELLALELV

SEQ ID NO: 7556 - protein, 310 aa, Enterobacter cloacae
RAWLKRQNSKMRESVHTNTSIWSKGMMAVIAAQFLSAFGDNALLFATLALLKAEFYPDWSQPILQMVFVGAYIVFAPFVGQVADSFPKGRVMMFANSLKLLGAASICFGINPFVGYTLVGIGAAAYSPAKYGILGELTTGDKLVKANGLMESSTIAAILLGSVAGGVLADWHVLAALGICALMYGGAVIANLFIPKLAVARPGQSWRFGPMTGSFFNACRVLWRNGETLFSLMGTSMFWGAGVTLRFLLVLWVPVALGITDNATPTYLNAMVAVRIVVRAGAAAKLVTLENRPRAACLPGILDWGPAFCS

SEQ ID NO: 7557 - protein, 179 aa, Enterobacter cloacae
SRGRIKMQYTRLGKSDLLVSRICMGCMGFGDPLTGQHRWTLDETASRDIIRYGLEKGINFYDTAIAYQNGSSERYVGRALREMAKREDVVLATKFLPRTAAQIAAGIGGKEAIARSLDQSLQNLGMDYIDLYIYHIWDYNTPVIEVLEALHAAVTAGKVRAIGISNCYAWQLAKANALA

SEQ ID NO: 7558 - protein, 120 aa, Enterobacter cloacae
REGLTAFVSVQSHYNLIMREDERELFGLCAEDDIAMTPYSALASGRLSRKEGHTRRASEDAYARGKYDSTAEQDRSIIERVAELAERHQVSMTEISLAWLLTKVTSPVVGARKKITSMAR

SEQ ID NO: 7559 - protein, 202 aa, Enterobacter cloacae
TRIYRVLCQQGMPLRLLSIYNSHLRNTMHIRKGLSTDLARLECCDFSFTVDEIAREPFLNGDLHIEALTEPYLKTYELDLQTLENHCVNPDSIFLIAETDDGEIAGFITASCNWNKFISVDYIAVERSKRRTGAAHKLMSATHVWARSLNAPGLRLETQNVNVSACLFYRHYGFILGGYDRYLYNALPEKDEVALFWYYMLA

SEQ ID NO: 7560 - protein, 196 aa, Enterobacter cloacae
RLILELTIKEAGMSTGNNHTLHYPRPPFAEQPQRAPGLASEMKPIPDHGETSYIGSGKLAGKKALITGGDSGIGRAVAIAYAREGADVAIGYLPEEESDAASVIALIQAEGRKAVAIPGDIRVESFCDTLVEKAVAELGGLDILVNNAGRQQYCESIDDLTTADFDATFKTNVYAPFWITKAALRLHPRERARSRA

SEQ ID NO: 7561 - protein, 402 aa, Enterobacter cloacae
GGSQPGWGIPSGGLGRFIQKPPNCSENVLMDGRLIRGQNPVSAHGVGGALLNAVGQPSKNIHLSFTVTHPLWPVYVSNVPAFFQELNMKSLPSVALGTWSWGTGFAGGDTVFGNHLSDTQMADVFTTAMSKGLNLWDTAAVYGMGSSEAALGALVRQFPREDMILSTKFTPQIANEQSAQPVSDMLEASLGRLGVDAIDIYWIHNPLDVEKWTPGLIPLLQSGKVKRVGVSNHNLAQIRRANEILNASGYSLSAVQNHYSLLYRASEEAGILGYCRQNNITFFAYMVLEQGALSGRYDSNHPMPAGSGRAESYNAVLPQLERLTAAMKKMGADRNASVAQIAIAWAIAKGTLPLVGATKVHHVLDAACASDIQLRDEEIILLEQLATETRVDTRGAWEKPMV

SEQ ID NO: 7562 - protein, 357 aa, Enterobacter cloacae
SASLLLLCMKGENMKIICLEEHYLDSELGRACMPVALEQAPFLGDWGKTVADGHNPDRSRPQIEKNALINAKGADLGSRRLRDMDEAGITLQILSVGGFPQLAPGDEAVTLNTAANDRLAGAVRNHPDRFAAFATLPWAQPEEAEKELVRAVEKLGFKGALLNGRPSSCFLDHPDYDSLLSRFNKLNVPLYLHPGLPLKSVQQAYFTGFNAEVNARLSMFGWGWHHEAGIHLLRLMLSGAFDKYPHLQVISGHWGEMLPFWLQRLDDSLPLAATGLSRTLTRTFQEHVYVTPSGMLTLPHFQFIYALMGADRILFSVDYPYQTLDGVKTFIDSLPVNKAEKEAIAFRNAERLLGITA

SEQ ID NO: 7563 - protein, 193 aa, Enterobacter cloacae
LIEMKNILIVSGHPELTHSVANATILDEVATALPDAEIRRLDWLYPDGKFNIAAEQESLLRADVIVWQFPFSWYGLPGLMKQWLDEVFVHGFAHGSTAKLGGKKLLLSFTTGAPQALYTADGFFGHAIEEYLIPFETTAKLCNLELLEPVYTCGISYADRDADKLAQQKTLAREHALRLVHLLNSVVNNPEGE

SEQ ID NO: 7564 - protein, 213 aa, Enterobacter cloacae
RFTVLLRQRRFMMVLLQRRAAALFLFAFIFLMPASHAHSREKTDIKTLVIVSHPYPERSVLTKGLQEAAESLEGVTVRNLETLYGYDTRRINGDAERKMMREHRRVVFIFPTHWFNITPMMKAWLNETWGSVGPGLWQGKEMFIVSTAAGGSSTYGTDGRIGVSLADVFLPMKASALHAGMTWLPPLVFESASSDRLPSYQHQLIERLKQPFQ

SEQ ID NO: 7565 - protein, 253 aa, Enterobacter cloacae
NVLNSHFSKRIIVKKTLMLLICMLISSPVFATKLDAPDKRVMNIFELGVRPDRDKDFADVARQTISASVDHEAGTLAMYALHRSDNPRQAFMVELYENENAYRKHLNAEPYKAFADRAPDIIDQKNKITLEPQFLGDKHIIPDERTINNLVIVEVKPEFQTEFKNIVLPEMAESLKVEKGVLAMYAATDSQTPNRWYFYEIYASEEAYQLHRQTPHFRDYLRQTAHMSASKNAIPVKPVFLRNKSGIKQDPHR

SEQ ID NO: 7566 - protein, 272 aa, Enterobacter cloacae
PVRINMKSVIAAAAMSLVISDFATAEETRGKAMMKIEPSTISEADIRSVSPALARFGREAITEDLWTRDALSPRDRSMVTVAMLIARNQPGDLKHYMDIALDNGVTPAELSEIITHLAFYSGWPNAMSAVSVTKAVFETRGVTADALPDASPDLLPLNQQAEKQRSETVEKNVGPISPGLVKFTADPLFLDLWQRPALKPRDRSLITVSALIASGQSAQIGYHLNRAMDNGLSVEEAGEIVTQAAFYAGWPNAFTAAPVVGEVLNNRSSSKR

SEQ ID NO: 7567 - protein, 496 aa, Enterobacter cloacae
GVSCNDKVQMVRLPPCKSHLYSFVIHTLFSEDNLMTLFSSQPGDEGLPGPARARVMAAIMTTTLMGVFDGTMINIALPSMAQEMQVPASIAVWFANGYLLAAAMSLAIFAALAARLGYRPVFLAGLTTFTLTSLGCALAKTPEVLIGMRVLQGIGGAATLSIAPAILRSVFPGRLLGRILGLHALLIASSSAIGPVLGGTILHTLSWQWLFAINVVPGTLALLLAVKALPRDAVRKQAPFDTPGAILSALLLGSTIMAANSLQEATYHPGSLCWTVLAALSGMAFIWQIRRTDNPLLPPTMFKNERFTLAAFTSMIAFVSQGITFIALPFLFQSEYGYSPVLSALLFTPWPLGIVLIAPHAGRWADTISAPAISTLGLVIFVVGLILLATLPDRPTMWDICLRSLVCGMGFGCFQSPNNREMLSNVIREHASYASGVLSIMRTFGQCLGAAAVAVLLAADERSIHVALWVAAAASAVAVVVSASRLRKITHPAETG

SEQ ID NO: 7568 - protein, 182 aa, Enterobacter cloacae
HARCPGRGRSCHRKTAGKETAVGRVTAPEPLSSVHQLAEFVSGEAVLDEWLKQRGLKNQALGAARTFVICKTGTKQVAGFYSLATGSVNHTQATGNLRRNMPDPIPVIILARLAVDVSLRGNGLGADLLHDAVLRCYRVAENIGVRAIMVHALTEEAKAFYIHHGFKASQTQERTLFLRLPQ

SEQ ID NO: 7569 - protein, 827 aa, Enterobacter cloacae
WRSSAMIPSSTYRIQFRNGMTFDRVADLIPYMKDLGISHLYASPVFTATTNSTHGYDVTDPNEIDPAIGGREGFDRMAAALKQAGMGLILDIVPNHMSTSLENRWWRDVIEHGGQSRYAAYFDIDWSRPLTLPFLGDTFEAELERGTITLKRDSVTNSAALVYYDTAYPLNPGTYAEGKSIAEIHEAQSWRLMSWREAPKQLSWRRFFEITGLVGVRVEDEAVFADTHHLILELVHAGVVDGLRIDHVDGLADPLGYLQRLRAATGPDCYITVEKILAKGEQLPPEWPISGTTGYEFIASLAEVLVDDTNLSRLEMLYDETLGTTVDRQAELRNAKGLMTDRNFEGEFTTLLKIASELAGHNGAEVEHDDIRHALRELLIAFPVYRTYGTAEGLTPPDVALLSRVVASVNASEPALSLIVRILTGDLPEHDHALASLFRTRFQQLTGPLMAKSVEDTLFFRHNLELALNEVGADPTPRAFSLSRFHQEMRIRLARQPDALLGTSTHDTKRGEDARARLYTLTEAPDLWGENLARWRQMNQTQVRFLNDGTAPNAADTWMIFQALAGVWPATLSPEDRDGLKSLEERFLGFIEKALREAKQRTDWIDSNEGYESVVLDYVRHLLSPDNTLFLRDFSAALQPFIRAGLMNSLSQTVIKLTAPGVPDIYQGSEGLNFSLVDPDNRREPDFAALAENLSVADGTVFNDAQRWRDGSVKQYVTATLLRLRPHYPALFRYGDWLPLKVTGEREENLIVYARIKDDEALIVAVPRLVFDVTDNALLWANTIVAIPQELAGKHYRDLFTGERRLLPDTLDLTSEKGCLLVLLTCD

SEQ ID NO: 7570 - protein, 696 aa, Enterobacter cloacae
SRRTKMPKDTTFEIRAGHGQQLGANYDGKGVNFALFSAHAERVELCLFDPSGKTEIARLELPEYTHEVWHGYVPDLKPGALYGYRVYGPYDPENGHRFNPNKLLIDPYARELVGDIEWNDAHFGYELGHDELDLSFDTRDSAPFTPKCKVIDPNAVDWQDSRRPDIPWPHTVVYESHVKGFTQLNPAIQPELRGTFEGMGHKASVEYIKSLGITSVELLPVHWFPDDQHLLDRGLKNFWGYNSLGFFAPASRYYGPAGIQGFRDMVRAYHDAGIEVILDVVYNHTAEGNELGPTLSFKGIDNFCYYRTMPDQHRYYINDTGTGNTVNTSHPRVLQMVMDSLRYWAESMQIDGFRFDLGTILGREPEGFDPRGGFFDAVTQDPVLSKLKLIGEPWDIGPGGYQVGGFPPGWGEWNDKYRDTVREYWKGDNVSNDFAARLLGSGDLYDLRGRRPWASVNFITAHDGFTLNDLVSYNEKHNADNGEDNNDGHNDNRSYNYGEEGPTENPDIIATRERQKRNFLTTLFFSHGTPMLLAGDEFGRTQKGNNNGYCQDSEISWVNWEGLTENDEKLRDFTRRLIALRATQPLLRRENWRDGLEIRWFNAGGGPQQSEQWDEGSTLGLAISRPDLEQEEGVWQDVLMLFNPFEGTVPFQIPQFGEGGWVLELSTSEDATTGEIITESVDYELAGRSITLFRRP

SEQ ID NO: 7571 - protein, 320 aa, Enterobacter cloacae
NALSECTGMSAMTDPDFNLLIALDILLSEASVAGAARRLNLSTSAMSRTLSRLRDVTGDPILVRAGRNMVLTPWAEATRDRARRAVHETRAVLQPSTETFSARSLARLFTIRANDGFVVAFGPALIAAVADAAPDVCIRFAPKPEKTSRYLREGLVDLEIGVQSNMGPEIRLQRLFEDRFVGVVRKGHPLANQAEIGVKDYVAWGHVVASPEGALHGSVDDALAELGTKRKIASVVPGFPTALSVALASDLVAMIPALYLLNQQITEQLHVFELPFKSRRITVSQMWHPRMERDPGHRWLREQILAICGVERSDMIKSAV

SEQ ID NO: 7572 - protein, 97 aa, Enterobacter cloacae
SNCYTRGIPMKSDVQLNLRAKESQRALIDAAAEILHKSRTDFILEMACQAAENVILDRRVFNFNDEQYAEFIDMLDAPVADDPAIEKLLARKPQWDV

SEQ ID NO: 7573 - protein, 595 aa, Enterobacter cloacae
MEFRTCRRHWGAEFISDDVVRFRVWAEGQKDLTLRLTDTDIPMAAVGDGWFQIDVPGVRHGTTYQFVLQDGMAVPDPASRAQQADVNGPSVVIDPRRSLPAQREWQGRPWEETVIYELHIGTFTGEGTFRSAIDKLPYLAELGITQLEVMPVSQFGGARGWGYDGVLLYAPHSAYGTPDDFHAFIDAAHALGLSVVLDIVLNHFGPEGNYLPLLSPAFFHQDRMTPWGNGIAYEVEAVRQYIAEAPLFWLSEYHLDGLRFDAIDQIHDDAETHILPEIAQRIRDAFPDRHIHLTTEDSRNVIFLHPRDEHGQTPLFTAEWNDDFHNAAHVFATGESHAYYQDFAFEPEKKLARALAEGFVYQGEISLQTGKSRGVECREQPPQFFVDFIQNHDQVGNRAQGERLISLAGADKTRVLFAALLLSPHIPLLFMGEEYGETHPFLFFTDFHGDLAKAVREGRAKEFTGHAGHDETVPDPNDLNTFMRSKLDWNKADTEEGRAWLHVTRELIVLRQRFIVPLLKQRGTVEGNVLQTALGMVAVSWRFPSGTLSLALNIGKKPLALPDLPGKTIFSWPEAVENLPPNSIVVRFADGEAAL

SEQ ID NO: 7574 - protein, 220 aa, Enterobacter cloacae
CFISADPASSRGEDLVGKKVGMTRIFTEDGVSIPVTVIEVEANRVTQVKDLANDGYRAIQVTTGAKKANRVTKPEAGHFAKAGVEAGRGLWEFRLAEGEEFTVGQDISVELFADVKKVDVTGTSKGKGFAGTVKRWNFRTQDATHGNSLSHRVPGSIGQNQTPGKVFKGKKMAGQLGNERVTVQSLDVVRVDAERNLLLVKGAVPGATGSDLIVKPAVKA

SEQ ID NO: 7575 - protein, 123 aa, Enterobacter cloacae
  UNSURE (101)
RRKGIAMELVLKDAQSALTVSETTFGRDFNEALVHQVVVAYAAGARQGTRAQKTRAEVTGSGKKPWRQKGTGRARSGSIKNPIWRSGGVDFAARPQETQSXVNKKMLRGALKSILVQLGTSGS

SEQ ID NO: 7576 - protein, 306 aa, Enterobacter cloacae
LQHDGSLRAASMFKQYLQVTKPGIIFGNLISVIGGFLLASKGSIDYTLFIYTLVGVSLVVASGCVFNNYIDMDIDKKMERTKNRVLVKGLIAPSVSLVYATLLGIAGFMLLWFGANPLACWLGVMGFVVYVRVYSLYMKRHSVYGTLIGSLSGAAPPVIGYCAVTNEFDSGALILLAIFSLWQMPHSYAIAIFRFKDYQAANIPVLPVVKGISVAKNHITLYIIAFAVATLMLSLGGYAGYKYLVVAAAVSVWWLGMALRGYKVEDDKVWARKLFVFSIVAITSLSVMMSVDFMVPDSQNLLTYVW

SEQ ID NO: 7577 - protein, 457 aa, Enterobacter cloacae
TEVVMNDYKMTPGELRATWGLGTVFSLRMLGMFMVLPVLTTYGMALQGASEALIGLAIGIYGLAQAIFQIPFGLLSDRVGRKPLIVGGLLVFVLGSIIAALSHSIWGIILGRALQGSGAIAAAVMALLSDLTREQNRTKAMAFIGVSFGVTFAIAMVLGPIITHSLGLHALFWMIAMLATIGIALTLWVVPDSKNHVLNRESGMVKGCFSKVIVEPRLLKLNFGIMCLHILLMSTFVALPGQLAAAGFPAAEHWKIYLVTMLISFVSVVPFIIYAEVKRKMKRVFVGCVALLLIAEIVLWGAGPHFWELIAGVQLFFLAFNLMEALLPSLISKESPAGYKGTAMGIYSTSQFLGVAIGGSLGGWVDGLFDSQTVFLAGALLAMLWLFVASTMKEPRYVSSLRVEIPDDVAIGDALQQRLEATEGVSEVLIVPEERSAYVKIDSKVTNRFEVEQALKA

SEQ ID NO: 7578 - protein, 204 aa, Enterobacter cloacae
DKGSMPDGTILSTIAAICDFKELNAMTRRYLKIVLVGSLFTLSACAQQSEVREMKQSVNTLNVAMDKLNKETVKITQQNALNAKSSNGVHLLPGANTPARLNSQIGTLKMSLVNVAANADGTRATLRIQGESNDPLPAFSGTVEWGQIQGTTESYQEVNVKNQLFTAPASTLAPSDVDIPLQLSGLTPEQLGFIRIHDIQPAAQ

SEQ ID NO: 7579 - protein, 676 aa, Enterobacter cloacae
ATRKPLTKGPRKKMFGKLTLDAVPYHEPIIMVTVAAIIIGGAALVGLITYFGKWSYLWNEWLTSVDHKKLGIMYCIVGIVMLIRGFADAIMMRSQQALASAGEAGFLPPHHYDQIFTAHGVIMIFFVAMPLVIGLMNVVVPLQIGARDVAFPFLNNLSFWFTVVGVILVNLSLGVGEFAQTGWLAYPPLSGIEYSPGVGVDYWIWALQLSGVGTTLTGINFFVTILKMRAPGMTMFKMPVFTWASLCANVLIIASFPILTVTIALLTLDRYLGTHFFTNDMGGNMMMYINLIWAWGHPEVYILVLPVFGVFSEIAATFSRKRLFGYTSLVWATVCITVLSFIVWLHHFFTMGAGANVNAFFGITTMIIAIPTGVKIFNWLFTMYQGRIVFHSAMLWTIGFIVTFSVGGMTGVLLAVPGADFVLHNSLFLIAHFHNVIIGGVVFGCFAGVTYWWPKAFGFTLNEKWGKRAFWFWIIGFFVAFMPLYVLGFMGMTRRLSQQIDPQFHPMLMIAAGGAALIACGILCQLIQYYVSIRDRNLNRDLTGDPWGGRTLEWSTSSPPPFYNFAVVPHIHERDAFWEMKEKGEAYKQPEHYEEIHMPKNSGAGIVIAAFATVFGFAMIWHIWWMAIVGFAGIVISWIVKSFDEDVDYYVPVREVEKLENQHFDEISKAGLKNGN

SEQ ID NO: 7580 - protein, 140 aa, Enterobacter cloacae
PYPYYVPEPVLALPGRGMDLCVLCCLSDGGDVMSHSNDHGASHGSVKTYMTGFILSIILTVIPFWMVMNGSASKPVILGAILVTAVIQILVHLVCFLHMNTKSDEGWNMTAFIFTVIIIAILVVGSIWIMWNLNYNMMVH

SEQ ID NO: 7581 - protein, 306 aa, Enterobacter cloacae
GGTMKVTVLGCGALGQLWLTALCKQGHDVQGWLRIPQPYCSVNVMGTDGSIFNESLTANDPEFLATSDLLLVTLKAWQVSDAVKSLAAQLPESTPILLIHNGMGTIEELKSVRQPLLMGTTTHAARRDGNVIIHVASGITHIGPAREQPGDYSYLADTLQSTLPDVAWHNNIRAELWRKLAVNCAINPLTALLDCPNGELRQHPDRVALICREVAAVIEREGYHTSESDLRYYVDQVIESTAENISSMLQDIRAMRHTEIDYITGYLLKRARAHGITVAENSRLFELVKRKESEYERIGTGMPRPW

SEQ ID NO: 7582 - protein, 334 aa, Enterobacter cloacae
TYCLNSRSGTMQYTTLGKTDLKVSRLCLGCMTFGEPDRGNHAWTLPEESSRPIIKRAIDGGINFFDTANSYSDGSSEEIVGRALRDFARRDDVVVATKVYYPSGDLAEGLSRAQILRSIDDSLRRLNMDYVDLLQIHRWDYNTPIEETLEALNDVVKAGKARYIGASSMHASQFAQALDLQAQHGWARFVTMQDHYNLIYREEEREMLPLCYQEGVAVIPWSPLARGRLTRPWGETTARLVSDEVGKNLYDDTETSDALIAERLAGIADDIGATRAQVALAWLLSKRGVAAPIVGTSREEQLDELLSAVDLSLTPEQIAELETPYQQHPVVGFK

SEQ ID NO: 7583 - protein, 205 aa, Enterobacter cloacae
KMATDTLAHSTAHAHEHAHHDTGPTKVFGFWIYLMSDCILFCCLFATYAVLVNGTAGGPTGKDIFELPFVLVETALLLFSSITYGMAAIAMYKNNKSQVVSWLALTWLFGAGFIGMEIYEFHHLIMEGFGPDRSGFLSAFFALVGTHGLHVTSGLIWMAVLMFQISRRGLTSTNRTRIMCLSLFWHFLDVVWICVFSVVYLMGAM

SEQ ID NO: 7584 - protein, 202 aa, Enterobacter cloacae
NERRVSMSASALVCLAPGSEETEAVTTIDLLVRGGIKVTTASVASDGSLAITCSRGVKILADAPLVQVADGDYDIIVLPGGLKGAECFRDSPLLVETVRQFHLSGRIVAAICAAAGTVLVPHDIFPIGNMTGFPGLKDTIPEDQWVDKRVVWDPRVNLLTSQGPGTAIDFGLKIIDLLVGREKAYEVASSLVMAAGIYNYYE

SEQ ID NO: 7585 - protein, 82 aa, Enterobacter cloacae
FTMPKKNDAPASFETALSELEQIVTRLESGDLPLEDALNEFERGVQLARQGQVKLQQAEQRVQILLSDSEDAKTTPFTPDAE

SEQ ID NO: 7586 - protein, 299 aa, Enterobacter cloacae
MDFSNALQARVIRANDALRRFIEPQPFQNTPLVEAMHYGALLGGKRLRPFLVYATGNMFGISDNTLDAPAAAVECIHAYSLIHDDLPAMDDDDLRRGQPTCHIKFGEANAILAGDALQTLAFSILSDAPMVEVSDRDRLAMVSELAMASGVAGMCGGQALDLEAEGRQVTLEQLERIHRHKTGALIRAAVRLGALSAGERGRKALPILDRYAESIGLAFQVQDDILDVVGDTATLGKRQGADQQLGKSTYPALLGLEHAQRKARDLIDDARQSLNELAAQSLDTSALEALADYIIQRDK

SEQ ID NO: 7587 - protein, 628 aa, Enterobacter cloacae
TINLDEPLMSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKENKQRRTVCVIGDGAITAGMAFEAMNHAGDIKPDMLVILNDNEMSISENVGALNNHLAQLLSGKLYSSLREGGKKVFSGVPPIKELLKRTEEHIKGMVVPGTLFEELGFNYIGPVDGHDVLGLVTTLKNMRDLKGPQFLHIMTKKGRGYEPAEKDPITFHAVPKFDHTSGCLPKSSGGMPSYSKIFGDWLCETAAKDNMLMAVTPAMREGSGMVEFSKKYPDQYFDVAIAEQHAVTFAAGLAIGGYKPVVAIYSTFLQRAYDQVIHDVAIQKLPVLFAIDRAGIVGADGQTHQGAFDLSFLRCIPDMVIMTPSDENECRQMLYTGYHYQDGPCAVRYPRGNALGVELQPLEKLDIGKALVKRRGEKVAILNFGTLMPEAAKVAENLNATLVDMRFVKPLDESLILSMAESHDVLVTLEENAIMGGAGSGVNEVLMANRKAVPVLNLGLPDHFIPQGTQDEARADIGLDAAGIEAKIRTWLA

SEQ ID NO: 7588 - protein, 402 aa, Enterobacter cloacae
KSSIKSPISALPPFTAASKTSKSLAKRSPAYRIKTMHDEMYMARAMKLAQRGRFTTHPNPNVGCVIVKDGEIVGEGFHYRAGEPHAEVHALRMAGEKARGATAYVTLEPCSHHGRTPPCCEALIAAGVSRVVAAMQDPNPQVAGRGLYRLQQEGIDVSHGLMMQDAEALNKGFLKRMRTGFPFIQLKLGASLDGRTAMANGESQWITSPQARRDVQRLRAQSHAILTSSETVLADDPAMTVRWEELNADTQALYPQENLRQPLRIIIDSQNRVTPEHRIVQQPGETWIARTKEDTREWPQGVRSITVPEHNGHLDLVVLMMLLGKQQVNSIWVEAGPTLAGALLQAGLVDELLVYVAPKLLGNDARGLFVLPGLEKLADAPQLSFSEIRPVGPDVCLHLTTA

SEQ ID NO: 7589 - protein, 159 aa, Enterobacter cloacae
RKSMNIIEAAVATPDARVAITIARFNNFINDSLLEGAVDALKRIGQVKDDNITVVWVPGAYELPLAAGALAKTGKYDAVIALGTVIRGGTAHFEYVAGGASNGLAHVAQDAEIPVAFGVLTTESIEQAIERAGTKAGNKGAEAALTALEMINVLKAIKA

SEQ ID NO: 7590 - protein, 146 aa, Enterobacter cloacae
FFCKGNSVKPAARRRARECAVQALYSWQLSQNDIADVEYQFLSEQDVKDVDVLYFRELLSGVATNSAYLDGLMKPYLSRLLEELGQVEKAVLRIALFELSKRDDVPYKVAINEAIELAKTFGAEDSHKFVNGVLDKAAPAIRPHKK

SEQ ID NO: 7591 - protein, 184 aa, Enterobacter cloacae
ASRYASLRVLCNATKMKGEEKMPSFDIVSEVDLQEARNGVENAVREVESRFDFRGVEATIELNDANKTIKVLSESDFQVNQLLDILRAKLLKRGIEGTSLDVPEDFVHSGKTWFVEAKLKQGIESAVQKKIVKLIKDSKLKVQAQIQGEEIRVTGKSRDDLQSVMALVRGGDLGQPFQFKNFRD

SEQ ID NO: 7592 - protein, 153 aa, Enterobacter cloacae
QGHRMHCPFCSAVDTKVIDSRLVGEGSSVRRRRQCLVCNERFTTFEVAELVMPRVVKSNDVREPFNEEKLRSGMLKALEKRPVSSDDVEMALNHIKSYLRGLGEREVPSKMIGNLVMEQLKKLDKVAYIRFASVYRSFEDIKEFGEEIARLQD

SEQ ID NO: 7593 - protein, 324 aa, Enterobacter cloacae
RMACGEFSLIARYFDRVRTSRLDVETGIGDDCALLNIPEKQTLAISTDTLVCGRHFLPDIDPADLAYKALAVNVSDLAAMGADPAWLTLALTLPEVDEAWLEAFSDALFEQLNYYDMQLIGGDTTAGPLSMTLAIHGYVPAGRALKRSGAKPGDWIYVTGTPGDSAAGLAILQNRLTVEDADDAAYLVKRHLRPTPRILHGQALRERASSAIDLSDGLISDLGHILKASGVGARIDLDLFPLSEPLRRHAEPEQALRWALSGGEDYELCFTVPELNRGTLDVALAHLGAKFTCIGQVMPESEGLLFVRDGAPVTLDWKGYDHFA

SEQ ID NO: 7594 - protein, 490 aa, Enterobacter cloacae
ACLRNIAAMKFIIKLFPEITIKSQSVRLRFIKILTGNIRNVLKHYDETLAVVRHWDHVEVRAKDESKRLDIRDALTRIPGIHHILEVEDVPFSDMHDIFEKALVQYRDQIEGKTFCVRVKRRGKHEFSSIEVERYVGGGLNQHVETARVRLTNPDVTVNLEIENDRLLLVKGRYEGIGGFPIGTQEDVLSLISGGFDSGVSSYMLMRRGCRVHYCFFNLGGAAHEIGVRQVAHYLWNRFGSSHRVRFVAINFEPVVGEILEKVDDGQMGVVLKRMMVRAASKVAERYGVQALVTGEALGQVSSQTLTNLRLIDNVSDTLILRPLISHDKEHIIDLARKIGTEDFARTMPEYCGVISKSPTIKAVKAKIEAEEENFDFSILEKVVAEASNIDIREIAQQTEQEVVEVETVSGFGANDTILDIRSVDEQDDKPLQVEGVEVVSLPFYKLSTQFGDLDQSKTYLLWCERGVMSRLQALYLREQGFANVKVYRP

SEQ ID NO: 7595 - protein, 719 aa, Enterobacter cloacae
RSERILATTTAERVIQATPDYHALNAMLNLYDREGRIQFDKDREAVDAFFAAHVRPNSIVFGSQQERLDWLVKEGYYEERVLTRYDRAFVVALFERAHASGFRFQTFLGAWKYYTSYTLKTFDGKRYLESFEDRVVMVALTLAQGDEVLAESLTEEILSGRFQPATPTFLNCGKAQRGELVSCFLLRIEDNMESIGRAVNSALQLSKRGGGVAFLLSNLREAGAPIKRIENQSSGVIPVMKMLEDAFSYANQLGARQGAGAVYLHAHHPDILRFLDTKRENADEKIRIKTLSLGVVIPDITFKLAKENADMALFSPYDVERIYGKAFGDVAISELYDELVADDRIRKKTINARDFFQTLAEIQFESGYPYIMYEDTVNRANPIGGRINMSNLCSEILQVNSASSYDENLDYADVGKDISCNLGSLNIAHTMDSPDFGRTVETAIRGLTAVSDMSHIRSVPSIEAGNAASHAIGLGQMNLHGYLAREGIAYGSPEGLDFTNLYFYTVTWHAVHTSMMLARERHQRFAGFEQSRYASGEYFSQYLEGDWQPKTEKVRALFARAGITLPTREMWQQLREEVMRYGIYNQNLQAVPPTGSISYINHATSSIHPIVSKIEIRKEGKTGRVYYPAPFMTNENLALYQDAYEIGPEKIIDTYAEATKHVDQGLSLTLFFPDTATTRDINKAQIYAWKKGIKTLYYIRLRQLALEGTEIEGCVSCAL

SEQ ID NO: 7596 - protein, 322 aa, Enterobacter cloacae
GEWMKLSRVSAVNWNKIQDDKDLEVWNRLTSNFWLPEKVPLSNDIPAWQTLSHAEQQLTIRVFTGLTLLDTIQNTVGAPALMSDALTPHEEAVMSNISFMEAVHARSYSSIFSTLCQTRDVDAAYAWSEESASLQRKADLVLEYYRADEPLKKKIASVFLESFLFYSGFWLPMYWSSRGKLTNTADLIRLIIRDEAVHGYYIGYKYQKGLEKVIPEKREELKGFALDLLMDLYDNELSYTEELYAGTGWEEDVKAFLCYNANKALMNLGYEALFPPEMAEVNPAILAALSPNADENHDFFSGSGSSYVMGKAVETQDEDWDF

SEQ ID NO: 7597 - protein, 406 aa, Enterobacter cloacae
QDTLYCMAIKLEVKNLYKVFGEHPQRAFKYIEKGLSKEQILEKTGLSLGVKDASLAIEEGEIFVIMGLSGSGKSTMVRLLNRLIEPTRGQVLIDGVDIARISDAELREVRRKKIAMVFQSFALMPHMTVLDNTAFGMELAGIPAQERQEKALDALRQVGLENYAHAYPDELSGGMRQRVGLARALAINPDILLMDEAFSALDPLIRTEMQDELVKLQAKHQRTIVFISHDLDEAMRIGDRIAIMQNGEVVQVGTPDEILNNPANDYVRTFFRGVDISHVFSAKDIARRTPNGIIRKTPGFGPRSALKLLQDEDREYGYLVERGNKFVGVVSIDSLKTALSENQGIDAALIDAPLAVDAETPLSELLSHVGQAPCAVPVVGEEQQYVGIISKRMLLQALDREGTNNG

SEQ ID NO: 7598 - protein, 403 aa, Enterobacter cloacae
SLNSRFLKLMTKTTQGLSPALILLMSVATGLAVASNYYAQPLLDTIARAFDLSASSAGFIVTAAQLGYAAGLLFLVPLGDMFERRMLIVSMTLLAAGGMLITASSQSLTMMIIGTALTGLFSVVAQILVPLAATLASPEKRGKVVGTIMSGLLLGILLARTVAGLLASLGGWRTVYWVASVLMLIMALALWRGLPKVKQENHLNYPQLLASVFSLFTRDKLLRTRAILGCLTFANFSILWTSMAFLLAAPPFNYSEGVIGLFGLAGAAGALGARPAGGLADKGKSHMTTSAGLVLLLLSWAAIWYGHVSVLALIVGILVLDLTVQGVHITNQTVIYRMKPDARNRLTAGYMTSYFIGGAAGSLISASAWQHAGWTGVCAIGAIVAAINLLVWWRGYHRQEAIH

SEQ ID NO: 7599 - protein, 407 aa, Enterobacter cloacae
QQVGSADVKIKRSWRTTMSANAENTPPQQPVNKKGKRKSALILLTLLFIIIAVAYGIYWFLVLRHVEETDDAYVAGNQVQIMAQVSGSVTKVWADNTDFVKKSDVLVTLDPTDAQQAFEKAQTALASSVRQTRQLMINSKQLQANIDVQKTALAQAQSDLNRRVPLGTANLIGREELQHARDAVASAQAQLDVAIQQYNANQAMVLGTSLENQPAVKQAATEVRNAWLALQRTKIVSPMTGYVSRRSVQPGAQISTTTPLMAVVPANNLWVDANFKETQLAHMRIGQTATVVSDIYGDDIKYTGKVVGLDMGTGSAFSLLPAQNATGNWIKVVQRLPVRIELDPKQLADHPLRIGLSTLVTVDTANRDGQILASQVRSTPAYESNAREISLDPVNKLIDDIVKANAG

SEQ ID NO: 7600 - protein, 161 aa, Enterobacter cloacae
NATFLSCSRSSDMFSPQSRLRHAVADTFAMVVYCSVVNMLIEIFLSGMSFEQSLSSRLVAIPVNIMIAWPYGLYRDAVMRLARRISPAGWVKNLADVLAYVTFQSPVYVFILLTVGADWHQIAAAVSSNIVVSMLMGAVYGYFLDYCRRLFKVSPYSQAKA

SEQ ID NO: 7601 - protein, 181 aa, Enterobacter cloacae
SGARRGRHPAGAGFPSASGCGCRRHQLVWLPSGHDQPPCRSGRQCMSTLVYFSSSSENTLRFMERLGLPAIRIPLNERERIQVDEPYILVVPSYGGGGTAGAVPRQVIRFLNDPHNRQLIRGVIAAGNRNFGEAFARAGDVISQKCGVPYLYRFELMGTQQDVENVRKGVNEFWQRQPQSA

SEQ ID NO: 7602 - protein, 360 aa, Enterobacter cloacae
IARGQTMADQSNPWGTTEAADSAAQSADAWGSTPAPADGGGAADWLNSAPAPAPEHFNIMDPFHKTLIPLDSWVTEGIDWVVTHFRPVFQGIRIPVDYILNGFQQLMLGMPAPVAIILFSLIAWQFGSAGMGIATLISLIAIGAIGAWSQAMITLALVLTALLFCVVIGLPMGIWLARSPRAAKIIRPLLDAMQTTPAFVYLVPIVMLFGIGNVPGVVVTIIFALPPIIRLTILGINQVPADLIEASRSFGASPRQMLFKVQLPLAMPTIMAGVNQTLMLALSMVVIASMIAVGGLGQMVLRGIGRLDMGLATVGGVGIVILAIILDRLTQAVGRDSRSRGNRRWYTTGPVGLLTRPFTK

SEQ ID NO: 7603 - protein, 334 aa, Enterobacter cloacae
GTTMRHNVLFATAFATLVSTSAVAADLPGKGITVQPVQSTISEESFQTQIVSRALEKLGYTVNTASEVDYNVGYTSIASGDATFTAVNWQPLHDDMYAAAGGDKKFYREGTFVTGAAQGYLIDKKTADKYHITNIEQLKDPKIAKLFDTNGDGKADMMGCSPGWGCEAVINHQNKAFDLAKTVDVSHGNYSAMMADTIARFKEGKPVIYYTWTPYWVSDVLKPGKDVVWLQVPFSSLPGEQKDIDTKLPNGMNYGFPVNTMHIVANKAWAEKNPAAAKLFSVMKLPLADINAQNAMMHAGKSSEADIKGHVDGWIKAHQQQFDGWVKEALEAQK

SEQ ID NO: 7604 - protein, 526 aa, Enterobacter cloacae
RQTPVKPKVSVMQQQKPQKPLEGAQLVIMTIALSLATFMQVLDSTIANVAIPTIAGNLGSSLSQGTWVITSFGVANAISIPITGWLAKRVGEVKLFLWSTILFVLASWACGMSSSLTMLIFFRVIQGIVAGPLIPLSQSLLLNNYPPAKRSIALALWSMTVIVAPICGPILGGYISDNYHWGWIFFINVPIGALVVLMTLQSLRGRETRTEQRRIDGIGLALLVVGIGSLQIMLDRGKELDWFASTEIIVLTVVAVVAISFLIVWELTDDNPIVDLSLFKSRNFTIGCLCISLAYMLYFGAIVLLPQLLQEVYGYTATWAGLASAPVGLIPVLLSPIIGRFAHKLDMRRLVTFSFIMYAVCFYWRAYTFEPGMDFGASAWPQFIQGFAVACFFMPLTTITLSGLPPERMAAASSLSNFTRTLAGSIGTSITTTLWTNRESMHHAQLTEAVNPFNPNAQQMYSQLEGMGMTEQQASGWLAQQITNQGLIISANEIFWISAGIFIVLLGLVWFAKPPFGAGSGGGGAH

SEQ ID NO: 7605 - protein, 117 aa, Enterobacter cloacae
TGTQIMEDRMFNRPNRNDINDDTQDIRNDVSQLADTLEAVLKSWGSDAKDEADAAKRKAQSLLRETRARMNGRSRTTQAACDMASCATTFVREKPLCTLGTVAAVGIFVGALLSLRK

SEQ ID NO: 7606 - protein, 84 aa, Enterobacter cloacae
MEMRIMSIIIYTRNDCVQCHATKRAMESRGVAFEMVNIDQVPDAADTLRAQGFRQLPVVVAGDTSWSGFRPDMINRLAAQGVSA

SEQ ID NO: 7607 - protein, 208 aa, Enterobacter cloacae
HTFGGYNRTNNSFTLFVTVVTISAVINEVMPKMDSSFTPIEQMLKFRASRHEDFPYQEILLTRLCMHMQGKLLENRNKMLKAQGINETLFMALITLESQENHSIQPSELSCALGSSRTNATRIADELEKRGWIERRESDNDRRCLHLQLTEKGHEFLREVLPPQHNCLHQLWSALSTAERDQLEHITRKLLTRLDQMDEDGVILEALR

SEQ ID NO: 7608 - protein, 564 aa, Enterobacter cloacae
NRFTIVKRQQERTMLNTPADKYQPYPTLSLPDRRWPEQIITCAPRWLSTDLRDGNQALAEPMDSARKLQFWDLLLTCGFKEIEVAFPSASQTDFNFVRQLIEENRIPDDVTIQVLTQARDDLIHRTFDSLRGAKQATVHLYNATAPLFRRLVFGMEKAQIVELATRATRLIRQLCEENPDTRWQYEYSPETFCFTEPEFALEICEAVAEIWQPCAARPMIVNLPATVEVSTPNVYADQIEYFCRHFSRRSDVCISVHPHNDRGTGVASAELAVMAGADRVEGCLFGNGERTGNVCLVTLAMNLYSQGISPNLDFSDMNRVVETVETCNQLPVHPRHPWAGRLAYTAFSGSHQDAIKKGFDARKPGERWEMPYLPVDPQDIGCTYEAVIRVNSQSGKSGSAWLIEQNHGLKLPRALQQDFSQHVQQETDNHGKEMTQNALWQLFRARYGLVASPPLALQSYRSDSQQDGQLRLTASVATHGGTRQLEGQGNGLLSAAAHGLSRWINASFVIKDYHEHTLGERSDSRSVAYIRCLFQDGTSRWGVGIDSDVARASIQALFNAVSRS

SEQ ID NO: 7609 - protein, 144 aa, Enterobacter cloacae
SFSESTMYAQYDGLIFDMDGTLLDTEPTHRQAWTEVLGRYGMRFDLQAMIALNGSPTWRIAQAVIELNQADLDPHQLAREKTDAVKAMLLDTVQPLPLIDVVKEWHGRRPMSVGTGSESAIAEALLNHLGPAPLFFCRRCRRSC

SEQ ID NO: 7610 - protein, 153 aa, Enterobacter cloacae
CRNGGGGRSLTVSDALSLASLFASSFLSSTLLPGNSEVVLVAMLLSGVSQPWLLVLIATMGNSLGGLTNVILGRFFPLREKSRWQEKAVGWLKRYGAATLLLSWMPVIGDLLCLLAGWMRISWGPVLFFLCLGKALRYVLLAWVTLQGITWWH

SEQ ID NO: 7611 - protein, 294 aa, Enterobacter cloacae
CSCKQQRRAGPAKRKTSGTAHLVSCLWMPGGASLTGPTILMTTTTTFSFTHRPLVPFSHDYAHGDSEPWHQHDCAQLLHSLTGVVRVDTASGCWVVPPGRGVWLPAGTQHALRITGNVAARTLFIDPLARADLPATCQIVQISPLLRELILTSLTLPESYAPGSRDERVYELILDEIRLMPVLPFHLPEPESEALRHLCQQIRMAPGESWSSAQAAGIVGMSERTLNRHFQQQTGLSYGEWVRRARLLEALVRLAQGQPVLRVALDLGYGSHSAFTAMFRRVMGLSPSDYFRND

SEQ ID NO: 7612 - protein, 117 aa, Enterobacter cloacae
GKDMYLRPDEVARVLEKEGFTMDEVTSKAYGYRRGENYVYVNREARMGRTALIIHPTLKDRSLSFAEPASDIKTCDHYQQFPLYLGGETHEHYGIPHGFSSRMALERFLKGLFGDVQ

SEQ ID NO: 7613 - protein, 104 aa, Enterobacter cloacae
TPCSLYHSLTSSRSGTAVVLCLSVRAARARLLKRYSITLGLRHYFSAVVAADHVKHHKPAPDTFLLCAELMGVPPAKCVVFEDADFGIQPARDAGMAAVDVRLL

SEQ ID NO: 7614 - protein, 172 aa, Enterobacter cloacae
RMPLLDSFTVDHTRMEAPAVRVAKTMNTPHGDTITVFDLRFCVPNKEVMPEKGIHTLEHLFAGFMRDHLNGNGVEIIDISPMGCRTGFYMSLIGQPEEKRVADAWKAAMEDVLKVKEQNQIPELNVYQCGTYQMHSLEEAQEIARHIIERDVRVNSNDELALPKEKLQELHI

SEQ ID NO: 7615 - protein, 523 aa, Enterobacter cloacae
QFFDRREVKLIPDVSQALAWLENHPQALKGIQRGLERETLRVNADGSLATTGHPKALGSALTHKWITTDFAEALLEFITPVDGDIDHMLTIMRDVHRFTARNLGDERMWPLSMPCYIEQGQDIELAQYGTSNIGRLKTLYREGLKNRYGALMQTISGVHYNFSLPMAFWQAKCGETDKEAISAGYFRLIRNYYRFGWVIPYLFGASPAICSSFLQGKPTTLPFEKTECGMYYLPYATSLRLSDLGYTNKSQSNLGITFNDLHEYVAGLKRAIKTPSEEYEKIGLEKDGKRLQINTNVLQIENELYAPIRPKRVTRSGETPSDALQRGGIEYIEVRSLDINPFSPIGVDEQQVRFLDLFMVWCVLADAPEMSSDELLCTRANWNRVILEGRKPGLTLGIGCETAQFPLSKVGKDLFHDLKRVAQTLDSVYGGEAYQKVCDELVESFDNPELTFSARILRSMIEQGIGGTGRSLSAEYREMLMQEPLEILSEADFVAERDASVVRQKEVEAADTESFEAFLAKQA

SEQ ID NO: 7616 - protein, 118 aa, Enterobacter cloacae
PTEKRCGETGLIVPACFTLKPPHQEASAMATPRLTQKDMTEAEQRELKTLLDRARIAHGRTLTNAETNQVKKEYIDKLMAQREAAAKKARKLKKEQAYKPDAEATFSWSANTSTRGRR

SEQ ID NO: 7617 - protein, 453 aa, Enterobacter cloacae
HEVVMTSFVVAKFGGTSVADYDAMNRSADVVLADPNTRLVVLSASAGVTNLLVSLSEGLEATERFVKLDALRKIQFDILERLQNPNVIREEVERLLENITTLAEAASLATSTALTDELVSHGELMSTLLFVEIMRERNIQAQWFDVRKVMRTSDRFGRAEPDVEVLAELTNQQLAPRLDEGIVITQGFIGSEAKGRTTTLGRGGSDYTAALLGEALHATRVDIWTDVPGIYTTDPRVVSAAKRIDVIAFEEAAEMATFGAKVLHPATLLPAVRSDIPVFVGSSKDPKAGGTLVCKKTENPPLFRALALRRKQTLVTLHSHNMLHSRGFLAEVFGILARHNISVDLITTSEVSIALTLDTTGSTSTGDTLLTQSLLIELSELCRVEVEEDLALVAIIGNKLSRACGVGKEVFGVLDPFNIRMICYGASSYNLCFLVPADQAEQVVQKLHQNLFE

SEQ ID NO: 7618 - protein, 339 aa, Enterobacter cloacae
TISISRAQTRLFYNKTTRQYCKEFTMLSAITRLFPLWALLLSVLAYYTPATFTGIGPWVTTLLMLIMFGMGVHLKIDDFKRVLSRPAPVAAGIFLHYLVMPLAAWLLAMAFKMPPDLSAGMVLVGSVASGTASNVMIYLAKGDVALSVTISSVSTLVGVIATPLLTRLYVDAHIQVDVMGMLLSILQIVVIPIALGLVIHHLFPRVVKAVEPYLPAFSMICILAIISAVVAGSASHIASVGFVVIVAVVLHNTIGLLGGYWGGKLFGFDESTCRTLAIEVGMQNSGLAAALGKIYFSPLAALPGALFSVWHNLSGSLLAGYWSGKPIDDQPKKDAVKQG

SEQ ID NO: 7619 - protein, 310 aa, Enterobacter cloacae
HETCSLSLLRSVRKAVAKPPNKTKMISTIQKKEFVMVTTVPAKRGRKPAATTAAQPGGQVQSLTRGLKLLEWIAESHGSVALTELAQQAGLPNSTTHRLLTTMQQLGFVRQVGELGHWAVGAHAFIVGSSFLQSRNLLAIVHPILRKLMEESGETVNLAVLDQSDHQAIIIDQVQCTQLMRMSAPIGGKLPMHASGAGKAFLSQLSEEQVTGLLHRKGLHAYTHATLVSPVHLKEDLALTRKRGYSFDDEEHALGLRCLASCIFDEHREPFAAISISGPISRMTDDRVTELGAMVIKAAKEVTLAYGGIR

SEQ ID NO: 7620 - protein, 105 aa, Enterobacter cloacae
ITGSNMKEIVQTESFRRWEQNLKDRRAKTIIASRLFRLANGLAGDIRPVGEGISELRIHFGPGYRVYFKDQGNCIIVLLCGGDKSSQARDILMAKMLSNVSQWQE

SEQ ID NO: 7621 - protein, 97 aa, Enterobacter cloacae
MSMHKLTPYDPANALVDDEEIAVFMADALETGDSAYIAKALGVIARAKGMSTISQQTGLSREQLYRSFSDKGNPTLKTTLAVMKALGLGLTIKPSGD

SEQ ID NO: 7622 - protein, 313 aa, Enterobacter cloacae
GFKVMPIRVQDELPAVNFLREENVFVMTTSRASGQEIRPLKVLILNLMPKKIETENQFLRLLSNSPLQVDIQLLRIDARESRNTPAEHLNNFYCNFEDIRDENFDGLIVTGAPLGLVEFNDVAYWPQIRQVLEWAKDHVTSTLFVCWAVQAALNILYGIPKQTRSDKLSGVYEHHILHPHALLTRGFDDTFLAPHSRYADFPAQLIRDYTDLEILAETEDGDAYLFASKDKRIAFVTGHPEYDPHTLAAEYFRDVEAGLNPDVPYNYFPKNDPQNTPRATWRSHGNLLFTNWLNYYVYQITPYDLRHMNPTLE

SEQ ID NO: 7623 - protein, 454 aa, Enterobacter cloacae
PCRATASWRNSPHNNMEHLHMKTRTQQIEELQKEWTQPRWEGIRRPYSAEEVVKLRGSVNPECTLAQNGAAKMWDLLHGGAKKGYINSLGALTGGQALQQAKAGIEAIYLSGWQVAADANLASSMYPDQSLYPANSVPSVVDRINNTFRRADQIQWAAGIEPHDPRFIDYFLPIVADAEAGFGGVLNAFELMKSMIEAGAAAVHFEDQLASVKKCGHMGGKVLVPTQEAIQKLVAARLAADVLGVPTLVIARTDADAADLITSDCDPYDSEFITGERTSEGFYRTHAGIEQAISRGLAYAPYADLVWCETSTPDLALAKRFADAIHAKYPGKLLAYNCSPSFNWQKNLDDTTIASFQQQLSDMGYKYQFITLAGIHSMWFNMFDLAHAYAQGEGMKHYVEKVQQPEFAAGKEGYTFVSHQQEVGTGYFDNVTTIIQGGASSVTALTGSTEEAQF

SEQ ID NO: 7624 - protein, 600 aa, Enterobacter cloacae
SFPPLPPRGEGWGEGEYMSRGLELLIAQTILQGFDAQYGRFLEVTSGAQQRFEHADWHAVQQAMKQRIHLYDHHVGLVVEQLRCITDGKSPDADFLLRVKEHYTHLLPDYPRFEIAESFFNSVYCRLFDHRSLSPERLFIFSSQPERRFRTIPRPLAKDFFPDRGWEKLLHRVLTDLPLRLPWENKPRDIGYIHAYLSETFGEEVLSRSHLQVANELFYRNKAAWLVGKLVTPTAIVPFLLPIHRTDDGELFVDTCLTTSAEASIVFGFARSYFMVYAPLPAALVEWLREILPGKTTAELYMAIGCQKHAKTESYREYLRYVTTADEQFIEAPGIRGMVMLVFTLPGFDRVFKVIKDKFAPQKEMSAAHVRACYQLVKEHDRVGRMADTQEFENFVLDKQQIDPSLVSLLMQEAPTKITDLGDKIAISHLYIERRMVPLNIWLEQSEGQALRDAIEEYGNAIRQLAAANIFPGDMLFKNFGVTRHGRVVFYDYDEICYMTEVNFRDIPPPRYPEDELSSEPWYSVSPGDVFPEEFRHWLCADPRIGPLFEEMHADLFRASYWRGLQTRIKNGHVEDVYAYRRKQRFCIRFSPSPCGRGPG

SEQ ID NO: 7625 - protein, 1233 aa, Enterobacter cloacae
ALSGASVSSKVEQLRAQLNERILVLDGGMGTMIQGYRLCEDDFRGERFADWPCDLKGNNDLLVLSKPSVIRDIHNAYFEAGADIVETNTFNSTTIAMADYQMESLSAEINFEAAKLARACADEWTARTPDKPRYVAGVLGPTNRTASISPDVNDPAFRNITFDQLVAAYRESTKALVEGGSDLILIETVFDTLNAKAAIYAVKEEFESLGVDLPIMISGTITDASGRTLSGQTTEAFYNSLRHAEALSFGLNCALGPDELRQYVQELSRIAECYVTAHPNAGLPNAFGEYDLDADTMAAQIREWAESGFLNIVGGCCGTTPEHIAAMSNAVAGLPPRKLPELPVACRLSGLEPLTIGDDSLFVNVGERTNVTGSAKFKRLIKEEKYSEALDVARQQVESGAQIIDINMDEGMLDAEAAMVRFLNLIAGEPDIARVPIMIDSSKWDVIEKGLKCIQGKGIVNSISMKEGVDTFIHHAKLVRRYGAAVVVMAFDEVGQADTRERKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDATERMLDLAEKYRGSKSDESANVQQAEWRSWDVNKRLEYSLVKGITEFIEQDTEEARQQAARPIEVIEGPLMDGMNVVGDLFGEGKMFLPQVVKSARVMKQAVAYLEPFIEASKEKGSSNGKMVIATVKGDVHDIGKNIVGVVLQCNNYEIIDLGVMVPADKILRTAREVNADLIGLSGLITPSLDEMVNVAKEMERQGFTIPLLIGGATTSKAHTAVKIEQNYSGPTVYVQNASRTVGVVSALLSDTQRDDFVARTRKEYETVRIQHGRKKPRTPPVSLQAARENDLAFDWSSYTPPVAHRLGVQDVTASIETLRNYIDWTPFFMTWSLAGKYPRILEDEVVGEEAKRLFKDANDMLDRLSAEKALNPRGVVGLFPANRVGDDVEIYRDETRTHVLAVSHHLRQQTEKVGFANYCLADFVAPKLSGKADYIGAFAVTGGLEEDALADAYDAQHDDYNKIMVKAIADRLAEAFAEYLHERVRKVHWGYAANENLSNEELIRENYQGIRPAPGYPACPEHTEKGTIWKLLDVEAHTGMKLTESFAMWPGASVSGWYFSHPDSKYFAVAQLQRDQIEDYALRKGMSVSEVERWLAPNLGYDAD

SEQ ID NO: 7626 - protein, 317 aa, Enterobacter cloacae
KTRLSNRRLIFFSSPNLRYISPFTGETMLPTQSTRLNKYISESGICSRREADRYIEQGNVFLNGKRATIGDQVVPGDVVKVNGQVIEPRDAEDLVFIALNKPVGIVSTTEDGERDNIVDFVNHSSRIFPIGRLDKDSQGLIFLTNHGDLVNKILRAGNDHEKEYIVTVNKPVTDEFIRGMGAGVPILGTVTKKCKVRKEAPFAFRITLVQGLNRQIRRMCEYFGYEVTKLERTRIMNVSLSGIPLGEWRDLTDDELIELFKLIENSSSEAKPKAKAKPKTQTIKRPVVKAPQAEEKGRGKPGNGKRFTQPGRKKKGR

SEQ ID NO: 7627 - protein, 74 aa, Enterobacter cloacae
KSITPICYPTTRASRLRRAFSTPSIAGYLTTAHYLLSGYLSSAPSRSAASVPFRVRWRKISFPIAAGKSSCTVS

SEQ ID NO: 7628 - protein, 542 aa, Enterobacter cloacae
FGSLMRSRTMTQQATTVDELTFTQPNGEQEQQVLTAEAVEFLTELVTRFTPQRNKLLAARIHQQQGIDNGKLPGFISETASIRHGDWKIRGIPEDLQDRRVEITGPVERKMVINAMNANVKVFMADFEDSLAPDWQKVIDGQINLRDAVNGTISYTNEAGKIYQLKPNPAVLICRVRGLHLPEKHVTWRGEAIPGSLFDFALYFFHNHKNLLAKGSGPYFYLPKTQSWQEAAWWSEVFSYAEDRFSLPRGTIKATLLIETLPAVFQMHEILHALRDHIVGLNCGRWDYIFSYIKTLKNHADRVLPDRQVVTMDKPFLSAYSRLLIKTCHKRGAFAMGGMAAFIPSKDAERNNHVLNKVKADKELEARNGHDGTWIAHPGLADTAMEVFNRVLGDNKNQLFVTREDDAPIAEEQLLAPCAGERTEEGMRANIRVAVQYIEAWISGNGCVPIYGLMEDAATAEISRTSIWQWIHHQKTLSNGKPVTKALFRQMLAEEMRVIQDELGEHRFSSGRFDDAARLMEQITTSDDLIDFLTLPGYRFLA

SEQ ID NO: 7629 - protein, 548 aa, Enterobacter cloacae
GGMPTVLTLLHLLSAVALLVWGTHIVRTGVMRVFGARLRTVLSGSVEKKPLAFCAGIGVTALVQSSNATTMLVTSFVAQDLVALAPALVIVLGADVGTALMARILTFDLSWLSPLLIFIGVIFFLGRKQSRAGQLGRVGIGLGLILLALELIVQAVTPITQANGVQVIFASLTGDIMLDALIGAVFAIVSYSSLAAVLLTATLTAAGVISFPVALCLVIGANLGSGLLAMLNNSAANAAARRVALGSLLFKLVGSLIILPFVHPLANLMDNLSLPKAELVIYFHVFYNLVRCLAMVPFAAPMARFCERLIRDEPELDARLKPKHLDTSVLDTPALAIANAARETLRMGDAMETMLEGLQKVMHGEPREEKELRRLADDINVLYTAIKLYLARIPQDELAEEESRRWAEIIEMSLNLEQASDIVERMGSEIADKSLAARRAFSVEGLKELEALHEQLVSNLKLAMSVFFSSDVPSARRLRRNKHRFRILNRRYSHAHVERLHQQNVQSIETSSLHLGLLGDMKRLNSLFCAVAYSVMEQPDEDDERDEY

SEQ ID NO: 7630 - protein, 143 aa, Enterobacter cloacae
APFLSGEFIMAKEFGRPQRVAQEMQKEIALILQREIKDPRVGMMTTVSGVEMSRDLAYAKVFVTFLNDQDEDAVKNGIKALQEASGFIRSLLGKAMRLRIVPELTFFYDNSLVEGMRMSNLVTSVVKHDDERRVNPADDSKED

SEQ ID NO: 7631 - protein, 174 aa, Enterobacter cloacae
RKVTKGNSSVWAKWTAKGVWRRVVWSSNIRSKRDGDNALPCDKQGRRVEYRRLTPGKLFNNLRGVHGIAELEIGILTFFILWSLKMSLSVEAKAKIVSEFGRGTNDSGSTEVQVALLTAQINHLQGHFAEHKKDHHSRRGLLRMVSQRRKLLDYLKRKDVARYTALIERLGLRR

SEQ ID NO: 7632 - protein, 184 aa, Enterobacter cloacae
QDYSYQGVKLVLDKLRSRLVQFGPSMLSVPVKLAPFALKRQVLEQVLSWQFRQALQDGELEFLEGRWLKIEVRDIGLRWFTSVENDRLIVRETAEADVSFSADASDLLMIAARKQDPDTLFFQRRLVIEGDTELGLYVKNLMDAIELEQMPKALRMMLMQMADFVEAGLKTPPDSKHTSVGEPC

SEQ ID NO: 7633 - protein, 163 aa, Enterobacter cloacae
LGFTPFFYVLGVGLSTLEQKLTEMITAPVEALGYELVGIEFVRGRTSTLRIYIDSEDGINVDDCADVSHQVSAVLDVEDPITVAYNLEVSSPGLDRPMFTAEHYVRFTGEEVALVLRMAVQNRRKWQGIIKAVDGEMITVTVEGKDEVFALSNIQKANLVPHF

SEQ ID NO: 7634 - protein, 336 aa, Enterobacter cloacae
TARRVRLPFALRAGGGLIIRQDALLSRRGTGRSSNSCLREWEMKPFLRWCFVATALTLAGCSNSAWRKSEVLAVPLQPTLQQEVILARMEQILASRALTDDERAQLLYERGVLYDSLGLRALARNDFSQALAIRPDMPEVFNYLGIYLTQAGNFDAAYEAFDSVLELDPTYNYAHLNRGIALYYGGRDKLAQDDLLAFYQDDPNDPFRSLWLYIVEQKLDEKQAKEALKQRFEKSDKEQWGWNIVEFYLGNISEATLMERLKADATDNTSLAEHLSETNFYLGKYYLSLGDMDSATALFKLAVANNVHNFVEHRYALLELSLLGQEQDDLAESDQQ

SEQ ID NO: 7635 - protein, 644 aa, Enterobacter cloacae
VDWPPLISRHLYYMAEFETTFADLGLKAPILEALNDLGYEKPSPIQAECIPHLLSGRDVLGMAQTGSGKTAAFSLPLLNNIDPDLRAPQILVLAPTRELAVQVAEAMTEFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWSVYGMRKNEALVRFLEAEDFDAAIIFVRTKNATLEVAEALERSGYNSAALNGDMNQALREQTLERLKDGRLDILIATDVAARGLDVERISLVVNYDIPMDSESYIHRIGRTGRAGRAGRALLFVENRERRLLRNIERSMKLTIPEAELPNAKLLGKRRLEKFAARVQQQLESIDLDQYRALLSQIQPVAEGEELDMETLAAALLKMAQGERSLIVPPDAPMRPKREFRDRDDRFERRGDRNDRGPRGDRPERGGEDRPRRERRDAGEMELYRIEVGRDDGVEVRHIVGAIANEGDISSRYIGNIKLFGSHSTIELPKGMPGEVLQHFTRTRILNKPMNMQLLGDAQPRPDRGGERRGGGRGFGGERREGGRSEGRGGEGRRFSGERRENRGPRREEGASRRRFGDA

SEQ ID NO: 7636 - protein, 240 aa, Enterobacter cloacae
ILTGNRLLSVVEQAQNANGQFCKGDKMSQVLITGATGLVGGHLLRLLIQDRHINYIAAPTRRPLLDITGVYNPHDPQLTDALAQVQDPIDIAFCCLGTTRREAGSKEAFVHADYTLVVDTALTAKKLGAKHFLVVSAHGANAGSPFFYNQVKGKMEEALIAQKWERLTIARPSMLMGHRDERRFNESFFAPLFRILPGNWKSIEARDVALAMLKEALAPSQEGVNIIPSAKLREIAQGEA

SEQ ID NO: 7637 - protein, 505 aa, Enterobacter cloacae
GEKPAMNKEILAVVEAVSNEKSLPREKIFEALESALATATKKKYEQEIDVRVEIDRKSGDFDTFRRWVIVEEVTQPTKEITLEAARFEDESLNVGDYVEDQIESVTFDRITTQTAKQVIVQKVREAERALVVDQFRDQEGEIITGVVKKVNRDNISLEIKSEGLPGNAEAVILREDMLPRENFRPGDRIRGVLYAVRPEARGAQLFVTRSKPEMLVELFRIEVPEIGEEVIEIKAAARDPGSRAKIAVKTNDKRIDPVGACVGMRGARVQAVSTELGGERIDIVLWDDNPAQFVINAMAPADVASIVVDEDKHTMDIAVEAGNLAQAIGRNGQNVRLASQLSGWELNVMTVDDLQAKHQAEAHAAIDTFTKYLDIDEDFATVLVEEGFSTLEELAYVPMKELLEIDGLDEPTVEALRERAKNALTTLALAQEESLGDKKPADDLLNLEGLDRAIAFKLAARGVCTLEDLAEQGVDDLADIEGLTDEKAGELIMAARNICWFGDEA

SEQ ID NO: 7638 - protein, 902 aa, Enterobacter cloacae
TVAGRNSMTDVTVKSLAAEIQTSVDRLVQQFADAGIPKSADDSVTAQEKQTLLAHLNREHGSTPDKLTLQRKTRSTLNIPGTGGKSKSVQIEVRKTRTFVKRDPQEAERLAAEEQAQREAEEQAQREAEATAKREAELKAEREAAEKAKRDAGEKAKRDAAEKDKVSNQQTDEMTKTAQAEKARRENEAAELKRKAEEEARRKLEEEARRVAEEARRMAEENEKNGVNTAEPTEDTSDYHVTTSQHARQAEDDNDREVEGGRGRTRSAKAARPAKKGNKHAESKADREEARAAVRGGKGGKRKGSALQQGFQKPAQAVNRDVVIGETITVGELANKMAVKGSQVIKAMMKLGAMATINQVIDQETAQLVAEEMGHKVILRRENELEEAVMSDRDTGAAAEPRAPVVTIMGHVDHGKTSLLDYIRSTKVASGEAGGITQHIGAYHVETENGMITFLDTPGHAAFTSMRARGAQATDIVVLVVAADDGVMPQTIEAIQHAKAAQVPLVVAVNKIDKPEADMDRVKNELSQYGVMPEEWGGEAQFIPVSAKAGTGIDDLLNAILLQAEVLELKAVRKGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKLENMFANMTEGEVHEVNVVLKADVQGSVEAISDSLLKLSTDEVKVKIIGSGVGGITETDATLAAASNAILVGFNVRADASARKVIDAESLDLRYYSVIYNLIDEVKAAMSGMLSPELKQQIIGLAEVRDVFKSPKFGAIAGCMVTEGTIKRHNPIRVLRDNVVIYEGELESLRRFKDDVNEVRNGMECGIGVKNYNDVRVGDMIEVFEIIEIQRTIA

SEQ ID NO: 7639 - protein, 325 aa, Enterobacter cloacae
PGGRQQGGLMSRPRRRGRDVHGVLLLDKPQGASSNDVLQKVKRIYNANRAGHTGALDPLATGMLPICLGEATKFSQYLLDSDKRYRVIAKLGQRTDTSDADGQVVEERPVTFSAEQLDAALDSFRGDTLQVPSMYSALKYQGKKLYEYARQGIEVPREARPITVYELLFIRHEGDELELEVHCSKGTYIRTIIDDLGEKLGCGAHVIYLRRLAVSKYPVERMVTLEHLHALIEQAQAQGVAPADLLDPLLMPMDSPAVDFPVVNLPLTSSVYFKNGNPVRTTGAPLEGLVRVTEGDEGKFIGMGEMDGEGRVAPRRLVVEYPVEA

SEQ ID NO: 7640 - protein, 739 aa, Enterobacter cloacae
SRGCEEGRVKSSAHLRCAFKHLRKDRTLLNPIVRKFQYGQHTVTLETGMMARQATAAVMVSMDDTAVFVTVVGQKKAKPGQDFFPLTVNYQERTYAAGKIPGGFFRREGRPSEGETLIARLIDRPVRPLFPEGFVNEVQVIATVVSVNPQVNPDIVAMIGASAALSLSGIPFNGPIGAARVGYINDQYVLNPTQEELKESKLDLVVAGTEAAVLMVESEAELLSEDQMLGAVVFGHDQQQVVIQNINDLVKEAGKPRWDWQPEAANDALNARVAALAESRLSDAYRITDKQERYAQVDVIKSEVTATLVAEDETLDANEIGEILHAIEKNVVRSRVLAGEPRIDGREKDMIRGLDVRTGVLPRTHGSALFTRGETQALVTATLGTARDAQIIDELMGERTDSFLFHYNFPPYSVGETGMVGSPKRREIGHGRLAKRGVLAVMPEADKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKINPDKIKDVIGKGGSVIRALTEETGTTIEIEDDGTVKIAATDGEKAKYAIRRIEEITAEIEVGRIYNGKVTRIVDFGAFVAIGGGKEGLVHISQIADKRVEKVTDYLQMGQEVPVKVLEVDRQGRIRLSIKEATEQSQPAAAPEAPAAEQQGE

SEQ ID NO: 7641 - protein, 416 aa, Enterobacter cloacae
  UNSURE (387)
GRMATLTTTQTSPSLLGGVVIIGGTIIGAGMFSLPVVMSGAWFFWSLAALVFTWFCMLHSGLMILEANLNYRIGSSFDTLTRDLLGKGWNLVNGLSIAFVLYILTYAYISASGSILHHTFSEMSLNVPARLAGLCFALGVAFIVWMSTKAVSRMTAIVLGAKVITFFLTFGSLLGHVTPATLFNVAETNTSYTPYLLMTLPFCLASFGYHGNVPSLMKYYGKDPRTIVKCLVYGTLLALALYVIWLLGTMGNIPRPEFIGIAQKGGNIDVLVQALGGVLNSHSLDLLLVVFSNFAVASSFLGVTLGLFDYLADLFGFDDSATGRFKTALLTFLPPIVGGLLWPNGFLYAIGYAGLAATIWAAIVPALLARKSRKRFGSPKFRVWGGXPMIALILVFGIGNAVVHVLSSFNLLPVYQ

SEQ ID NO: 7642 - protein, 168 aa, Enterobacter cloacae
TMLIRVEIGIDAPGIDALLRRSFAGDAEAQLVHDLREDGLITLGLVATDDEGQVVGYVAFSPVIVQGEELQWVGMAPLAVDENYRGQGLARQLVYEGLDSLNEFGYAAVVVLGDPAFYERLGFEPASRYDLRCHWPGTETSFQVHPLADDALDGVTGLVEYHDHFNRF

SEQ ID NO: 7643 - protein, 148 aa, Enterobacter cloacae
ERAKMETLAAINRWLAKQHVVTWCVCKDEEMWCANAFYYYDPERVAFYVMSEDKTRHAQMTGQQAKVAGTVNGQPKTVALIRGVQFKGEIRRLEGEESDAQRKRYTRRFPVAAALKAPVWEIRLDELKFTDNTLGFGKKLHWLRAEQA

SEQ ID NO: 7644 - protein, 245 aa, Enterobacter cloacae
HLPGNGMTGQSSSQAATPVQWWKPALFFLVVIIGLWYVKWQPYYGKAFTAADTHSIGKSILAQADSSPLRAAWDYAMVYFLAVWKAAVLGVLLGSLIQVLIPRNWLVKTLGQPRLQGTLLGTIFSLPGMMCSCCAAPVAAGMRRQRVSMGGALAFWMGNPLLNPATLVFMGFVLGWHFAFIRLAAGLLTVVLVATLVQHLVKDNEAGSASVELDVSEPQGSFFARWGKALWQLFLEHHSGLYPGF

SEQ ID NO: 7645 - protein, 120 aa, Enterobacter cloacae
WRPVFPFSLSLMLWCVHLNILNLFTVCWFLYLVRTADNALYTGITTDVARRFLQHQTGKGAKALRGKGELQLAFSAAVGDRSLALRLEYRIKQLTKRQKERLVNGDGSFEALLESLLKND

SEQ ID NO: 7646 - protein, 345 aa, Enterobacter cloacae
ARWQRCGVRPSTAAWRTRKTTLRRRHGWRRSARCPKAPKPRSARITVNGSEIIMKYSLGPVLYYWPKETLEDFYQQAANSSADVIYLGEAVCSKRRATKVGDWLDMAKSLAGSGKQVVLSTLALVQASSELGELKRYVENGEFLLEASDLGVVNMCAERKLPFVAGHALNCYNAVTLRLLLKQGMTRWCMPVELSRDWLANLLTQCEELGIRNKFEVEVLSYGHLPLAYSARCFTARSEDRPKDECETCCIKYPNGRSMLSQENQQVFVLNGIQTMSGYVYNLGNELASMHGLVDMVRLSPLDTGVFAMLDAFRANENGAAPLPLTANSDCNGYWRRLAGLELQA

SEQ ID NO: 7647 - protein, 337 aa, Enterobacter cloacae
AVMTDKTIPFSVLDLAPIPQGSSAREAFTHSLDLAQLAEKRGYHRYWLAEHHNMVGIASAATSVLIGYLAANTTTLHLGSGGVMLPNHAPLVIAEQFGTLNTLYPGRIDLGLGRAPGSDQPTMRALRRHMSGDIDNFPRDVAELVGWFDARDPNPHVRPVPGYGEKIPVWLLGSSLYSAQLAAQLGLPFAFASHFAPDMLHQALHLYRTHFKPSERLEKPYAMVCINIIAADSNRDAEFLFTSMQQAFVKLRRGETGQLPPPVENMHQLWSASEQYGVQQALSMSLVGDKAKVRHGLESVLRETQADEIMVNGQIFDHQARLHSFDLAMQVKEELVG

SEQ ID NO: 7648 - protein, 151 aa, Enterobacter cloacae
TGMVLQKKLPQRFAPASKETALRLADVQLNGSRSGLVVFHQVLHQRSDKHHRQQASRQTDKREMPAENEAHKHQRCRVQQWVTHPEGKRAAHRHALSAHTRRHRCGAAGTHHARQGENRPQQRALQARLSQGFHQPVTRDKYLNQRAQQYA

SEQ ID NO: 7649 - protein, 179 aa, Enterobacter cloacae
SENNGGSMGKKIAVLITDEFEDSEFTSPAEAFRKAGHEVVTIEKEAGKTVKGHKGEASVTIDESIDNVSPSDFDALLLPGGHSPDSLRGDERFVTFTRDFVGTGKPVFAICHGPQLLISAEVVRGRKLTAVKSIVIDLKNAGAEFYDQEVVNDNDQLITSRTPDDLPAFNREALRLLGA

SEQ ID NO: 7650 - protein, 374 aa, Enterobacter cloacae
AAGPRKGLPRSQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEFLNSSVKIVNPIMGVKFWDENVKIPAEEVTVRFERGHPVALNGKTFSDDVELMLEANRIGGRHGLGMSDQIENRIIEAKSRGIYEAPGMALLHIAYERLLTGIHNEDTIEQYHAHDRQLGKLLYQGRWFDPQALMLRDAMQRWVASAITGEVTLELRRGNEYSILNTVSDNLTYKAERLTMEKGESVFSPDDRIGQLTMRNLDITDTREKLFNYVENGLLSANSGNGLPQVENLEHSDKK

SEQ ID NO: 7651 - protein, 332 aa, Enterobacter cloacae
IMELLCPAGNLPALKAAIENGADAVYIGLKDDTNARHFAGLNFTEKKLQEAVNFVHQHRRKLHIAINTFAHPDGYARWQRAVDMAAQLGADALILADLAMLEYAAERYPHIERHVSVQASATNEEAVRFYHRHFDVARVVLPRVLSIHQVKQLARVTPVPLEVFAFGSLCIMAEGRCYLSSYLTGESPNTVGACSPARFVRWQQTPQGLESRLNDVLIDRYQDGENAGYPTLCKGRYLVDGERYHALEEPTSLNTLELLPELLAANIASVKIEGRQRSPAYVSQVAKVWRQAIDRCMADPQNYAPQAAWMETLGAMSEGTQTTLGAYHRKWQ

SEQ ID NO: 7652 - protein, 106 aa, Enterobacter cloacae
SVNQAGFYYMTTILKHLPVGQRIGIAFSGGLDTSAALLWMRQKGAVPYAYTANLGQPDEEDYDAIPRRAMEYGAENARLIDCRKQLVPGRDCRDPSAVLSITLPAA

SEQ ID NO: 7653 - protein, 157 aa, Enterobacter cloacae
TVIAMAARKSIIFICICWVDVHWDRCWHIKVFNMLTGRIAALIVTLVMVGCSARPAIPVSEEQTLVMESSVLAAGITAEKPSLTISEIQSSASSTLYNERQEPVTVHYRFYWYDVRGLEMHPLEAPRSVTIPARSSVTLYGSASYLGAHKVRLYLYL

SEQ ID NO: 7654 - protein, 89 aa, Enterobacter cloacae
RYKIMKNVKTLIAAAVLSSLSFASFAAVEVQSTPADQQKVGTISATAGTNLGSLEDQLAQKADEMGAKSFRITSVTGPNTLHGTAVIYK

SEQ ID NO: 7655 - protein, 422 aa, Enterobacter cloacae
TDADGSGVMASPLSLLIGLRFSRGRRRSGMVSLISVISTIGIALGVAVLIVGLSAMNGFERELNNRILAVVPHGEIEPVNQPWSNWQDSLNKVEKVPGIAAAAPYINFTGLVESGVNLRAIQVKGVNPRQEERLSALPRYVQNGAWANFKAGEQQIIMGKGVADALKVKQGDWVSIMIPNASADHKLQQPKRVRLHVTGILQLSGQLDHSFAMVPLEDARQYLDMSDSVTGIAIKVNDVFNANKLVRDAGSVTNNYVYIKSWIGTYGYMYRDIQMIRAIMYLAMVLVIGVACFNIVSTLVMAVKDKSGDIAVLRTLGAKDGLIRAIFVWYGLLAGLFGSLCGVAIGVVVSLQLTPIINGIEALIGHQFLSGDIYFIDFLPSELHWLDVIYVLVTALLLSLLASWYPARRASRIDPARVLSGQ

SEQ ID NO: 7656 - protein, 321 aa, Enterobacter cloacae
FRHGLAVFWPLNQTEECIMYYGFDIGGTKIALGVFDKDLKLQWETRVPTPRESYDEFLTAIAALVAQADERFGVKGSVGIGIPGMPETDDGTLYAANVPAASGKPLRADLSALLERDVRLDNDANCFALSEAWDDEFRRFPLVMGLILGTGVGGGIVINGKPITGRSYITGEFGHIRLPVDALEVVGRDFPLTRCGCGQHGCIENYLSGRGFAWLYEHFYHQKLEAPQIITLWEQGDAQAREHVERYLDLLAVCLGNILTIVDPDLLVIGGGLSNFTAITEQLSGRLTRHLLPVARVPRIERARHGDAGGMRGAAFLHLTD

SEQ ID NO: 7657 - protein, 216 aa, Enterobacter cloacae
TLIKTMSRYALLSAFALFLAGCVTRTEEPAPVDQAKPGTEQPTTPAQPVPTVPSVPTIPAQPGPIEHPDDTAQPAPRVRHYDWNGAMQPMVGKMLQAQGVTPGSVLLVDSVNNRTNGSLNAGEATETLRNALANNGKFTLVSAQQLAVAKQQLGLSPQDSLGSRSKAIGIARNVGAQYVLYSNATGNVNTPSLQMQLMLVQTGEIIWSGKGAVTQQ

SEQ ID NO: 7658 - protein, 355 aa, Enterobacter cloacae
CLASVTNERIREVGVGPVMLDVEGFELDAEEREILAHPLVGGLILFTRNYHDPEQLRELVRQIRAASRNHLVVAVDQEGGRVQRFREGFTRLPAAQSFAALLGIEEGGQLAQDAGWLMASEMIAMDIDISFAPVLDVGHISAAIGERSYHDDPRIALAMATRFIDGMHAAGMKTTGKHFPGHGAVTADSHKETPRDPRPEADIRAKDMSVFRSLIADNKLDAIMPAHVIYSEVDPRPASGSPHWLKTVLRQELGFNGVIFSDDLSMEGAAIMGSYAERGQASLDAGCDMILVCNNRKGAVSVLDNLSPINAERVTQLYHKGSFSRQELMDSARWKTVNARLEALNERWQAHKAAL

SEQ ID NO: 7659 - protein, 439 aa, Enterobacter cloacae
FEGVTLTTPLKKIVIVGGGAGGLELATQLGKKLGRGKKAKITLVDRNHSHLWKPLLHEVATGSLDEGVDALSYLAHARNHHFQFQLGSVVDINRENKTITLAELRDDKGELLVPERKLAYDTLVMALGSTSNDFNTPGVKEHCIFLDNPHQARRFHQEMLNLFLKYTNNMGANGKVNIAIVGGGATGVELSAELHNAVKQLHSYGYKGLTNEALNVTLVEAGERILPALPPRISGAAHNELTKLGVRVLTQTMVTSADEGGLHTKDGEYIQADLMVWAAGIKAPDFMKDIGGLETNRINQLVTEPTLQTTRDPDIFAIGDCASCARPEGGFVPPRAQAAHQMASLVLHNILAQIKGKPMKAYVYKDHGSLVSLSNFSTVGSLMGNLMRGSMMVEGRIARFVYISLYRMHQIALHGYFKTGLMMLVGRINRVIRPRLKLH

SEQ ID NO: 7660 - protein, 647 aa, Enterobacter cloacae
  UNSURE (355)
RIRLYTRGSAISKQTDFMYQPVALFIGLRYMRGRAADRFGRFVSWLSTIGITLGVMALVTVLSVMNGFERELQNNILGLMPQAVLSSTQGSVNPQQLPESAVKLQGVTRVAPLTTGDVVLQSARSVAVGVMLGIDPAQKDPLTPFLVNVKQTDLEAGKYNVILGEQLAGQLGVNRGDQLRVMVPSASQFTPMGRLPSQRLFNVIGTFAANSEVDGYQMLVNIQDASRLMRYPAGNITGWRLWLDAPLKVDTLSQQTLPEGTKWQDWRDRKGELFQAVRMEKNMMGLLLSLIVAVAAFNIITSLGLMVMEKQGEVAILQTQGLTPRQIMAVFMVHGASAGIIGALLGAALGALLAXQLNNLMPIIRALLDGAALPVAIEPLKWSVLRWPRWPMRCLLRFILPGGLPPLNPLRLYVMNKILLQCDNLSKRYQEGTVQTDVLHNVSFSVGEGEMMAIVGSSGSGKSTLLHLLGGLDTPTEGDVIFSGQPLSKMSSTAKAELRNRELGFIYQFHHLLPDFTALENVAMPLLIGKKKPAEINARASDMLKAVGLGHRGNHRPSELSGGERQRVAIARALVNNPRLVLADEPTGNLDARNADSIFQLLGELNAAQGTAFLVVTHDLQLAKRMGRQLEMRDGRLNAELTLMGAE

SEQ ID NO: 7661 - protein, 123 aa, Enterobacter cloacae
KEKVMAEETIFSKIIRREIPSDIVYQDELVTAFRDISPQAPTHILIIPNILIPTVNDVKTEHEVALGRMLTVAAKIAEQEGIAEDGYRLIMNCNRHGGQEVYHIHMHLLGGRPLGPMLAHKGL

SEQ ID NO: 7662 - protein, 287 aa, Enterobacter cloacae
CWFRPAKLSGQVKVPLRNNKRTRHDVLTRYFPQYHVIAPQAPAGLGGASCIIEHGDHRLVLRQHHDAAAPASHFRRQFRALKRLPADLAPQPHLFIRDWMAVAFIAGEIKSELPDTPALTAMLYHLHRQPRLGWRVTLLPLLDHYWQQAAPGRRTPYWLAQLKRLRKAGEPQALRLAPLHMDVHAGNIVHTTAGEKLIDWEYAGDGDVALELAAVWMPDEASRKQLITAYARNANINALTLARQVARWRPWVLMLMAGWFEMRLQQTGDKQFIALANDAWRQLQTKG

SEQ ID NO: 7663 - protein, 184 aa, Enterobacter cloacae
RGETMIIYLHGFDSNSPGNHEKVLQLQFIDPDVRLISYSTRHPKHDMQHLLKEVDKMLQLNIDDRPLICGVGLGGYWAERIGFLCDIRQVIFNPNLFPNENMEGKIDRPEEYADIATKCVSNFREKNRDRCLVILSRNDEALNSSRAAELLHHYYEIVWDEEQTHKFKNISPHLQRIKAFKTLG

SEQ ID NO: 7664 - protein, 203 aa, Enterobacter cloacae
SFILLAKRLLRCKIATNCNKGGSPVNKSMLAGIGIGVAAALGVAAVASLNVLDRGPQYAQVVSATPIKETVKTPRQECRNVSVTHRRPVQDENRIAGSVLGAVAGGVIGHQFGGGRGKDVATVVGALGGGYAGNQVQGAMQENDTYTTTQQRCKTVYDKSEKMLGYDVTYKIGDQQGKIRMDKDPGTQIPLDSNGQLILNNKV

SEQ ID NO: 7665 - protein, 299 aa, Enterobacter cloacae
ACATRGRRRHARSRIPSSHRLVYEVIMLSRRQGRLSRFRKNKRRLRERLRQRIFFRDRMMPEAMDKPRVVVLTGAGISAESGIQTFRAADGLWEEHRVEDVATPEGFARDPALVQAFYNARRRQLQQPEIAPNAAHLALAKLEEALGDRFLLVTQNIDNLHERAGNHNIIHMHGELLKVRCAWSGQVLEWKEDVLDEDRCHCCQFPSRLRPHVVWFGEMPLGMDEIYSALAMADVFIAIGTSGHVYPAAGFVHEARLQGAHTVELNLEPSQVGSEFEEKHYGLASEVVPAFVDKFLKGL

SEQ ID NO: 7666 - protein, 93 aa, Enterobacter cloacae
RNICVLLLNDNVVTKSEGDCMDKLLERFLHYVSLDTQSKPGVRQVPSTEGQWKLLNLLKEQLEAMGLVDVTLSEKATGLHARTGRIRAYVCAP

SEQ ID NO: 7667 - protein, 352 aa, Enterobacter cloacae
NKISGDTEMKKMLAAAALVLGMGAAHADDSKTLYFYNWTEYVPPGLLEQFTKETGIKVIYSTYESNETMYAKLKTYKDGAYDLVVPSTYFVDKMRKEGMIQKIDKTKLTNFSNLDPEMLNKPFDPNNDYSIPYIWGATAIGINSDAIDPKTVSSWADLWKPEYKSSLLLTDDAREVFQVALRKLGYSGNTTDPKEIEAAYNELKKLMPNVAAFNSDNPANPYMEGEVNLGMVWNGSAFVARQAGTPLEVVWPKEGGIFWMDSLAIPANAKNVEGALKLINFLLRPDVAKEVAETIGYPTPNLAARKLLSPEVANDKSLYPDAETISKGEWQNDVGDASRLYEEYYQKLKAGR

SEQ ID NO: 7668 - protein, 384 aa, Enterobacter cloacae
YRLLPITSGLHFTTIGVSFMATRSSRTMKQKALWINQIKGLCICLVVIYHSVITFYPHLDGLQHPLSGLLAKCWVYFNLYLAPFRMPVFFFISGYLIRRYIDEVNWRTSLDKRIWSIVWVLALWGVLQWQALTHLNAWLAPERELATASNAAYADSVSGFVLGMLTASTSLWYLYALVVYFTLCKLLSRWKLPMLGILALASIAINFLPLPWWGMNSVVRNMIYYSLGAWYGAQLMAWMKGMNLRRSWLVLLASGAVSVVLWFANVPLPLSLLSIVVIMKLFYSFEQRYAVHPNNLLNVIGSNTIAIYTTHRILIEAFSLLLIREMNAAYWPIWAELTLILVYPFISLLVCTLVGLGARKLSTALFGDLFFSPPARLSPQTATR

SEQ ID NO: 7669 - protein, 403 aa, Enterobacter cloacae
NVRPHYESPRWLHTNPASVCCLRRLYGTARKLNTQPRSLSPLVQLERIRKSFDGKDVISDLNLTINDGEFLTLLGPSGCGKTTVLRLIAGLESVDNGHIHLENQDITQVPAEDRHVNTVFQSYALFPHMTVFENVAFGLRMQKTPASEIPPRVTEALRMVQLEAFAQRKPHQLSGGQQQRVAIARAVVNKPRLLLLDESLSALDYKLRKQMQNELKALQRKLGITFVFVTHDQEEALTMSDRIVVMRDGKIEQDGTPREIYEEPKNLFVASFIGEINIFNATVIERLDEQRVRANVEGRECNITVNFAVEKGQRLNVLLRPEDLRVDEIHDTADVEGLIGYVRERNYKGMTLESVVELENGKMVMVSEFFNEDDPDFDHSLDQKMVINWVESWEVVLADEEHK

SEQ ID NO: 7670 - protein, 268 aa, Enterobacter cloacae
EGGAGMIGRLLPAGFMTAIYAYLYIPIIILIVNSFNSSRFGINWQGFTTKWYGLLMNNDSLLQAAQHSLTMAVFSATFATLIGSLTAVALYRYRFRGKPFVSGMLFVVMMSPDIVMAISLLVLFMLLGVQLGFWSLLFSHITFCLPFVVVTVYARLKGFDVRMLEAAKDLGASEMTILRKIILPLAMPAVAAGWLLSFTLSMDDVVVSSFVTGPSYEILPLKIYSMVKVGVSPEVNALATILLVLSLVLVIASQVIARDKTKSQGTQK

SEQ ID NO: 7671 - protein, 1170 aa, Enterobacter cloacae
RHCVSVICPNTVGISPRDSDIAMPEHYRFSLPVKAGDQRQLGELTGAACATLVAEIAERHPGPVVLVAPDMQNALRLHDEIRQFTDSLVFSLADWETLPYDSFSPHQEIISSRLSTLYQLPTMQRGVLIVPVNTLMQRVCPHSYLHGHALVMKKGQRLSRDALRVQLDGAGYRHVDQVMEHGEYATRGALLDLYPMGSDQPYRLDFFDDEIDSLRVFDADTQRTLEEVDSINLLPAHEFPTDKTAIELFRSQWRDRFDVKRDAEHIYQQVSKGTLPAGIEYWQPLFFNEPLPALFSYFPANTLIVNTGDIDASASRFESETRARFENRGVDPMRPLLPPEMLWLRTDELNAELKRWPRMQLKTDSLADKAANTNLAFRMLPDLAVQAQQKSPLDNLRKFLESFTGPVVFSVESEGRREALGELLGRIKVAPKRILRLSEATGNGRYLMIGAAEHGFIDTLNNLALICESDLLGERVARRRQDSRRTINPDTLIRNLAELHPGQPIVHLEHGVGRYQGMTTLEAGGIKGEYLMLTYANDAKLYVPVSSLHLISRYAGGAEENAPLHKLGGDAWARARQKAAEKVRDVAAELLDIYAQRAAKEGYAFKHDKEQYQLFCDSFPFETTPDQAQAINAVLSDMCQPLAMDRLVCGDVGFGKTEVAMRAAFLAVENNKQVAVLVPTTLLAQQHFDNFRDRFANWPVRIEMLSRFRSAKEQTQILEQASEGKIDILIGTHKLLQSDVKWKDLGLLIVDEEHRFGVRHKERIKAMRANVDILTLTATPIPRTLNMAMSGMRDLSIIATPPARRLAVKTFVREYDNLVVREAILREVLRGGQVYYLYNDVENIQKAADRLAELVPEARIAIGHGQMRERELERVMNDFHHQRFNVLVCTTIIETGIDIPTANTIIIERADHFGLAQLHQLRGRVGRSHHQAYAWLLTPHPKAMTTDAQKRLEAIASLEDLGAGFALATHDLEIRGAGELLGEDQSGSMETIGFSLYMELLENAVDALKAGREPSLEDLTSQQTEVELRMPSLLPDDFIPDVNTRLSFYKRIASAKSEGELEEIKVELIDRFGILPDAARNLLDIARLRQQAQKLGIRKLEGNEKGGVIEFAEKNHVDPMWLIGLLQKQPQHFRLDGPTRLKFTQDLTERKTRMDWVRNFMRQLEENAIA

SEQ ID NO: 7672 - protein, 339 aa, Enterobacter cloacae
LSLTPYKTITLSFVWIMIMMISSRFTRWLTLVALAATVAVALPARANTWPLPPAGSNVVGENRFHVVENDGGSLEAIAKKYNVGFLALLQANPGVDPYVPRAGSVLTIPLQTILPDAPRQGIVINLAELRLYYYPPGKNEVTVYPIGIGQLGGDTLTPTMVTTVSDKRANPTWTPTANIRARYKAQGIDLPAVVPAGPDNPMGHHAIRLAAYGGVYLLHGTNADFGIGMRVSSGCIRLRDDDIKTLYRVIAPGTKVNIINTPIKVSEEPGGVRLVEIHQPLSKNINDDPQTLPINLNASMVSFKTNANTDGAVMERAMEARSGMPTDVTRHHEVAQQSM

SEQ ID NO: 7673 - protein, 293 aa, Enterobacter cloacae
KAGRLYWLMKNTSKFQNVVIATIVGWLVLFVFLPNLMIIVTSFLTRDDANFVAMVFTLDNYARLLDPLYFDVLLHSLNMALIATLACLVLGYPFAWFLARLPQKVRPLLLFLLIVPFWTNSLIRIYGLKIFLSTKGYLNEFLLWLGVIETPIRIMFTPGAVIVGLVYILLPFMVMPLYSSIEKLNKPLLEAAKDLGASKLQTFVRIIIPLTMPGIIAGCLLVMLPAMGLFYVSDLMGGAKNLLIGNVIKSQFLNIRDWPFGSATSITLTVVMGLMLLVYWRASRLLNKKVELE

SEQ ID NO: 7674 - protein, 222 aa, Enterobacter cloacae
LFNKTTEDQRHMTTDVTRCAKKSRGRPKVFDRDAALDKAMTLFWQHGYEATSLSDLVEATGAKAPTLYAEFTNKEGLFRAVLDRYISRFAAKHEAQLFCEEKTVEQALQDYFTAIATCYTSKDTPAGCFMINTSATLAASSKEIANTVKSRHAMQEETLSTFLAQRQLRGEIPAHCRPQELAQYLSCILQGMSISAREGATLEKLQGITHTTLRLWPELLKL

SEQ ID NO: 7675 - protein, 281 aa, Enterobacter cloacae
HGGQSVQRLTKRIGRKMNIATASLSRQGTRASNQDQTGETIGERSACFVVCDGIAGLPGGEVAAELARNSIISRFDGDKHLNAQHIRDYVQTANRTILSEQQAVQDYRRMGTTLVSLFIDRDYRLAYWAHAGDSRLYLFRRGWLWHVTTDHSLVQQMKDAGHQTDDLNSNLLYLALGIENGGPEASYSDVVQVEDGDAFLLCTDGFWHGVSEEQMKQSLHMVNTPQEWLTLMNQIIQKNAEQEGNAQDNYTAVAVWMGNPQDTTLLHTLSDAAQFLPCGTD

SEQ ID NO: 7676 - protein, 913 aa, Enterobacter cloacae
RRAIRVQHLARPSASACSAWRSGVSRRAIILPYTESLLMETNMSEISRAVLFGKLDTLLFTSLESATAFCKLRGNPYVELVHWLHQLMQQQDGDLQQVIRHFALDEQQLTRDIVAALDALPRGASSVSDLSEHIDSAVERAWVYGSLKFGVSRIRGGHLLIGILKTWNLANVLKSISAQFTRLNVEVLVEQFDAICASSKESQQAAAAADAPAGAVPAAQGTLAQYGQDLTARAREGKIDPVVGRDEEIRQMVDILMRRRQNNPLLTGEAGVGKTAVVEGLALRIADGDVPEPLQNVQLWLLDIGMLQAGAGMKGEFEARLQALINEVQSSATPIILFIDEIHTLIGAGGQQGTGDAANLLKPALARGQLRTIGATTWAEYKKYIEKDPALTRRFQTVQVHEPDEAKAVLMLRSTVSPLETHHQVLLLDEAVSAAVKLSHRYIPARQLPDKAVALLDTACARVAVSQSAPPAQLEDCLRHLAALDVELEIAEREARVGAGDPARVATLTAERDAFETQREALARRWEEERTRVQEIIRLRAALFAAGDEDTAELRGQLAEQQQALKILQGDEPLLFAAVDENVVAAVVSDWTGIPLGRMVKNEIDAVLNLADTLNQRVIGQRHGLDLIARRVKTSRAKLDDPNKPVGVFMLCGPSGVGKTETALALAESLYGGEQNVITINMSEFQEAHTVSTLKGAPPGYVGYGEGGVLTEAVRRRPYSVVLLDEIEKAHPDVHEIFFQVFDKGWMEDGEGRHIDFRNTIIILTSNVGTELISAMCADPDLMPEPEALSGALRQPLLEVFPPALLGRLLVVPYYPLSDEMLGQIVRLQLRRIQRRLEENHNIISEFDDSVVEQIVQRCTEVESGGRMVDAILTNTLLPQMSQILLTASRSDQQYRRLHVTCEQGEFHCQFAA

SEQ ID NO: 7677 - protein, 478 aa, Enterobacter cloacae
KMTDNDNNRTVPNALPVGYRFNEFEIKEVIGGGGFGIVYRAWDHQLERTIAIKEFMPSSLAVRGEDMTLVLRSERFGKAFSAGLNSFIQEARLLARFNHPNLLHVLRFWVQNDTAYMGTLFYSGTTLSRLREEKPELINEAWIRRMLPMLFGAIKTIHDEGYLHRDISLDNIQIQDNGLPVLLDFGSARRTIGNLSDETETMLRPGFAPIEQYTDDNESEQGPWTDIYALGAVLRTLIVGSPPPVSVVRSIQDTCKPLVELMPQGYSIPLLQAIDKALALHMEDRPQSIEEFAALIEMPVAGIDEVLTAKKTGTMLVPVEEEASASALDWRRYKLPGLVAAGVLVGVVAGAMLFGGGSQETPEQTAQTPAVSPPAETSSQSETRPATADVSEPVAPPATAQQSAPPVDASPVALVYIRMLDGETLKVNGESKALRPGNNGYASLKLPAGETRIELEGNGRTRTQTLDIAKPGTWLVNP

SEQ ID NO: 7678 - protein, 262 aa, Enterobacter cloacae
GYFDNRESIVKKGLMAFVALCFLFMIQGCKQDMDLNPQDYFSGQQLELAKAIEEGDVDAVKTLAPDSDLNKPGKQDMTLLFWAIGNAINDKKTSPHLKVITLLVKAGADPLQPRPQGKSSPAEFALKGDSADWIDAMLDGGLSPNVKDKVFHEPIVFQSLKAKNTETLEAMLNRGADVNSTNSLGKTLVFDALDNQAYDHVLLLLDRGADPSIKAKNGWSMSNALADALNGLERGSEQYEKLNEIKEKLIQKGGEWPPAPVK

SEQ ID NO: 7679 - protein, 397 aa, Enterobacter cloacae
RVRRPITRTFTFKKPCVKNILSINHYGIKIMLNRITVQLPVEGLLFWKLSGREAMSESFALTLTLLGTDARIDRSRLLGQPVTVTIPTQSLLTPRFINGKVTRVAVSAVELTGTRYAVYQLTVEPDLWPMKRDRNLRIFQGQTVPQIVKTLLGEHQVNLEDKLTGSYRVWDYCVQYQESSLDFISRLMELEGIAYYFSHEADKHTLVLTDAAPQHQPFSGYEVIPYHQTPSGGSTDEEGISQWALEDSVTPGIYSLDDYDFRKPNAWLFQAQQYPASPKPGSIDVYDWPGRFVESAHTEIYASFPRELWQLEHQQIQASTWRRGVTPSSSIPAMCSMKMWRCLPVSWRARKKMPCLSVMRCLISARGKKCCAVRNQAGISTTASRPAIRLFSSQGAV

SEQ ID NO: 7680 - protein, 598 aa, Enterobacter cloacae
SYQQEYAMRFTIISTKPGHQPPQSSCDFYAPGGTIGRGTDNNLVLPDNDRTISRLQAIVHVDASGECRVTNRGSVTRVVLNDIPLERGRQVELQDGDILGIDDYRIEVSELIHDTQPVSRMAASMQQARPAATPAPAPQPKPASAAPRGKAEPTAVPSEIWDSLMQEFSISDSISSNRAKPQPAASHDPFSQPAAPERNAEDPLAMFNDAEPSLERKNVDPDTLFSDEALFKKESIFDDVTPSTLVQPDESKPAQPKEEASDELDPLALFGGSASAPAARHDDPLGLMGGAPLTHPDEIVADKPEPKPEAQAAQEEDALASSPLFDPEPTEPQDAPRAEEEPARPDYAGFTMPTPQAVARSNAQAPKGRLRIDPVKNAASPAASAQTGERGEVLQGELLEALLEGMGLSEMQPVPQFDRENMRQLGQILGMFSQGTVALLSSRSILKRGVKADMTMVLDDANNPFKLLPTGKTVLIQMFGTPMPGFMPPTKSVRDALIDLQAHQLGMISGIRAIIAAMLQSFNPEQLEEQAKQNGMTSRLALPGSRKAALWDYFVRSYGETAGEIEDDFHTLFGEAFLHAYDMEVNQYKDSQSGSEEK

SEQ ID NO: 7681 - protein, 150 aa, Enterobacter cloacae
LPQAERVAVPGPAVPGVTETGQHRRVRLAGALCGVGPYGNLRQLPSGALAIGASADSGINMAQGRYAIFLNSGDVFHENVALFARQLARQKEDAMFIGDALLDFGEGKKVLRGAKPGWYIYHSLPASHQAIFFPRRGLKFSMRRCRSIVF

SEQ ID NO: 7682 - protein, 387 aa, Enterobacter cloacae
TGGFSGSNSKPNAKSFTVTTYFFYFFPTSAVPRFHPARLICLCDGVCLPLDLFCDKGTFQDMKKILIIVPDGGMLFEAAGIADILMQANRLHPDGLAQPRYCIIIATTQPHLVIHGQSGLNLLADYRLPELDPREPLDTIIITGRGMNEQESTAVVDWLHLAAPHARRVASVCGGALLLAQAGLLDGRRATTHWRLLETLKTRYPAVNVEGGPLYIQDGPVWTSGGVSSGFDLTLALVEDDYGFTLARNVAQDMVMYLRRPGGQLQFSRYKLEQSGATGPVSELQSWILQNLTADLCVERLAERVAMSPRNFTRVFTRDVGVPPARYVTEARLAAARQLLEQTSYPLEVIAEKSGFGTSINLRRVFEKQLHLTPGEYRQRFHCRRMA

SEQ ID NO: 7683 - protein, 362 aa, Enterobacter cloacae
SDPFLSFTPSDLTPKVTPDNTDKECIMVKVGINGFGRIGRNVLRAALGNPDLQIVAINDLTDSRTLAHLLKYDSLLGTLPVPVEAADGALQVDGQRITVFSERDPANIAWKDAGVEVVIEATGFFTEREKAAVHITSGGAKRVIISAPAKNDDLTVVMGVNHTLYDPAQHFVVSNGSCTTNGLAPAAQVLHQQFGIEHGLMNTTHAYTNSQALHDQPEKDLRGARAAALSIVPYSSGAAKALGKVIPELDGKLTGYSLRVPVPVVSIVDLTVTLSRNVTAEEVNDAFRQAAISGPLKGILGYSDEPLVSRDYQGDPRSSIIDGLSTLVIGGNMVKILSWYDNEWGFSNRLVDLAVLMDKKGL

SEQ ID NO: 7684 - protein, 574 aa, Enterobacter cloacae
QQRSRCSVKTGDEPMIRPRARRPAFLPLALAGALLGVTAFGYAEDQPTSQQSSPDILLGPLFNDVQSAKLFPDQKTFADAVPKSDPLMILADYRMQHTQSGFDLRHFVEMNFILPKEGEKYVPPEGQSLREHIDDLWPVLTRTTDKANKWDSLLPLPKPYVVPGGRFREVYYWDSYFTMLGLAESGHWDKIGDMVDNFAYELDTWGHIPNGNRTYYLSRSQPPFFSLMVELLATHDSDALKKYRPQMEKEYAYWMEGADGLQPGQANKRVVKLDDGSILNRYWDDRDTPRPESWLDDVTTAKNNPNRPATEIYRDLRSAAASGWDFSSRWMDDPQKLGTIRTTSIVPVDLNALMFKMEKLLARASQEDGDTASASKYDALASARQKAMESHLWNDKEGWYADYDLKTRKVRNQLTAAALFPLYVKAASQDRADKVAAAASSRLLKPGGISTTTINSGQQWDAPNGWAPLQWVAVEGLQNYGQQKVAMDVTWRFLKNVQHTYDREKKLVEKYDVSSTGTGGGGGEYPLQDGFGWSNGVTLRMLDMVCPKEKPCDTVPENQPAANDDVAPAKQAAQ

SEQ ID NO: 7685 - protein, 574 aa, Enterobacter cloacae
TRSCVMPGAFPTEVRGSTSYMSEYKIRGFNVDQEFYNGLQLPYNVTGNTKARIDPLLIESVDILKGPSSVLYGGGSPGGLVNIQSKKPQKEAKTELGFNTGNRNLKEGYLDSTGQIANSDWNYRLLGKATESDEQAHTTRYENYLVAPSVTWQPDDKTRLTIDALAQNTPSLTPSDPMPLSYLRSKYADRRDYAGDEWSGFKQRQWMLGYSFEHEFDSGWGFNQKARYFDVDTHQRSAYSTGTGSEVYQLNRFAYTTDEDLQSFNIDNQVTRTVALGDWKHHLLAGFDYQKLNSHFHYRYASSTPGIDMRHPDHSQIDNDALGLETAQKNRLSYQQNGYYLQDQIAFGGLNVLASLRYDDYRSVTTNYLQNGDKAWVSQDRLTKRLGALYAFDNGLSPFISYSEGFAPVSPQGTLTAKDVKPTTSKQVEGGVKYLLAEYATTFTASVFNIRQKNVVTSDPGFLNYRQTGEVESKGAELSAMSRPTDNLTLIANYAYTHAINTEDDKYQGKGPTQVPENAFNLWGDYTFDSTPLKRGNAGGRRTLHRADGDLASQRRRQAGRYDAVRSGGILPHG

SEQ ID NO: 7686 - protein, 1221 aa, Enterobacter cloacae
QYPGRAERIAARKLRMLTTLLSILTNRILWSFLGVTALAAVIWMIGPLLSIVDTRPLESEQNRVISIAVVYLIWAQSHILPRLYNAWLNRKLMDKLNENTTSPEAADPQKRLNSEEQILAGRFDEAAQMLKKAHFSKAGHGAQWTQRFSTQYLYQLPWYVIIGAPGSGKTTALANSGLQFPLADRFGKTALRGIGGTRNCDWWFTNEAVLLDTAGRYTTQESEQVQDAGEWLEFINLLRKYRRRQPINGVIITISISDLLSQSAEASRQQAVNLRQRLSELHEQLGIRFPVYVMVTKADLLKGFRAWFADYDKAQRDQIWGFTLPWEQTKHADYDLMGNFHQEFSLLQQRLDAGLPETMLKEHDAKTRAEAYLFPQEFAALRPLLADYLSTVFARSNFETEFSPRGIYFASGTQEGMPFDRVMGELNRALSLPEGEESTRWDSVSKEAPIPGAKGQSFFIKNLLQNVIFQEAGIAGENRWWELRNRAVMWSGYAALLALLVILGGLWLTSYAKNKAYLEEVDAKVPMLEQQSKALQNQPQRDLFALLPLLNSLVDLPKSDAFDVNDPPVSRRMGLYRGDDVSDASQSLYQKALDQMLLPAVAMHITTWLRNDNGSDVEYSYEALKAYQMLYQPKHYDGKFLHSWVMLNLQRNLPQNVTQAQLQELEWHLTQLLEPKIQASPYAQDEDLVARERALINQQPLSTRVYGRLKRLLEHDENLKPVSLSDLGGPQSELVFSRKSGKPVSEGVPGLYTPDGYWKSFNDQIDSVTTALHEDDAWVLGAATAQEDKQQIDNAVRQLYMRDFIVNWDRFLADIQLNNSADLSQRINTARLLSGTNSPLRRLVLNLGKVLTLSRTAPAPEDAQKAEDQSNRATRTLEALFSNGDNAPTQGAVVTQAPEQLVTDHYAPMIELAQPLEKGGKTIVFDDFLKQVDELYRYLTAVQDAANSGMPAPGGDAISRLQASAGRLPGGLQTMFSNMAVGASSDTQRRDLENVRKRINVEVGGFCRQAIAGRYPLVRSASTEVTPDDLARMFAPGTGLMDTFFRDNLTNKVDTTQANWRFMPGIDGKTLPGSEGLLRPFQQAQSVRDAFFANGATTPSFKVTVRTVRMDNTILNLTLDVDGQLLRYSHGPQAVQIMTWPGPGGTNQVRMQLGLANGSTATLVTNGSWALNRFFDKARTSPGAGSLSRQATFNVDGHQVTLEFAPNSIRNPFQLPRFSCP

SEQ ID NO: 7687 - protein, 89 aa, Enterobacter cloacae
KGVTLGGGARYTGPMEISPANDAGKLGGTTQYDLAASYRMGELAPSLEGLTLKASAQNVTNKETLTCYDATNCWIGRDRTFQVGASYSF

SEQ ID NO: 7688 - protein, 422 aa, Enterobacter cloacae
PDRIIKRALNMQERQDTGSDAVFTGASGNNQLVAAANPLLNAIPQIRHSVSHDDQVGLRQRLIDEIRRFEVRCQQAGLPYEVIVGARYCLCTALDEAAALTPWGSSGVWSSNGLLVTFHNETWGGEKFFQLLARLSQNPREHILLLEMINYCLLLGFEGRYRVLDNGRTQLETIKQRLWQMIRGVRGSYPPPLSPHPEDRPVLRKLWRPMIPLWACVALVGFIACLFYIVLNWRLGDNTSPVLAKIYQSQLPETTIQQPARQLPAVLNLRGFLKPEIDAGLVAVKDEADRSVVILKGDGLFASASTVVRDRYEPVIDRIAQAMNNVSGKILVVGYSDNVPIRSARFASNYELSLERARSVQKQLQGSLSQPERVKAEGRGEINPVAPNTTPENRARNRRVEITLLVSPDNTQAELNGLPQGN

SEQ ID NO: 7689 - protein, 343 aa, Enterobacter cloacae
SRRKKSVWWITACMTAIVNFAPLRAIPVKGVNRWSSTVRTMRSFLKRTLCAQSRSTPLLNFSTGITDYCFPPEVEIPMYQVVASDLDGTLLSPDHTLSPYAKETLKLLTARGVNFVFATGRHHVDVGQIRDNLEIKSYMITSNGARVHDTDGNLIFTHNLDRDIATDLFGIVHNNPDIVTNVYRDDEWFMNRHRPEEMRFFKEAVFQYSLYEPGLLEPEGISKVFFTCVNHEELLPLEQAINARWGDRVNVSFSTLTCLEVMAGGVSKGHALEAVAKRLGFDLKDCIAFGDGMNDAEMLSMAGKGCIMQNAHQRLKDLHPELEVIGTNADNAVPKYLRKLFLE

SEQ ID NO: 7690 - protein, 219 aa, Enterobacter cloacae
RRVSSRCIVVTSSEWRFPVPIKPLVTAGIENVLNAFLYRAPALKTARQRLNGKVLRIVLKEFSTPLVLVFSERQLDVLGEWEGEADCSVITHMSVLPKLRDRQQMTALIRSGELEVEGDIQVVQNFVALSDQAEFDPAELLAPYIGDIAAEGISKTLRTGSAFLRKGLLRQQRYAAEVLTEEWRMAPGPLEVAWFAEETAAVERAVDALTKRLEKLEGK

SEQ ID NO: 7691 - protein, 93 aa, Enterobacter cloacae
LIIYHWGTRMGGISIWQLVIIAVIVVLLFGTKKLGSIGSDLGASIKGFKKAMSDDENKQEKTSQDADFTAKSIADKQDEAKKEEAKRHDKEQV

SEQ ID NO: 7692 - protein, 181 aa, Enterobacter cloacae
FVFDIGFGELLLVFVIGLIVLGPQRLPVAVKTVVGWVRALRSLATTVQNELAQELKLQEFQDSLKKVEKASMDNLTPELKASMDELREAAESMKRSYSINDPEKASDEANTIHNPVVKGSEEQREGVTPSSAEHQAASPEQSPQEPEVKKQVPPEEPVVKTAEVKPAAPVSESSPSSSDKA

SEQ ID NO: 7693 - protein, 174 aa, Enterobacter cloacae
  UNSURE (174)
KLYLARLTWTILVSVGHACAGVRFLGERSNKMATGKSCSRWFAPIAALLMVVSLSGCFDKEGDQRKAFIDFLQNTVMRSGERLPTLTADQKKQFGPFVSDYAILYGYSQQVSQAMDSGIRPVVDSVNAIRVPQDYMTQREPLRQSNGALGVLSQQLQNAQMEADAFRPALKQGX

SEQ ID NO: 7694 - protein, 303 aa, Enterobacter cloacae
ETSIVALLIITTILWAFSFSLIGEYLAGSVDSYFSVLMRVGLAALVFLPFLRTRGQSLKTILLYMLVGAMQLGIMYLFSFRAYVYLSVSEFLLFTVLTPLYITLIYDLLSRRRLRWGYLLSAALAVIGAAIIRYDKVSDHFWTGLMFVQLANISFAIGMVGYKRLMETRPMPQHNAFAWFYMGAAIVAIAAWFMLGNPQKLPTTPVQWSVLVWLGVVASGLGYFMWNYGATQVDAGTLGIMNNVHVPAGLLVNLAIWQEQPHWPSFLIGGTVILASLWVHRRWVAPRSAQTEDGRTRGSALSE

SEQ ID NO: 7695 - protein, 762 aa, Enterobacter cloacae
ITNFYKGYAMTIRTHTLGFPRVGLRRELKKAQESYWAGNATREELLAVGRELRARHWDQQKQAGVDLLPVGDFAWYDHVLTTSLLLGNVPARHQNNDGSVDIDTLFRIGRGRAPTGEPAAAAEMTKWFNTNYHYMVPEFVKGQQFKLTWTQLLDEVDEALALGHQVKPVLLGPVTYLWLGKVKGEQFDRLSLLNDILPVYKQVLIELGKRGIQWVQIDEPALVLELPQAWLDAFKPAYDALTGQVKLLLTTYFEGVTPNLDTITALPVQGLHVDLVHGKDDVAELHKRLPAEWLLSAGLVNGRNVWRADLTEKYAQIKDIVGKRELWIASSCSLLHSPIDLSVETRLDPEVKSWFAFALQKCEELALLRDALNSGDTAAITHWSAPIQARRHSTRVHNPAVEKRLAAITARDSQRQSPYEVRAEAQRARFNLPAWPTTTIGSFPQTTEIRGLRLDFKKGNLDANHYRTGIAEHIKQAIVEQERLGLDVLVHGEAERNDMVEYFGEHLDGFVFTQNGWVQSYGSRCVKPPVVIGDVSRPEAITVEWAKYAQSLTDKPVKGMLTGPVTILCWSFPREDVSRETIAKQIALALRDEVADLEAAGIGIIQIDEPALREGLPLRRSDWDAYLQWGVEAFRLNAAVAKDDTQIHTHMCYCEFNDIMDSIAALDADVITIETSRSDMELLESFEEFDYPNEIGPGVYDIHSPNVPSVEWIESLLQKAAQRIPAERLWVNPDCGLKTRGWPETRAALANMVQAAQNLRQA

SEQ ID NO: 7696 - protein, 269 aa, Enterobacter cloacae
STVLLLLTNRPTEESPMSKSDVFHLGLTKNDLQGATLAIVPGDPERVEKIAALMDKPVKLAAHREFTTWRAELDGKAVIVCSTGIGGPSTSIAVEELAQLGIRTFLRIGTTGAIQPHINVGDVLVTTASVRLDGASLHFAPMEFPAVADFECTTALVEAAKSVGATTHVGVTASSDTFYPGQERYDTFSGRVVSRFKGSMEEWQSMGVMNYEMESATLLTMCASQGLRAGMVAGVIVNRTQQEIPNAETMKQTESHAVKIVVEAARRLI

SEQ ID NO: 7697 - protein, 276 aa, Enterobacter cloacae
RIKPTARQGGCHMGIRMFDIGLNLTSAQFAKDHDEVVARAFAAGVSGLLLTGTNLHESEQARQLAQRYQHCWSTAGVHPHDSSQWTHESAEALHRLAATPEVVAIGECGLDFNRNFSTPEEQEKAFTAQLALAAELEMPVFMHCRDAHERFMALLEPWLEKLPGAVLHCFTGSRQEALDCLNRGLYLGITGWVCDERRGLELRELLPVIPADRLLLETDAPYLLPRDMQPKPPSRRNEPAYLGHIAERVAHWRGEDAQWLAAQTDDNVRRLFGVQF

SEQ ID NO: 7698 - protein, 504 aa, Enterobacter cloacae
SAYREAMINCMKYHDLRDFLALLEKQGELKRITLPVDPYLEMTEIADRTLRAGGPALLFENPKGYTMPVLCNLFGTPRRVALGMGQEDVTALREVGKLLAFLKEPEPPKGFRDLFDKLPQFKQVLNMPTKRLRGAPCQQKVLEGDAVDLTKIPIMQCWPEDAAPLITWGLTVTRGPHKERQNLGIYRQQLIGKNKLIMRWLSHRGGALDFQEWCAAHPGERFPVSVALGADPATILGAVTPVPDTLSEYAFAGLLRGTKTEVVKCISNDLEVPASAEIVLEGYIEQGELAPEGPYGDHTGYYNEVDNFPVFTVTHITQREDAIYHSTYTGRPPDEPAVLGVALNEVFVPILQKQFPEIVDFYLPPEGCSYRLAVVTMKKQYAGHAKRVMMGVWSFLRQFMYTKFVIVCDDDVNARDWNDVIWAITTRMDPARDTVLVENTPIDYLDFASPVSGLGSKMGLDATNKWPGETDREWGRPIEKDPAVTARIDAIWDELAIMNNGKAE

SEQ ID NO: 7699 - protein, 240 aa, Enterobacter cloacae
TSRQRERMTTLSCKVTSVDAITDTVYRVRLVPEAAFSFRAGQYLMVVMDERDKRPFSMASTPAEKEFIELHIGASELNLYAMAVMDRILKEREIVVDIPHGEAWLREDEDRPLILIAGGTGFSYVRSILLTALARNPNRDITIYWGGREEKHLYDLSELEALSVNHPNLRIEPVVEQPEEGWRGRSGTVLTAVLQDHGTLAGHDIYIAGRFEMAKIARDLFCNERDAREDRLFGDAFAFI

SEQ ID NO: 7700 - protein, 545 aa, Enterobacter cloacae
FHSGVLMAHFAQSPSFILHQVTCQFATGDILFGPLNLSLDASVCALVGRNGSGKTRLLRLLAGVDEPASGHIERFGTHVYVAQQQDISADTTLAELLGYDAIFAARTRIDSGHYEPDDLDTLDGYWDLAERLSQAFIAAKLPPFDPSKRAAELSGGERIRALLCSAFTADADYLLLDEPTNHLDRQGRKWFYEQLSRYQGGVLVASHDRELLAQVPRILELSALGLRSYGGNYADYRTQRDAEQLAARAALEHAATERKRTRARMHKEHDDSLRRSAKTLRTVDSLNIASFERVKYKGAAKERIGSWKKQHSVQNHALNAAVNQARERVEEDNAVMFTLPGSEIPEGKQVLVLEELVLPHVPVPPINWRMDGPMRVALRGPNGCGKSTLLKVMLGETAPVTGTCKVSVRCAYLDQHLSRLDLSQSVMTHLSLGNTPLEEGALRTRLAQLQLGAEKVTLPLAELSGGERLKAALACVLWREAATQLLLLDEPTNHLDLASVQAIEAALADYPGALLVVSHDEAFLAGLKLTHELVWEETGWRCESL

SEQ ID NO: 7701 - protein, 75 aa, Enterobacter cloacae
ADDDTRTLLIQAEEERVVDNRMHDRYCELRAAAGHPCEGGKPLVINGAYHEILFEKDAMRSVALNAIVEFFNRHN

SEQ ID NO: 7702 - protein, 533 aa, Enterobacter cloacae
SNSLFSAKRPTCSAFSFCVTPRRKTLSNWTFIQHNSILCGLDVDAGGIVDISILVYAVVALVSVGIGWLICGYQHAQQKADQLAEREEIVAELSATKQQLALSDHWRDECELLNNELRNLRDINTSLEADLREVTTRLESTQLHAEDKIRQMINSEQRLSEQFENLANRIFEHSNRRVDEQNRQSLNSLLTPLREQLDGFRRQVQDSFGQEARERHTLAHEIRNLQQLNAQMAQEAVNLTRALKGDNKAQGNWGEVVMTRVLEASGLREGYEYETQVSIENDARSRMQPDVIVRLPQGKDVVIDAKMTLVAYERYFNAEDDYTRETALQEHIASVRNHIRLLGRKDYQQLPGLRSLDYVLMFIPVEPAFLLALDRQPELITEALKNNIMLVSPTTLLVALRTIANLWRYEHQSRNAQQIADRASKLYDKMRLFVDDMSSVGQSLDRAQDNYRQAMKKLSSGRGNLLAQAEAFRSLGVEVKREINPELVEQATAQDEEFRLREGDGEQNSRNEDNGLAASLSPEAQPARFFHGG

SEQ ID NO: 7703 - protein, 256 aa, Enterobacter cloacae
LAGSEMVDDSQDTTHFGFQTVAKAQKADMVAHVFHSVAAKYDVMNDLMSFGIHRLWKRFTIDCSGVRRGQTVLDLAGGTGDLTAKFSRLVGETGRVVLADINDSMLKMGREKLRNIGVVGNVEYVQANAEALPFPDNTFDCITISFGLRNVTDKDKALRSMYRVLKPGGRLLVLEFSKPIIDPLSKAYDAYSFHVLPRIGELVANDAESYRYLAESIRMHPDQDTLKAMMQDAEFENVEYFNMTAGVVALHRGYKF

SEQ ID NO: 7704 - protein, 558 aa, Enterobacter cloacae
CVNQTAGKTGGQMTPGEIRRLYFIVRTFLSYGLDELIPRMRITLPLRLWRRTLFWMPNRHKDQELGARLRLALQELGPVWIKFGQMLSTRRDLFPPQIADQLALLQDRVAPFDGERAKKQIEEAMGNIPIETWFDDFDIQPLASASIAQVHTARLKENGKEVVIKVIRPDILPVIKADMKLIYRLARWVPRLLPDGRRLRPLEVVREYEKTLIDELNLLRESANAIQLRRNFEDSPMLYVPEVYSDYCSQNMMVMERIYGIPVSDVTALEKQGTNMKLLAERGVQVFFTQVFRDSFFHADMHPGNIFVSYEHPEDPKYIGIDCGIVGSLNKEDKRYLAENFIAFFNRDYRKVAELHVDSGWVPPDTNVEEFEFAIRTVCEPIFEKPLSEISFGHVLLNLFNTARRFNMEVQPQLVLLQKTLLYVEGVGRQLYPQLDLWKTAKPFLESWIKDQVGIPALVRSLKEKGPFWIEKMPEIPELVYDSLRQSKNLQHSMDKIAHELQSSRVRQGQSRYLFGIGATLLISGTLLLINRPDWEMMPAWIMAAGVVVWLAGWRKTR

SEQ ID NO: 7705 - protein, 259 aa, Enterobacter cloacae
SVNMAVDDTQPLIAHLIELRKRLLNCIIAVFLIFLCLVYFANDIYQVVSAPLIKQMPLGATMIATDVASPFFTPIKLTFWVSLIASAPVILYQVWAFVAPALYRHERKLVIPLLVSSSLLFYIGMAFAYFVVFPLAFGFLTHTAPEGVQVSTDIASYLSFVMALFMAFGVAFEVPVAIVLLCWVGVTTPDDLRKKRPYILVGAFVVGMLLTPPDVFSQTLLAIPMYCLFEVGVFFARFYVGKGRTRDEEDEPSEETTKE

SEQ ID NO: 7706 - protein, 105 aa, Enterobacter cloacae
SRCVIYEEFSMELKDPEFELLSSLEQIIFKDVPPTVTLNQKSNPFSEFERLRKGSGLKTDEFARAMGVSVAMVLEWESKREKPTPAELKLMRLIQANPDLRKQLA

SEQ ID NO: 7707 - protein, 181 aa, Enterobacter cloacae
RSRQGFGMLAPRTMGRVIMQAWYLLYCKRGQLQRAQEHLERQSVNCLTPVITLEKMQRGRRTTVSEPLFPNYLFVEFDPEVIHTTTISATRGVSHFVRFGAHPARVPSSVIHQLSVYQQPEDITDPETPYAGDSVVITEGAFEGLQAIFAEPDGEARSMLLLNLLNKEVLQSVKNTDFRKV

SEQ ID NO: 7708 - protein, 286 aa, Enterobacter cloacae
PGVYIYLCANPFIGTENAMTEKTGFAPAAAPHASTIVSTPEEAITAGETSIPSQGENMPAYHARPKSADGPLPIVIVVQEIFGVHEHIRDLCRRLALEGYLAVAPELYFRQGDPNDYSDIPTLFSNLVSKVPDAQVLADLDHVASWAARNGGDPHRLMVTGFCWGGRISWLYAAHNPQLKAAVAWYGKLVGEKTLNSPKHPVDIATDLNAPVLGLYGGQDTGIPLDTVETMRHALRAANAKAEIVVYPDAGHAFNADYRPSYHAESAKDGWQRMLAWFSQYGGKKA

SEQ ID NO: 7709 - protein, 147 aa, Enterobacter cloacae
GCMAVRIPAFRLIPSRPCATRCGRQTRRPKSWCTRMRDTRLMPIIVRAITRNPRKMAGRECWRGSASTAGRKRNTKSPVAATPTGQSSPTTPDANSAPPAPCSPAPRGFQASREFSGRSPGLPTDVPPGCAGPLFAAAIQSTPRLAR

SEQ ID NO: 7710 - protein, 320 aa, Enterobacter cloacae
RTFMIEIKHLKTLQALRNCGSLAAAAATLHQTQSALSHQFSDLEQRLGFRLFVRKSQPLRFTPQGEILLQLANQVLPQIASALQSCNEPQQTTLRIAIECHSCIQWLTPALENFRQKWPQVEMDFKSGVTFDPQPSLQQGELDLVMTSDILPRSGLHYSPMFDFEVRLVLAPDHPLAAKTRITPEDLATETLLIYPVQRSRLDIWRHFLQPAGISPQLKSVDNTLLLIQMVAARMGIAALPHWVVETVERQGLVVTKTLGEGLWSRLYAAVRDGEQRQPITEAFIRSARNHACDHLPFVRSAERPSGDVPTAKPGSPFPQ

SEQ ID NO: 7711 - protein, 501 aa, Enterobacter cloacae
KEPPGYVFLVPRGGMMNIPGDELYTLLHAALKKRGTETLQRALYLALREAILCGRLRSGSHLPGSRTLAHQISVSRNTVNAALDQLTLEGYLLRSRQGTRVGQFAPRTIARTLPDPDVRLTKRVARLPAPVPRDTPVMAFTPGTPAINYFPLPLWRRLYDRVLREEGSALLGYGDPAGEPSLRAAIARHLALSRGIDCDASQIVITEGALEGVNLCTMLLSEPGDVAWVENPGYSGAKSAFVKTGLAMTGIPVDDEGMCWEGLCAPSPTLIFTSPSHQFPYGSVLSARRRLALLELARQHNAWIIEDDYDSEFRYTGEPVPAMLGMVNNAPVVYLGTFSKTLFPSLRMGFMVLPPALAKAARPAIGSLLRGGHRAEQRTLALFIEEGHYARHLAAMRRLYRKRYRQLREVLSAELHTPHRVLAGEGGMHLALAIDGIDDQRLVEQARAFQLAPAALSGYYLETKQGQTGLVLGYGNTSASQFAPGIRRLQALITQQWGGKG

SEQ ID NO: 7712 - protein, 221 aa, Enterobacter cloacae
IHQRMARKTKQQALETRQHILDVAMRLFSQQGVSATSLAQIAQAAGVTRGAIYWHFKDKSDLFGEIWELSESSISDLESEYRAKFPHDPLSVLREILVYILEATVVEERRRLMMEIIFHKCEFVGEMAVVQQAQRDLCLESYDRIEQVLTECMQAKMLPATLLTRRAAILMRSYISGLMENWLFAPESFDLRSEARSYVDIFLEMCQLCPTLQSKHHPRST

SEQ ID NO: 7713 - protein, 205 aa, Enterobacter cloacae
TTVTLTDSSRAVSNTVSFRHKPMTATAQQLEYLKNSIKSIQDYPKPGILFRDVTSLLEDPKAYALSIELLVERYKNAGITKVVGTEARGFLFGAPVALAMGVGFVPVRKPRKLPRETIAESYELEYGTDQLEIHVDAIKPGDKVLVVDDLLATGGTIEATVKLIRRLGGEVTDAAFIINLFDLGGEQRLEKQGITSYSLVPFPGH

SEQ ID NO: 7714 - protein, 117 aa, Enterobacter cloacae
RERREKPMFGGKGGLGGLMKQAQQMQEKMQKMQEEIAQLEVTGESGAGLVKVTINGAHNCRRVEIDPSLLEDDKEMLEDLVAAAFNDAARRIDETQKEKMASVSSGMQLPPGFKMPF

SEQ ID NO: 7715 - protein, 657 aa, Enterobacter cloacae
HSPPLIHLPALQSLPMSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRAQLEHILDEENIVHEPRALQLLARAADGSLRDALSLTDQAIASGDGKLSTDAVSTMLGTLDDDQALSLIEAMIAANGERVMTLVNDAAARGIEWEALLVEMLSLLHRVAMLQLSPSAIGADMATIEQRMRELARTVPPADVQLYYQTLLIGRKELPFAPDRRMGVEMTLLRALAFHPRKPLPEPETPRQSFAPVAPTAVMSPQQVPPQPASPPPQNVPLSDATSSVLAARSQLQRAQGATKPKKSEPAAPARARPVNNAALERLASVTERVQSRPAPSALEQKAPAKEEAYRWKATTVVETVKEVVATPKALKKALEHEKTPELSAKLAEESIERDAWAAEVSKLQLPKLVEQVALNAWKEQDGNQVRLHLRPGQRHLNSPGAQKALAEALTALQGVPVELTIIEDDNPAVKTPLEWRQAIYEEKLAQAREAIIADNNIQTLRRYFDADLDEESIRPI

SEQ ID NO: 7716 - protein, 624 aa, Enterobacter cloacae
MKGQETRGFQSEVKQLLHLMIHSLYSNKEIFLRELISNASDAADKLRFRALSNPDLYEGDGELRVRVSFNKENRTLTIADNGIGMNRDEVIDHLGTIAKSGTKAFLESMGSDQAKDSQLIGQFGVGFYSAFIVADKVTVRTRAAGDSAENGVLWESKGEGEYTVDDITKADRGTEITLHLREGEYDFLNDWRVRSIISKYSDHIALPVEIEKQEEKDGETVVSWEKINKAQALWTRNKAEIKDDEYNEFYKHIAHDFTDPLTWSHNRVEGKQEYTSLLYIPAQAPWDMWNRDHKHGLKLYVQRVFIMDDAEQFMPNYLRFVRGLIDSNDLPLNVSREILQDSTVTRNLRNALTKRALQMLEKLAKDDAEKYQTFWKQFGLVLKEGPAEDTANVEAIAKLLRFASTHNDSSAQTVSLEEYVSRMKEGQEKIYYITADSYAAAKSSPHLELLRKKGIEVLLLSDRIDEWMMNYLTEFDGKAFQSVAKADESIDKLADEVDESAKEAEKALEPFIERVKTLLGDRVKEVRFTHRLTDTPAIVTTDADEMSTQMAKLFAAAGQAVPEVKYIFELNPDHPLVKRAADTQDDARFAEWVELLLDQSLLAERGTLEDPNLFIKRVNALLLA

SEQ ID NO: 7717 - protein, 225 aa, Enterobacter cloacae
KIESTFEGIFAMRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAASGRVYHIKFNPPKVEGKDDVTGEELTTRKDDQEETVRKRLVEYHQMTAPLIGYYTKEAQAGNTKYAKVDGTKAVADVRAELEKILG

SEQ ID NO: 7718 - protein, 469 aa, Enterobacter cloacae
THRHDGVTGHHPPLIALRAGFVLPFPARILCTVQTMKFPGKRKSKHYFPVDARDPLLQQIQQESETSAAWVVGIDQTLVDIEAKVDDAFVARYGLSAGHSLVIEDDVAEALYQELVRENLITHQFAGGTIGNTMHNYSVLADDRSVLLGVMCSNIEIGGYAYRYLCNTSSRTDLNYLQGVDGPIGRCFTLISDSGERTFAISPGHMNKLRAESIPEEVIAGASALVLTSYLVRCKPGEPMPDATMKAIEYAKKYNVPVVLTLGTKFVIADNPEWWQAFLKEHVSILAMNEEEAEALTGESDPLLASDKALDWVDLVLCTAGPVGLYMAGFTEEESKRKTQHPLLPGAIAEFNQYEFSRAMRHKDCINPLRIFSHIAPYMGGPEKIMNTNGAGDGALAALLHDITANAYHKTNVPNSSKHTFDWLTYSSLAQVCKYANRVSYQVLNQHSPRLTRGLPEREDSLEEAYWDR

SEQ ID NO: 7719 - protein, 1160 aa, Enterobacter cloacae
ASPPFYLIGYGKNRRPFPSYYSASAGRDILHARLFPVISHITFTTMLHINRSQHLVLALFLILLFYFAAAPLSWARADNGSDIPTRADVQAQLDTLNKQKDLSALEKLVQQDLTETLETLDKIERIKAETAQLRQKVAQAPENMRKATEALNALSDVDNDDETRKTLATLSLRQLESRVAQLLDDLQTAQSDLSTYNSQLVSLQTQPERVQNAMYSASQQLQQIRNRLNGVTVGEGALRPTQQTLLNIQQTLLNAEIEQQRKSLEGNTVLQDALQKQRDYVTANINRLEHQLQLLQEAVNSKRLTLTEKTAQEAVSPDETARIQANPLVKQELEINHQLSERLIQATENGSALVQQNIKVKNWLDRALQAERNVKEQIAVLKGSLLLSRILYQQQQTLPSADELEDMTNRIADLRLEQFDVNQQRDALFQSDTFVAKVEEGHSGEVNAEVHDALLQVVDMRRELLDQLNKQLGNQLMMAINLQINQQQLVSVSKSLQEILTQQIFWVNSNKPMDWDWFKSFPETLKSQIKSMKITVNWEKAWPAVMIAFLAGLPLLLIAGVIRWRLKWLKQYQAKLASEVGQLRNDSQLHTPKAILIDLIRALPVCLLILAVGLILLTMQLNISDLLWAFSKKLALFWLVFGLCWKVLEKDGVAVRHFNMPEKLTSHWRRQIVRISLALLPLHFWSVVAELSPLHLMDDVLGQLVIMLNLLLIAVLMWPMCRDSWRDKESHNLRLVTVTVLAIIPLAMMVLTATGYFYTTLRLSGRWIETVYLVIVWNLLFQTVLRGLSVAARRIAYRRAVARRQHQVKEGAEGAEPQEEPTIALEQVNQQTMRITMLVMIALFAVMFWAIWSDLITVFAYLDSITLWQYNGTEAGAAVMKSVTMGSLLFALVSSVVAWALIRNLPGLLEVLVLSRLNLRQGASYAITTILNYVIIIVGAMTVFGSLGVSWDKLQWLAAALSVGLGFGLQEIFGNFVSGLIILFERPVRIGDTVTIGTFSGTVSKIRIRATTITDFDRKEVIIPNKAFVTERLINWSLSDTTTRVVIRLGVAYGSDLDKVKEVLLEAAKSHPKVMHDPAPDVFLTTFGPSTLDHELRLYVRELRDRSYTVDELNRTIDRLCRENNINIAFNQLEVHLRNEKGDEHTEVKREIKGDDPTPA

SEQ ID NO: 7720 - protein, 134 aa, Enterobacter cloacae
PFSLITIRIMQRTILIIIGWLAVVLGTLGVVLPLLPTTPFILLAAWCFARSSPRFHHWLLYRSWFGGYLRHWQKHRAMPPGAKPRAIAFILITFAVSLWLVKMMWVRILLLAILVSLLLFMWRIPVVDEKQQKH

SEQ ID NO: 7721 - protein, 205 aa, Enterobacter cloacae
DAILMQTSPLLTQLMEALRCLPGVGPKSAQRMAFTLLQRDRSGGMRLAQALTRAMSEIGHCADCRTFTEQDVCNICTNPRRQENGQICVVESPADIYAIEQTGQFSGRYFVLMGHLSPLDGIGPDDIGLDRLEQRLESETIKEVILATNPTVEGEATANYIAELCAQYGVDASRIAHGVPVGGELEMVDGTTLSHSLAGRHKIIF

SEQ ID NO: 7722 - protein, 320 aa, Enterobacter cloacae
MSQAKTGILLANLGTPEAPTPAAVKRYLRQFLSDTRVVDTPRLLWWPLLRGVILPIRSPRVAKLYQSVWMEEGSPLMVYSRRQEKALAARLPDMPVALGMSYGKPSLESAVDSLLAQGVEHIVVLALYPQYSCSTVAAVWDELGRILATRRRIPGITFIRDYADNELYIQALASSVRASFEKHGEPDLLLLSYHGIPQRFANEGDDYPQRCRDTTRELVSALGLPPEKVMMTFQSRFGREPWLTPYTDETLKMLGEKGVKHIQVMSPGFSADCLETLEEIAVQNKEFFMEAGGTKYEYIPALNDSPEHIDMMVSLVTTRR

SEQ ID NO: 7723 - protein, 89 aa, Enterobacter cloacae
PAKAIRCWRLIRRWTGWTWCSAPPGRSGCTWRASRKKRASVKPSTRCCRAQSPNLTSMSSAALCVIKTASTRCVSSLTSHRIWVALRRS

SEQ ID NO: 7724 - protein, 263 aa, Enterobacter cloacae
MRISGSNSIPTETKNSTANASRSGRVSCAARWLSSDSFSTIPAKNAPSAKETSNSSTAPKAMPSASARTESVNSSREPVAALRDMIHGTRRRPTSIMMAINATTLPMVMLISSASEAKPIFSFSIIPATAGSRTSVNTITRSSTISQPIAICPRWLSISCLSSSARSSTTVLAVERHSPNTIPVMIDQPSTAESAMPSSVATPIWAIAPGMAIDFTAIRSFREKCSPTPNISRITPNSASSGASLVSATKPGVKGPASTPASK

SEQ ID NO: 7725 - protein, 103 aa, Enterobacter cloacae
YPVYGGGSPECAPVRPRRQLPWSTNTADIEPAPQCVQRPAPAESQRRFPGTAYRSSCRAQRACPAGGRPAPSPDDGCTPSAASPLPSTRTDRALPHAGNESAE

SEQ ID NO: 7726 - protein, 172 aa, Enterobacter cloacae
AADWFASEWHLKARRQLHTAGNRGHFLFLGFVDTASGIVKRGCNQIFQHLFVVFEQARVDFHATAVMRTVDGHLDQTGTGFTRDFQLSDLFLHLLHFFLHLLSLLHQATQTAFSTKHRLLSSFTLRITTVSQTHDQMGRILSSSRSASKYRRRVWMLLSAIIASRACASFSS

SEQ ID NO: 7727 - protein, 184 aa, Enterobacter cloacae
TATLPLESALKTALLLERLQNQLIALRAQATPLMGHATLKPRFDRQLFRTRSTVIQDYLAEAQTNLDELRHAVESEQQEQVAWLAEHLTEQITALHREIAAWPLRAWDSASPGLGKWQRKRLENQEFERRLFEMKREREARLNISETLEEQQLLMREISALEGRIVRCRQALDEIERVIERLTR

SEQ ID NO: 7728 - protein, 62 aa, Enterobacter cloacae
QEPLMSLENAPDEVKLAVDLIMLLENHAIPAETVLKALEIVRRDFEGKLPPHPALSPEGRGK

SEQ ID NO: 7729 - protein, 421 aa, Enterobacter cloacae
YKRSNGFLDSGPLINLKSDTRGLHMNKNRGLTPLAVVLMLSGSLALTGCDDKEAQQGAQQVPEVGVVTLKSEPLQMTTELPGRTSAYRIAEVRPQVSGIILKRNFTEGGDVKAGESLYQIDPATYQASYESAKGDLAKAEAAAKISQLTLNRYKKLLGTQYISQQDYDSALADAQQANAAVVAAKAAVETARINLAYTKVTSPISGRIGKSAVTEGALVQNGQTNALATVQQLDPIYVDVTQSSNDFLRLKQELASGQLKQENGKAKVELVTNDGIEFSQTGTLEFSDVTVDQTTGSITIRAIFPNPDKTLLPGMFVRARLEEGTNPSAILVPQQGVTRTPRGDASALVVGADNKVEMRNITATQAIGDKWLVTEGLKDGDRVIITGLQKVRPGAQVKAQEVKSDDKQQASAAGQSEQTKS

SEQ ID NO: 7730 - protein, 66 aa, Enterobacter cloacae
SKLMNTWTTPLCCSAATALTHRICRNGVNQETAYFAASLMSAELIRLVFPVKIITITKVNLCLINH

SEQ ID NO: 7731 - protein, 190 aa, Enterobacter cloacae
NDSREVPMSEEKQKMIAGEYYRPGDDTLRANRLRARHLVHRYNHTAPDEKAERRALLADLLGQSEGAYIEPSFRCDYGYNIYLGKNFYANFDCVMLDVCPVRIGDNCMLAPGVHIYTATHPLDATERNSGLEYGKPVTIGDNVWIGGRAIINPGVTIGDNAVIASGAVVTKDVPANAVVGGNPAKIIKML

SEQ ID NO: 7732 - protein, 92 aa, Enterobacter cloacae
SLHYFTLLAIIGFVLASAFSVILVYAQELLPGRIGMVSGLFFGFAFGMGGLGAAVLGMVADHTSIFLVYKICAFLPLLGMLTIFLPDNRHKA

SEQ ID NO: 7733 - protein, 1037 aa, Enterobacter cloacae
DMPNFFIDRPIFAWVIAIIIMLAGGLAILKLPVAQYPTIAPPAVTISATYPGADAKTVQDTVTQVIEQNMNGIDNLMYMSSNSDSTGTVQITLTFESGTDADIAQVQVQNKLQLAMPLLPQEVQQQGVSVEKSSSSFLMVVGVINTNGTMTQEDISDYVGANMKDAISRTSGVGDVQLFGSQYAMRIWMDPNKLNNFQLTPVDVINAIKAQNAQVAAGQLGGTPPVKGQQLNASIIAQTRLTSADEFSKILLKVNQDGSQVRLRDVAKVELGGENYDVIAKFNGKPASGLGIKLATGANALDTATAIRAELKKMEPFFPSGLKIVYPYDTTPFVKISIHEVVKTLVEAIILVFLVMYLFLQNFRATLIPTIAVPVVLLGTFAVLAIFGYSINTLTMFGMVLAIGLLVDDAIVVVENVERVMAEEGLPPKEATRKSMGQIQGALVGIAMVLSAVFIPMAFFGGSTGAIYRQFSITIVSAMALSVLVALILTPALCATMLKPIQKGGHGEHKGFFGWFNRMFDKSTHHYTDSVGNILRSTGRYLLLYIIIVVGMAFLFVRLPSSFLPDEDQGVFLSMAQLPAGATQERTQKVLDEMTDYFLTKEKDNVESVFAVNGFGFAGRGQNTGIAFVSLKDWSERPGAENKVEAITGRAMGTFSQIKDAMVFAFNLPAIVELGTATGFDFQLIDQGGLGHEKLTQARNQLFGEVAKHPDLLVGVRPNGLEDTPQYKIDIDQEKAQALGVSISDINTTLGAAWGGSYVNDFIDRGRVKKVYVMSEAQYRMLPNDINNWYVRGSDGQMVPFSAFSTSRWEYGSPRLERYNGLPSMEILGQAAPGRSTGEAMNLMEELASKLPAGIGYDWTGMSYQERLSGNQAPALYAISLIVVFLCLAALYESWSIPFSVMLVVPLGVIGALLAATFRGLTNDVYFQVGLLTTIGLSAKNAILIVEFAKDLMEKEGKGLIEATLEAVRMRLRPILMTSLAFILRRYAAGYQLRRGLRRTKRGKYGCNGWYGHGDRSRHLLRTGVLRGGSSPLQPQK

SEQ ID NO: 7734 - protein, 579 aa, Enterobacter cloacae
TINRLFGICTKNGSPIAKGDGMHHATPLITTIVGGLVLAFILGMIANKLRISPLVGYLLAGVLAGPFTPGFVADTKLAPELAELGVILLMFGVGLHFSLKDLMAVKSIAIPGAIAQIGVATLLGMALSAVLGWSIMTGIVFGLCLSTASTVVLLRALEERQLIDSQRGQIAIGWLIVEDLVMVLTLVLLPAVAGMMEKENIGFASLALDMSITIGKVVAFIAIMMLVGRRLVPWIMSRSAATGSRELFTLSVLALALGIAFGAVELFDVSFALGAFFAGMVLNESELSHRAAHDTLPLRDAFAVLFFVSVGMLFDPLILIQQPLAVLGTLAIIIFGKSVAAFFLVRMFGHSPRTALTIAASLAQIGEFAFILAGLGMALNLLPQAGQNLVLAGAILSIMLNPVLFALLEKYLEKTETLEELTLEEATEEEKQIPVDICNHALLVGFGRVGSLLGEKLMAQGIPLVVIETSRTRVDELRERGIRAVLGNAANEEIMNLAHLDCARWLLLTIPNGYEAGEIVATAREKCPHIEIIARAHYDDEVEYITERGANQVVMGEREIANTMLTMLTKPPVEEAVTG

SEQ ID NO: 7735 - protein, 137 aa, Enterobacter cloacae
CSVSKKSLRRGCAMDEYSPKRHDIAQLKFLCESLYHDCLANLEESNHGWVNDPTSAINLQLNELIEHIATFALNYKIKYNEDNKLIEQIDEYLDDTFMLFSSYGINAQDLQKWRKSGNRLFRCFTNVSRANPVSLSC

SEQ ID NO: 7736 - protein, 75 aa, Enterobacter cloacae
GEFMSDKPLTKVDYLMRLRRCQSIDTLERVIEKNKYELSDNELAVFYSAADHRLAELTMNKLYDKIPSSVWKFVR

SEQ ID NO: 7737 - protein, 158 aa, Enterobacter cloacae
RQKMTEIQRLLTATIDDLNTREKRDNRPRFSISFIRKHPGLFVAMYAAWLATLIVMLKSETLVDSVWLLVVLFVVFNAFFFFDVNPRYRYEDIDVLDFRVCYNGEWYNTRYVPKELIDSILHSPAVEAGQKEKLQKMVTTKGQLSFYDVFTLSRPTAA

SEQ ID NO: 7738 - protein, 247 aa, Enterobacter cloacae
SGDLLNIMEIKMNTFNEFGQPVGESLIDWQPRPHPSRVVLQGRYCRLEPLRMEHAHALFSAYSVAGDTRSWTWLLREPDATAEEFAEWVASVSELADPIHFTVIDNQTQSPVGTLSLMRIDPKNGVVEVGHVHFSSLLSRTPMSTEAQYLLMRYVFDTLGYRRYEWKCNSLNEPSRKAALRLGFQFEGRFRQALVIKGRNRDTDWFSILDKEWPALASAFESWLATDNFTADGKQKRSLESWRETRV

SEQ ID NO: 7739 - protein, 265 aa, Enterobacter cloacae
RYAQELQMARSWVRLFAGATLTLSLTGHALADEGKITVFAAASLTNAMQDIAAVYKKEKNVEVVSSFASSSTLARQIEAGAPADLFISADQKWMDYAVEKKSVDTATRETLLGNSLVVVAPANSKQGDIAINKQTDWTRLLNGGRLAVGDPEHVPAGIYAKEALQKLGAWETLSPKLAPAEDVRGALALVERNEVPLGIVYGSDAVASKGVKVVGTFPEDSHKKVEYPVAIVDGHKNASVTAFVDYLKGPEASAIFKRYGFTTHE

SEQ ID NO: 7740 - protein, 335 aa, Enterobacter cloacae
SGVFMKQTVYTASPESQQIHVWRLNTEGSLTLVQVVDVPGQVQPMVVSPDKRFLYVGVRPEFRVLAYRISPDDGALTYTAEAPLPGSPTHISTDHKGNFIFSGSYNAGSVSVTRLEDGIPVETVDVVEGLEGCHSANISPDNRTLWVPALKQDRICLFTLSDDGHLVAQSPAEVTTVEGAGPRHMVFHPNQQYAYVVNELNSSVDVWELNDPNGQIECVQTLDMMPSDFSDTRWAADIHITPDGRHLYACDRTSSLITVFSVSEDGSVLAVEGFQPTETQPRGFNVDHSGKYLIAAGQKSHHIALYEIQGVQGLLEEKGRYAVGQGPMWVVINAH

SEQ ID NO: 7741 - protein, 418 aa, Enterobacter cloacae
MSIQPMTSGRHMQQLNPDDVIWRNARLATLATGEAEPYGLREQHALVVRGQTILAIIPESEIPSGHCQCVDLDGRLVTPGLIDCHTHLVFGGDRAAEWEQRLNGVSYQTISAQGGGINATVTATRNSSPETLLTVAQQRLQRLMNEGVTTVEIKSGYGLNAEAEEKMLLVARQLSLNNLVDISPTLLAAHAVPAEYRQDPDAYLALVCEQIMPTLWQKELFEAVDVFCENVGFTPAQTERLFRAAAALGIPVKGHVEQLSNLGGAALVSQYKGLSADHIEYLDDAGIQAMAQSGTVAVLLPGAFYFLQERQRPPVAQLREQGVPMAVATDYNPGTSPFASLHLAMNMACVQFGLTPEEAWAGVTRHAAQALGRAATHGQLKPGYVADFVVWEANHPVEMVYEPGRNPLYQRVFRGQVA

SEQ ID NO: 7742 - protein, 295 aa, Enterobacter cloacae
LSVSAEAVNYRRRIWWNLIRTTIGTVRGRSLPPDWPGKLLTGGHNHIQGVMMFSRSPLPQPSPPAPFYEKVKQAISEKIAAGVWRPHDRIPSEAELVAQFGFSRMTINRALRELTDEGLLVRLQGVGTFVAEPKGQSALFEIRSIADEIAARNHQHHCEVLVLEETQASAEQAIELNVTEGTRIFHSVMVHYENDIPVQIEDRCVNAERIPDYLNQDYTQTTPHAYLSLVAPLTEGEHIVEAVRATPQECELLRIKEHDPCLLIRRRTWSSSQIVSHAKLLFPGNRYRLQGHFMS

SEQ ID NO: 7743 - protein, 526 aa, Enterobacter cloacae
LCQRAGPEPADDPRHTRKACMNALTLTPGSLTLKQLRHVWRQPVTLSLDESAHRAINDSVACVEAIVAEGRTAYGINTGFGLLAQTRIATHDLENLQRSLVLSHAAGVGQPLDDEIVRLMMVLKINSLARGFSGIRLSVIQALMALVNAEVYPWIPAKGSVGASGDLAPLAHMSLLLLGEGQARWQGEWLPAKEALKKAGLTPITLAAKEGLALLNGTQASTAFALRGLFEAEDLFASAVVCGALTTEAVLGSRRPFDARIHEVRGQRGQIDAAAMYRHVLTDTSDIAESHHNCEKVQDPYSLRCQPQVMGACLTQLRQAAEVLLVEANAVSDNPLVFAQENEVVSGGNFHAEPVAMAADNIALAIAEIGALSERRIALMMDKHMSQLPPFLVRNGGVNSGFMIAQVTAAALASENKALSHPHSVDSLPTSANQEDHVSMAPAAGRRLWEMASNTRGVLAVEWLAACQGIDLREGLTSSPLLEQARHTLREHVTHYDDDRFFAPDIDKAMQLLEEGRLVGLLPSVL

SEQ ID NO: 7744 - protein, 397 aa, Enterobacter cloacae
RRHRPVLQRGSHMTWQARIRTALDERRAADAFRVRRVVENGAGRFLTREGERFCNFSSNDYLGLSQHPQIVRAWQQGADRYGVGSGGSGHVSGYTTAHQALEEELADWLGYPRALLFISGFAANQAVIAALMGKDDRIVADRLSHASLLEAASLSPAQLRRFAHNNASQLNVLLGKPCSGLQLAVTEGVFSMDGDSAPLATLHDVAKQQNAWLLVDDAHGIGVTGEEGRGSAHQQRVRPELLVVTFGKGFGVSGAAVLCSEPVADYLVQFARHLIYSTSMPPAQAVALSASLAVIRGEDGAERRARLADHIQRFRRGISELSYRLTDSHSAIQPVIVGENHRALMVAQALRERGQWVTAIRPPTVPPGTARLRLTLTAAHEPQDIDTLLEALYVSRQ

SEQ ID NO: 7745 - protein, 358 aa, Enterobacter cloacae
TDGEIVMLELNFTQTLGSHTLTLNETLPASGITAIFGVSGAGKTSLINAISGLTRPQSGRIVLNNRVLNDAEKKVCLSPDKRRIGYVFQDARLFPHYSVRGNLRYGMAKSMAGQFNKLVALLGIEPLLDRLPSSLSGGEKQRVAIGRALLTAPELLLLDEPLASLDIPRKRELLPYLQRLAREINVPMLYVSHSLDEILHMADKVLVLEAGRVKAFGNLEEVWGSSVMHPWLPKEQQSSILKVSVLEHHPHYAMTALALGDQHLWVNKIDTPIQSTLRIRIQASDVSLVLQPPLQTSIRNILRAKVAQCFDDNGQVEVQLEVGSRTLWARISPWARDELGIKPGLWLYAQIKSVSITA

SEQ ID NO: 7746 - protein, 117 aa, Enterobacter cloacae
SALRFNELGQTPSFAVAFAGDIHLIVPGPFTFQTQRMLDKFCEGIQFGGVFIGQGKFPDCFDVFRRLAQGGNLSKHRTLRFRQRQSPVAGADHMAGRAFIHHGVIHIHQAVNGVLIQ

SEQ ID NO: 7747 - protein, 586 aa, Enterobacter cloacae
IRPCVCLSIQVYLNASSVPYEEHTMSSDKYRKQDVRAARGTTLTAKSWLTEAPLRMLMNNLDPEVAENPHELVVYGGIGRAARNWACYDAIVESLTNLENDETLLVQSGKPVGVFKTHKNAPRVLIANSNLVPHWATWEHFNELDAKGLAMYGQMTAGSWIYIGSQGIVQGTYETFVEAGRQHYNGSLKGRWVLTAGLGGMGGAQPLAATLAGACSLNIECQQSRIDFRLRTRYVDEQADNLDDALARIKKYTSEGKAVSVALCGNAADILPELVARGVRPDLVTDQTSAHDPLHGYLPKGWTWEDYQQKAETDPEGTVLAAKRAMAEHVSAMLAFSKMGIPTFDYGNNIRQMAKEMGVNNAFDFPGFVPAYIRPLFCRGIGPFRWVALSGDPEDIYKTDARVKEIVADDEHLHRWLDMARERINFQGLPARICWVGLEWRQKLGLAFNEMVRSGEVSAPIVIGRDHLDSGSVASPNRETEAMRDGSDAVSDWPLLNALLNTASGATWVSLHHGGGVGMGFSQHSGMVIVCDGTDEAAARIARVLHNDPATGVMRHADAGYEIAIDCAKEQGLNLPMIPATQGKPA

SEQ ID NO: 7748 - protein, 359 aa, Enterobacter cloacae
TEPTINKTLWRSPMAHHARWTMSQVTELFNKPFLELMFEAQQVHRQHFDPRHVQVSTLLSIKTGACPEDCKYCPQSARYKTGLESERLMEVEQVLDSARKAKNAGSTRFCMGAAWKNPHDRDMPYLEQMVKGVKEMGLEACMTLGTLNEEQAQRLSAAGLDYYNHNLDTSPEFYGNIITTRTYQERLDTLDKVRDAGIKVCSGGIVGLGETVKDRAGLLLQLANLPTPPESVPINMLVKVKGTPLADNEDVDAFDFIRTIAVARIMMPTSYVRLSAGREQMSEQTQAMCFMAGANSIFYGCKLLTTPNPEEDKDVQLFRKLGLNPHQTGVQVGDNEQQQQLEQQIFNADTDQFYNAAAI

SEQ ID NO: 7749 - protein, 269 aa, Enterobacter cloacae
RSRQRMSRRISIRFWRHCMSLVNKQAVAAAFGRAAQSYSQHDELQRLSARGLLAALGDGRFAQVLDAGCGPGGNSRYWRATGSHVTALDLSAQMLDEARQQQSADRYLVADIEAIPLEDALFDLVWSHLAVQWCASLPQALRELYRVARPGGAVAFTTLLESSLPELNQAWRAVDAQPHANRFLSHEQVTQALAGWRYRSVVQTVTLEFSDALSAMRSLKGIGATHLHAGREKKPLTRGQLQRLELAWPQERGRFPLSYHLFHGIIERD

SEQ ID NO: 7750 - protein, 238 aa, Enterobacter cloacae
TLRIYDSRMILTEPEWQAVLLSLKVSSLAVALSLPFGVFFAWLLVRVKFPGKALLDSVLHLPLVLPPVVVGYLLLISMGRRGVIGEWLYDWFGLTFAFSWRGAVLAAAVMSFPLMVRAIRLALEGVDIRLEQAARTLGAGRWRVFLTITLPLTLPGIIVGTVLAFARSLGEFGATITFVSNIPGETRTIPSAMYTLIQTPGGEGAAARLCIISIVLALVSLLVSEWLARLSRERMGKS

SEQ ID NO: 7751 - protein, 89 aa, Enterobacter cloacae
IKSIRRFSPRYGSAFRRRMSHWSCNRRCKPVSAIFCAQKWRSVLMITARWKCSWKWAAERCGRASARGPGMSWVSSLACGFTRKSRAFP

SEQ ID NO: 7752 - protein, 332 aa, Enterobacter cloacae
DGLRAGAESFVSTRVSGAGSMKLWHPVSPQVWQGRDDSAESSTAKRLFQTIQQREHFSPVPSGIALLGFECDEGVKRNQGRPGAAQAPDVLRGALANMASHQGHARLVDMGSVYVEGHALEAAQQALSEAITACQQSGMRTLVFGGGHETAWAHGRGVLDAFPNDRIAVINLDAHLDLRKAERATSGTPFRQLAHYCASQSRVFHYACLGVSRAANTQALWEEAERLNVTLVEDLDFRRDALSALDSVLTQADRVYLTVDLDVLPAAEMPAVSAPAALGIPALDLFPVIERICRSGKLQAADLVEFNPHYDRDGQGAKLAARLAWQIAHWWA

SEQ ID NO: 7753 - protein, 278 aa, Enterobacter cloacae
ARRTCTPDGRRNPLPAVNSSVSSWPGRRSGAGSRSLIIFFMGLLNVTERYFVTGTDTEVGKTVASAALLQAARLLGKTTAGYKPVASGSEMTPEGLRNTDALALQRNSSLALAYSAVNPYTFAEPTSPHIVSADEDRPIDFSVLSSGLRDLETQADWVLVEGAGGWFTPLSDEQTFADWVQAEQLSVILVVGVKLGCINHAMLTAQAVQQAGLRLAGWIANDVVAPGKRHAEYLATLKRGLPAPFLGEIPWLADGAEQAETGRYLDLSALCPAPSSAQ

SEQ ID NO: 7754 - protein, 117 aa, Enterobacter cloacae
  UNSURE (19)
  UNSURE (43)
  UNSURE (44)
NYSPAAYSVIRSSPMSKPXKLNSAFRPSGDQPEAIRRLEKGLXXRLAHQTLLGVTGSGKTFTIANVIADLQRPTNVLAPKKTLAGPLYGEMKEFFPEKPGGIFRLPLTTTTNPGSLP

SEQ ID NO: 7755 - protein, 275 aa, Enterobacter cloacae
VIPKNGLFLIIMKFLAGVLQTSLCASPPHIFKERKMLSLRAVNQFYGSQHTLWNVNIDFPQGICTGIVGLPGMGKSTLMNCITGKVPVESGTIIWHEAGAPPRNLLSPASAFTAPPTIGYVPQDRRIFSQLTVDENLHIAMRATGKPDPTSKSDVYALFPELYPLRQSRASSLSPDDQYQLALASALVNRPRVLILDEPMHGAGHGFARRLGQLLVRLNRELGMTVLLAEQQLSFIRRVADRFCMLYRGRNVAQGHVNELDDDLIAHWMARDIRR

SEQ ID NO: 7756 - protein, 165 aa, Enterobacter cloacae
VSNEENRMKIISKDLRDGEKLPERHVFNGMGYQGDNISPHLAWDDVPAGTKSFVVTCYDPDAPTGSGWWHWIVANLPADTRVLPQGSGSDLVALPDGAIQTRTDFGKAGYGGAAPPKGETHRYIFTVHALDVDKIEVDEGASGAMVGFNVHFHSLGSASITAMYS

SEQ ID NO: 7757 - protein, 378 aa, Enterobacter cloacae
SEELHPCALFLGDGSQCSTVDAFFINLPKQPDFVVGPAGAQGVTHTSIQAAVDAAITKHSASRQYIAILPGEYEGTVYVPAAPGSITLYGLGEKAVDVKIGLAIDSEIDSTTWRHLVNPAGKYMPGKPAWYMFDNCQRKRAATIGVMCSAVFWSQNNGLQLQNLTIQNTLGDSVDAGNHQAVALRSDGDKVQINNVNILGRQNTFFVTNSGVQNTLQNNRLTRTLVTNSYIEGDVDMVSGRGAVVFDNTDFRVVNSRTQQEGYVFAPATQSNLFYGFLAVNSRFTAAGDGVAQLGRSLDVDSATNGQVVIRDSVINEGFNMAKPWADAAISKRPFSGNTGTVDDKDNVQRNLNDANFNRMWEYNNRGLGSKVVAEPKQ

SEQ ID NO: 7758 - protein, 449 aa, Enterobacter cloacae
LSVRFILVNLKLFKMVYKSIMTQDDLAFDKQHIWHPYTSTTRPLPVYPVASAHGCELHLASGERLVDGMSSWWAAIHGYNHPRLNAAMKAQIDQMSHVMFGGITHQPAVDLCRRLVAMTPESLECVFLADSGSVAVEVAMKMALQYWHAKGETRQRFLTFRNGYHGDTFGAMSVCDPDNSMHSLWKGYLPENLFAPAPQSRFDGEWDEMDMVGFARLMAAHRHEIAAVILEPIVQGAGGMRIYHPEWLKRIRKMCDREGILLIADEIATGFGRTGKLFACEHAGIAPDILCLGKALTGGTMTLSATLTTRQVADTISDGDAGCFMHGPTFMGNPLACAVASESLAILESGAWQTQVAAIEAQLKQQLSAAAEAEYVADVRVLGAIGVIETKHPVNMAALQRFFVDQGVWVRPFGKLIYLMPPYSISADQLRKLTGAVVEAVNTSAHFAI

SEQ ID NO: 7759 - protein, 166 aa, Enterobacter cloacae
YKKAGYFVYPDKTCIPRSITLNISRISRLALALAFGVTLSACSSTPPDQQPSEQVAPGTASRPILSAAEAKNFTRAHYFSAMDPNAAPWTLFLLTCRNSQTSLSARPGRRALHTPLFRQPLMPQSPNTAHLVSTLPSCRVNTKEPFMFRRHREALHFTAWAKKRST

SEQ ID NO: 7760 - protein, 300 aa, Enterobacter cloacae
IVVRDFAGFRSRCTIPTDLKFNINPEEKMTSRVIALDLDGTLLTPQKTLLPSSLEALKRAQEAGYQLLIVTGRHHVAIHPFYQALGLDTPAICCNGTYLYDYQAKKVLASDPLPVTQALQLIDLLDEHAIHGLMYVDNAMVYERPTGHVIRTSNWALSLPEAQRPVFTQVSSLRQAAEDVEAIWKFALTDEDTAKLNTFAKLVEHTLGLECEWSWHDQVDIARKGNSKGRRLTQFVESQGGSMQDVIAFGDNYNDISMLEAAGTGVAMGNADDAVKARADVVIGDNTTDSIAQYIYTHLL

SEQ ID NO: 7761 - protein, 185 aa, Enterobacter cloacae
WEACSTAGEKLGVAWLASPALAQEAPAAGPIEAQTPPVDAEPNDVVVTGSRIPQPNLEGASPVTVVNSQDLKLQGTTRVEDLLNSLPQVFAGQASTLSNGADGTATVDLRGLGPTRTLVLVNGRRLMPGDPTTSAADLNSIPAALIKRVEVLTGGASSTYGADAVAGVVDLMSSLRGRPIPPYTP

SEQ ID NO: 7762 - protein, 85 aa, Enterobacter cloacae
FDFWRIDMSRVCQVTGKRPVTGNNRSHALNATKRRFLPNLHSHRFWVESEKRFVTLRVSAKGMRVIDKKGIDTVLSELRARGEKY

SEQ ID NO: 7763 - protein, 259 aa, Enterobacter cloacae
  UNSURE (259)
ESEKMFKITVCLLTFNSERTLHDVIPPLLKIADEFVVVDSGSTDATIYICQSYGLSAIFKKYSWHGEQMNHAVSHAHNDWVLCMDSDEILDQETVDAILKLKMGDEPEPDMAWRICRHWFVLGENVRTIYPVSSPDYPVRLFNRTQSRFNNRPVDDQVEGFLHSERIPGYVRHDTFYSLHELFNKLNGYSTRLVQYQTIRPSLGRGAISAIGAFFKWYLFSGAWRQGKVGVVTGFYATAYSFLKYFKAWYQNREKKDSX

SEQ ID NO: 7764 - protein, 60 aa, Enterobacter cloacae
RGNKSWLKVFAKKIKLVSSAGTGHFYTTTKNKRTKPEKLELKKFDPVVRQHVLYKEAKIK

SEQ ID NO: 7765 - protein, 291 aa, Enterobacter cloacae
SPCIEKPRNCGVFCILHLNGGTMPELPEVETSRRGIEPHLVGATILHAVVRNGRLRWPVSDEIHALSDKPVLSVQRRAKYLLLELPDGWIIIHLGMSGSLRILTEELPAEKHDHVDLVMSNGKVLRYTDPRRFGAWLWTKELEGHNVLAHLGPEPLSEAFNADYLKEKCAKKKTPIKPWLMDNKLVVGVGNIYASESLFAAGIHPDRLASSLSAQECELLVRVIKAVLLRSIEQGGTTLKDFLQSDGKPGYFAQELQVYGRKGEPCRACGTPIIATKHAQRATFYCRQCQK

SEQ ID NO: 7766 - protein, 464 aa, Enterobacter cloacae
SMSRGISRTLISLSYHHNAQASAIHRYAAGVRVIYAAKTRRDTASSRHELLVWVICAKICRVWRIAMRGDFYKQLNSDLETARAEGLFKEERIITSAQQADITVADGSHVINFCANNYLGLANHPELIAAAKNGMDTHGFGMASVRFICGTQDSHKQLEQKLANFLGMEDAILYSSCFDANGGLFETLLGAEDAIISDALNHASIIDGVRLCKAKRFRYANNDMVELEARLKEAREAGARHVLIATDGVFSMDGVIANLKGVCDLADKYDALVMVDDSHAVGFVGENGRGSHEYCDVMGRVDIITGTLGKALGGASGGYTAARKEVVEWLRQRSRPYLFSNSLAPAIVAASIKVLEMVESGAELRERLWANARLFREKMSAAGFTLAGADHAIIPVMLGDAVVAQQFARELQKEGIYVTGFFFPVVPKGQARIRTQMSAAHSPEQIERAVEAFTRIGKQLGVIA

SEQ ID NO: 7767 - protein, 345 aa, Enterobacter cloacae
GRVMKALSKLKAEEGIWMTDVPEPEVGHNDLLIKIRKTAICGTDVHIYNWDQWSQKTIPVPMVVGHEYVGEVVGIGQEVKGFNIGDRVSGEGHITCGHCRNCRGGRTHLCRNTVGVGVNRPGCFAEYLVIPAFNAFKIPDNISDDLASIFDPFGNAVHTALSFDLVGEDVLVSGAGPIGIMAAAVAKHVGARNVVITDVNEYRLSLARKMGVTRAVDVSKESLTDVMEELGMTEGFDVGLEMSGAPPAFRTMLDTMNHGGRIAMLGIPPSDMSIDWNKVIFKGLFIKGIYGREMFETWYKMAALIQSGLDLSPIITHRFSIDEFQQGFDAMRSGQSGKVILSWDK

SEQ ID NO: 7768 - protein, 378 aa, Enterobacter cloacae
PARRRLRQAVQDRCRRRNGIYGLAEPRRISMKILVIGPSWVGDMMMSQSLYRTLKARYPQAIIDVMAPAWCRPLLSRMPEVNEAIPMPLGHGALEIGERRKLGHSLREKRYDRAYVLPNSFKSALVPFFAGIPHRTGWRGEMRYGLLNDARVLDKEAWPLMVERYVALAYDKGVMRSAKDLPQPLLWPQLQVSDGEKSHTCNAFGISSERPMIGFCPGAEFGPAKRWPHYHYAELAKQLIDEGYQIVLFGSAKDHEAGNEILATLSTEQQAWCRNLAGETQLEQAVILIAACKAVVTNDSGLMHVAAALDRPLVALYGPSSPDFTPPLSHKARVIRLITGYHKVRKGDAAEGYHQSLIDITPQRVLEELNALLLSEEG

SEQ ID NO: 7769 - protein, 328 aa, Enterobacter cloacae
RMRVLIVKTSSMGDVLHTLPSLTDAMRAIPGIRFDWVVEEGFAQIPTWHEAVDRVIPVAIRRWRKAWFSAPIKAERKAFREAVQARRYDAIVDAQGLVKSAALVTRLAHGVKHGMDWQTAREPLASLFYNRRHHIAKQQHAVERTRELFAKSLGYAKPEAQGDYAIAQHFLRETEEHAEPYLVFLHATTRDDKHWPETHWRRLIELMQPCGIHIKLPWGAEHERQRAERLAAGFSHVEVLPKLTLAQVAAQLAGANAVVSVDTGLSHLTAALDRPNITIFGPTDPGLIGGYGKNQHQMVSPTQQTKDISADAIFSFLQGSHRLSNRDI

SEQ ID NO: 7770 - protein, 370 aa, Enterobacter cloacae
PMSYVFLLILLFPVKLIRKLFRKDTGKNLVIQTAKIGDFINATPLLAWLQKSDVLISRSVGALAKHDETIEQIYFIEQHKRNLWRKLCFACRIMNRYDNVYLLQPNSVNLFFAAVCNAKNKQFLSIYTRRWYHGIFYLAADGTVEHGKKTLSVANYLKLADRSLTWQDSPKHATKPLFKPTTWPAILDKPDVIRIGISIAAGNKAKTVPPVIWKRIVDQLADLPCEFYVFGAPNEQSWMDDITRLYGEIPNFINLIGKISLEELPWAISKMDCYIASDSGNVYIADAVGVPVVLLFGPCCHYEQRPLGNVMLIGNDDNICSYVFETRYYFPQEREALFSVTDSALHDLQQFVRTLPKARSLASATDAQGN

SEQ ID NO: 7771 - protein, 361 aa, Enterobacter cloacae
YNADKMMMNNLPDTPDLRILLIKLRHHGDMLLTTPVINSLRQKWPEAQIDVLLYEETRDMLAAHPAIGTIYGIDRKWKQLGTLKHLQKEWQLLRALRAQHYHLVINLADQWRSAIVTRFTGAPVRLGFAFNKRKNAFWRFCHSELVSVASHQSLHTVEQNLSILSALPVMANPTVTMAYSADDWRHAHQKLTQKGVGDRYIVIQPTSRWFFKCWDEGKMAQTIAALQQDGHTIVLTAGPDKKELAMIDRILAASPQTGVVSLAGQLTLRQLASLIDHAILFIGVDSVPMHMAAALQTPCVALFGPSKLTFWSPWQVNGEVIWAGNYGPLPNPDAIDTKTTERYLDAIPVDAVVSAARRYLQ

SEQ ID NO: 7772 - protein, 348 aa, Enterobacter cloacae
RHLPAIHCFGRQPKIIRFHMQNSAPLLSVVVAVYNGEAFLDQFFTCLVNQHIDSMEVIIVNDGSTDRSMQIVEKWREKLPQMQVIEQPNQGVSIARNTGLAVATGQYLSFPDIDDVFKPGMYQRLLDMAVTQNLDVATCNGNYVWENNKKPSRPIFPEVKLASTGVMNGAVWLKKALDSRKFLHVTWLNIYRHDFIRQHGFRFEPGLRHQDIPWTTEVLLAAERVQYTSERFYDYYIHSASVSHTPDNDDTLIRSARHYMKILKMLDAINQRYPDKVKNIPACHWQIAKEGLGIIHTFDNMKDEAKKAMIIKEFFDTGIWKLIWKSAKSPRLRWRLGRRYFRLKRYLA

SEQ ID NO: 7773 - protein, 436 aa, Enterobacter cloacae
NFPAETKKTDNRLELLYTALLYIIQPLVWLRLLLRSRKAPAYRKRWAERYGYCRNKVAPDGILLHSVSVGETLAAIPLVRALRHRYPSLPITVTTMTPTGSERVMSAFGKDVHHVYLPYDLPCAMNRFLNTVRPKLVIVMETELWPNMISALHARKIPLVIANARLSERSAKGYGKLGKFMRRLLSKITLIAAQNEEDAARFIALGLKRNQLAVTGSLKFDISVTPELAARAVTLRRQWAPRRQVWIATSTHDGEEAIILQAHRQLLEKFPDLLLILVPRHPERFKDAREMVQKGGFSFTLRSSGEIPSGSTQVVIGDTMGELMLLYGIADLAFVGGSLVERGGHNPLEPAAHAIPVLMGPHTFNFKDICAKLQQADGLITVTDADSVVKEVSTLLTDEDYRLWYGRHAVEVLHQNQGALTRLLQLLQPYLPQRSH

SEQ ID NO: 7774 - protein, 406 aa, Enterobacter cloacae
HTDSDMPQKRKILLLDTGKEWGGGTNSMLELLKRINREKFDITCCFYSDYSRAEGETIGQVLNSIGIPLLVIPQRKQPAWAKLLKEAGRGLLFFSRSARKAFTRHIDTLWRIRPNVSKIETIFREGGFDTLYMNNQPGSNEEGYLAGANLHARIIQHCRIEPVLTPPLVKLVNTHATKIIAVSHGVERVLLQHGVRPALCTTVNNAIDIHQPLPDRRAMRQRLNIDDDTFVFGSVGSLIPRKANHHTLEALAQFNQRHPQAKWKMVLVGEGAERGALTAQADALGIAEHVIFTGFQNTPFDYLATFDAFILASKSEGLPRVVLEAMLLNIPVIGSKVTGTAELIDHESTGLLFPWSDVSQLAQHLDNIWQDPALRARLAAAAHQNVCNMYAIESYVNGVEAVLGAQ

SEQ ID NO: 7775 - protein, 324 aa, Enterobacter cloacae
RSGYSPTHTSKVTVMIIVTGGAGFIGSNIVKALNDKGITDILVVDNLKDGTKFVNLVDLNIADYMDKEDFLIQIMAGEEFGEIEAIFHEGACSSTTEWDGKYMMDNNYQYSKELLHYCLEREIPFLYASSAATYGGRTSDFIESREYEQPLNVYGYSKFLFDEYVRQILPEANSQIVGFRYFNVYGPREGHKGSMASVAFHLNTQLNNGESPKLFEGSDGFKRDFVYVGDVAAVNLWFLENGVSGIFNLGTGRAESFQAVADATLAYHKKGSIEYIPFPDKLKGRYQAFTQADLTNLRAAGYDKPFKTVAEGVTEYMAWLNRDA

SEQ ID NO: 7776 - protein, 405 aa, Enterobacter cloacae
GIMEKIKPRLYQLTIALSLISLILALVSSGKQREFFYIAIYVSIIGLAFEYKKITLRPFTIALPILLIGLLNLGWYLLYEYHNEGLNLYSDYLGASKKLILASVLIFYIDRFKFYIDKDTFRKFFFFATALGFVLATGYGLWQASQGMTRVEMAINRATVSAYVYSVLSLAFVYSLYLQQNVKLYVVAGFTILISYFVILLTGTRAAMGLYLLLAIVLTLYHFRKIHLKSALIFLCIVAGVVIVSYKPLISSKIKQTQREVERYQQGFDRTSLGARFSMWTVGIENGLAHPLGQSLEQREAWTRQYIKDGHPHLGSALEYIKVHLHNEFIEKYSLQGIPGVTVMLFFFVSMIAYALRNRNALLLTSMLLLLLYGLTDVILLSSEALIFFMILFALSTPFSQTKQQ

SEQ ID NO: 7777 - protein, 383 aa, Enterobacter cloacae
KTIKSAYFALSKITGLIMRILMIIDGLPGGGAEKTVLTLSSGLTELGHQVTLFSLRKVCDYAIPEGIDFQIVQDTCKKPWRKLTEIPRRARLLDRAIENAERSGKFDVVFSHLHKTDRIVAHSRVLDRDKVWFCVHGMFSFSYLRHRSGLSRWFKHYKIRHTYENRNVVAVSGAVLHDLSQVLAIPLRRKAVIHNPFDIPEIQRLAEAPFEMQGQDYIIHVGRFHEHKRHDRLLRAFALSKIDASLVLMGKGSDAKINQLKQLAAKLGIENKIVFRPFETNPYPWIKGARLLVLSSDCEGFGNVLVESIICQTPPVSTNCPGGPAEILTGPLARGLTALTDESLAKTLAELYASPPVVDRETIASFGINAICQQYIALVDNQK

SEQ ID NO: 7778 - protein, 191 aa, Enterobacter cloacae
MPLMNSPLKMTLFQSMDISDGGIPSIAIRPPWFMVSSMVRNAGGAPDISRPTSKPSVMPSSSITSVRLSFETSTARVTPILRASDRRYSFTSVITTLRAPTCFATAAAIIPMGPAPETSTSSPTRSKESAVCTALPNGSKMEARSSEILSGILNALNAGITRYSAKQPGRFTPTPTVLRHRWVRPPRQLRQ

SEQ ID NO: 7779 - protein, 309 aa, Enterobacter cloacae
RYRRSRKLIFMAFLSVIIAAHNAEATLHATLSSLLAAIGQDTEVIIFNDNSEDATQAIIEEWSPKFPQIITRTVNFRNVGRVRNSAVALASGEYITMLDSDDCLKPGSLGDAIAFLKAQRPDMLLTRLLEIRDPRKMTSDWQGFNPVPLPRNEAVARFLRHKDFQAHLIGQFIHRSLYESNPIPPMLCYEDFAVFPGMLMQSNKIVYQRQGHYYYIKRRDSLSSTLDASKISTLVECTLQMERTFPSSYKHLVNCHWFDIYSNHRSCLTDQQLQLVKQRVKAMYTLSFFLSTDVRFSYKKRVIEALWKK

SEQ ID NO: 7780 - protein, 386 aa, Enterobacter cloacae
CCRLRRKEIPAMKLHRLAIVRQKYRPDGGAERFVSRALTALSNQNLELNVITREWQGEKQDDWHIHICDPRKWGRISRERGFAHAARALWQQQQFDIVQSHERIPGCDIYRAGDGVHRRWLLQRTRILPAWRAKLLMHDRYHRYVMNAEREMYQAPELKAVICNAEMIKREIVEDFDIDAKKIHVIYNSIDSSRFVPAEERQRAVLRQQFGLPADAVIFCFVGSGFERKGLASAIRAIAGTSAWLVVVGQDKAESRYRDLARSLGCEGQIRFLGMQKETLPFYQLSDGLLLPTLYDPFPNVILEAMACGLPVITSESCGGSEFIEQGQNGFYCDALDIHTLKEAVMSIPSLEKNNNMGLAARERVREATPEKLSSQLISLYQKLLD

SEQ ID NO: 7781 - protein, 282 aa, Enterobacter cloacae
SPASEPGRTDPSAATSATLSAAAEPLMSTRLSVVMIAKNAADLLPDCLASVAWADEIVILDSGSTDNTADVARAAGAKVFTDTDWQGYGIQRQRAQGYATGDYVLMIDTDERVTPELRQAIQTVLAAPQPGAVYSIARRNYFLGRFMRHSGWYPDRVMRLYARERYQYNDNLVHESLACDNAQVIPLTGDLLHLTCRDFASFQRKQLNYATAWAQERHARGKKATLTGIFTHTLGAFLKTLLLRGGVLDGKQGWLLAVVNAQYTFNKYTELWALNRGYSEKT

SEQ ID NO: 7782 - protein, 160 aa, Enterobacter cloacae
AMSTKAIYPGTFDPITNGHIDIITRAACMFDKVIMTISASPSKKPMFDLNERVQLATDAISHLSNVEVVGFSDLMANFARDRHANILIRGLRAVADFEYEMQLAHMNRHLMPELESVFLMPSKEWSFISSSLVKEVARHHGDVTHFLPVNVHQALMEKLK

SEQ ID NO: 7783 - protein, 133 aa, Enterobacter cloacae
SVNRQRGMSSLALVLLLLVLGTLILTGLNQQLQTFSTLVSGESLSVRQQAAVQSALEWGRVQEWALQPEVQCKQTQRLRVCVRLFGERVLLIAGNDDLLLWQGGDIAEGQIRFSAHGWSDFCPLKESTLCQLP

SEQ ID NO: 7784 - protein, 968 aa, Enterobacter cloacae
CSRDKEVVMPGSTLFKAFVLFIALWAPVTQADSGWQPVKETIRKSDKDTRQYQAIRLDNGMTVLLVSDPQAVKSLSALVVPVGSLEDPDAHPGLAHYLEHMTLMGSKKYPQPDSLSEFLKMHGGSHNASTAPYRTAFYLEVENDALDGAVDRLADAIAAPLLDKKYADRERNAVNAELTMARTRDGMRMAQVSAETINPAHPGSRFSGGNLETLSDKPGSPVLDALHAFREKYYSANLMKAVIYSNKPLPTLANMAAQTYGRVPNKNIDLPQINVPVVTDAQKGIVIHYVPALPRKVLRVEFRIDNNTAQFRSKTDELVTYLIGNRSPGTLSDWLQKQGLVEGIRADSDPVVNGNSGVLAISATLTDKGLAHRNDVVAAIFSYLSLLRDKGVDKRYFDELAHVLDLDFRYPSITRDMDYVEWLADTMIRVPVEHTLDAVNIADQFDAGALKARLAMMTPQNARVWYISPNEPHNKMAYFVDAPYQVEKISEQTFAGWQKKAGEIALKLPELNPYIPDDFSLIKPAKAYPHPELIVDEPTLRVVYTPSRYFADEPKADVSVVLRNPKAMDSARNQVLFALNDYLAGIALDQLSNQAAVGGISFSTNANNGLMVNANGYTQRLPQLFQALLDGYFSYTPTEEQLEQAKSWYAQMMDSAEKGKAYDQAIMPAQMLSQIPYFQREDRRAILPSVTLKEVLAYRDALKTNTRPEFLVVGNMSEDQAKTLAQNVRAQLGSKGDEWCRNQDVLVEKKQNVIFEKAGSSTDSALAAVFVPVGYDEFTSSAQSAVLGQIIQPWFYNQLRTEEQLGYAVFAFSMNVGRQWGLGFLLQSSDKQPAYLWQRYQAFFPQAEAKLRAMKPEEFAQIQQAVIAQVMQPPQTLGEEASQLSKDFDRGNMKFDSRDKIVAEIKQLTPQKVADFFHQAVVKPQGMAILSQVSGSQNGKTDYVKSKEWTVWKSVSALQQTMPWSKKE

SEQ ID NO: 7785 - protein, 445 aa, Enterobacter cloacae
MTVYASFVKVFGQFGRFVHQSDFLLGRSMSGSNSAISRRRLLKGAGAMWLLSVSQVGLAATSQVVAVRVWPSSTYTRVTVESNRVLKYKQFALSNPERVVVDLEGVNLNSVLKGMAAQIRGDDPFIKSARVGQFDPQTVRMVFELKQNVKPQLFALAPVAAFKERLVMDLYPANATDIQDPLLALLEDYNKGDLDSQVPPAQSGPKPGKAGRDRPIVIMLDPGHGGEDSGAVGKYRTREKDVVLQIARRLKALIDKEGNMRAYMTRNEDVFIPLKVRVAKAQKQRADLFVSIHADAFTSRQPSGSSVFALSTKGATSTAARYLADTQNASDLIGGVSKSGDRYVDHTMFDMVQSLTITDSLKFGKAVLGKLGRVNKLHKNSVEQAGFAVLKAPDIPSILVETAFISNVEEERKLKTAKFQQEVAESILAGIRAYFSDGETLARRG

SEQ ID NO: 7786 - protein, 292 aa, Enterobacter cloacae
QMNSGYLHFPEFDPVIFSIGPVALHWYGLMYLVGFVFAMWLAGRRASRPGSGWTKNEVENLLYAGFLGVFLGGRIGYVLFYNFPVFLNDPLYLFRVWDGGMSFHGGLIGVILVMVIFARRTKRNFFQVADFIAPLIPFGLGAGRLGNFINGELWGRVDPSVPFTMLFPGSRAEDIALLPSHPEWQSIFDTYGVLPRHMSQLYELALEGVVLFIILNLYIRKPRPMGAVSGLFLIGYGAFRIIVEFFRQPDAQFTGEWVQYISMGQILSIPMIVAGAIMMIWAYRRRPQQQLS

SEQ ID NO: 7787 - protein, 266 aa, Enterobacter cloacae
GIMKQYLELMKKVLDEGTPKNDRTGTGTLSIFGHQMRFNLQEGFPLVTTKRCHLRSIIHELLWFLQGDTNVAYLHENNVSIWDEWADENGDLGPVYGKQWRAWPTPDGRHIDQITTVINQLKNDPDSRRIIVSAWNVGELDKMALAPCHAFFQFYVADGKLSCQLYQRSCDVFLGLPFNIASYALLVHMMAQQCDLEVGDFVWTGGDTHLYSNHMEQTHLQLTREPRALPKLVIKRKPDSIFDYRFDDFEIEGYDPHPGIKAPVAI

SEQ ID NO: 7788 - protein, 192 aa, Enterobacter cloacae
CRRRRCMPVNRKGFSLLEVLIAMTISSILLLSTSRFLPGLQRGVLLQSGQQELEDEVWQRLFAVGKQFQRAGYCAGHCQGQGMIIGRQGRCAIVQWDANSNGQWDSTASENDSTGFRLESGSLETLRGATSCDGKGWDKLTDPDRVLIEQFMVTKTDRAGFAPVISIELRARRKGELTAPFSARHTVTGFNL

SEQ ID NO: 7789 - protein, 616 aa, Enterobacter cloacae
PVCSKHGGDGMTMQDLLLDAVEQRVLRQLDVQFAMMIAADQPAVMLAAALLSKDAGEGHVCLPLSRLVVDEKMPPVLQSCFALLGDKVDWQKILRESSAVGPGDNQAPLILTGERLYLNRLWRNELTVARFFSETNAPLPCDEAQLRQTLDRLFDSGEDTDWQKVAAAVALTRRISVISGGPGTGKTTTVAKLLAALIQLSGEQRCRIRLAAPTGKAAARLTESLGGAMQQLPLTQEQLALFPGEASTLHRLLGAQPGSQRLRYHAGNPLHLDVLVVDEASMIDLTMMSRLIDALPPHARVVFLGDRDQLASVEAGAVLGDICTYASYGYTAARAQELARLTGCSLEPDHTPIAGALRDSLCLLQKSYRFGSDSGIGQLAAAVNRGDRHATRTVFDGTFTDIEKKSLQSGEEYQAMLEEALQGYQHFLSCVQQCSQPGQVIAAFGEYQLLCALREGPFGVTGLNDRLEQLLVQKRKINRQLHSRWYEGRPVMISRNDSALGLFNGDIGIALDRGNGLRVWFQLPDGSVKSVQPSRLPEHETAWAMTVHKSQGSEFNHAALILPTQLSPVVTRELVYTAITRARQRLSLYADERVLSQAIATRTERRSGLSAIFESV

SEQ ID NO: 7790 - protein, 119 aa, Enterobacter cloacae
RGSFRPRGEDLASTRNWLRYKLPKRLVRWDTKPVCIGQKQKWFLLQLVGNDSDINMQTSSTPEFDGWRWVSYWYPVRQVVSFKRDVYRRVMKEFASVVMQLQETPPKPQSAPAWRRKRG

SEQ ID NO: 7791 - protein, 752 aa, Enterobacter cloacae
ATQIMLTRLREIVEKVASAPRLNEALNILVTDICLAMETEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLAALFGQYRHTRIRALPASPGVAIAEGWMDATLPLMEQVYEASTLDEALERERLTAALEEAANEFRRYSKRFAAGAQKETAAIFDLYSHLLSDARLRRELFAEVDKGSVAEWAVKKVIEKFAEQFAVLTDGYLKERAGDLRALGQRLLFHLDDTIQGANAWPNRFVLVADELSATTLAELPQDRLAGVVVRDGAANSHAAIMVRALGIPTVMGADIQPSVLHRRTLVVDGYRGELLVDPEPVLLQEYQRLISEENELSKLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEIDEARRLIERAGREVEEMIGYAIPKPRIGVMLEVPSMVFMLPQLATRVDFISVGTNDLTQYILAVDRNNTRVASIYDSLHPAMLRALAMIAREAEQHNIDLRLCGEMAGDPMCVAILIGLGFRHLSMNGRSVARVKYLLRHIEQDEARELAARSLEAQLAAEVRHQVAAFMERRGMGGLIRGGR

SEQ ID NO: 7792 - protein, 171 aa, Enterobacter cloacae
SSGLTLAPFLLFLHTPAMKNEQGFTLIETLIAVSLAVILSATGLYGWDSWQQRQRLWQTACQVRDYLVFLRNDANRHNSEHRIALYNDGEKNCLTSSAVTGCDSGGPFVMKPMWPGVTISDITPALGFYGLRDTAWAGHIRVQSRAGGWWVIVSNGGRIRLCNAAGEGACQ

SEQ ID NO: 7793 - protein, 111 aa, Enterobacter cloacae
GKYAMSVTLSRQKGFSMVEVLLAMMLLVVVVTALSGYHRALAARYAALSQYRQLWHHAWNQSQISTLTLPPGWQVSRGQTTQSGCVSITVTLISPMGRQGALTRLHCPVSR

SEQ ID NO: 7794 - protein, 1128 aa, Enterobacter cloacae
SGAFMLRVYHSNRLDVLEALMEYIVEQERLDDPFEPEMVLVQSTGMAQWLQMSLSQKFGIAANIDFPLPASFIWEMFVRVLPDIPEQSAFNKQSMAWKLMTLLPDMLARDEFAMLRHYLNDDTDKRKLFQLASRTADLYDQYLVYRADWLIRWEAGELVDGLPEAQIWQAPLWKALVEHTGKLGQPKWHRANLYDRFISILENSAERPARLPSRVFICGISALPPVYLNALKALGKHTDIHILFTNPCRHYWGDIQDPRWLSRLVTRQRKRLFEERAVPLFKDSENAAQLFDEEGIQNLPNPLLASWGKLGRDYIYLLSDITSSGEGDVDAFADITPDSLLHNIQLDILDLENRAVAGITAEEFARSDKKRKLDPDDRSIAIHVCHSPQREVEILHDRLLAMLQDDPTLTPRDIVVMVADIDSYSPFIQAVFGSATGDRYLPYAISDRRARQSHPALQAFISLLSLPDSRFISEDVLALLDVPVLAARFNINEEGLRYLRQWVNESGVRWGIDDDNVQEFELPATGQHTWQFGLTRMLLGYAMESIHGEWNDVLPYDESSGLIAELVGHLATLLMQLNRWRRALMQPRLLEEWLPVCREMLNDFFLPDSETEAAMALIEKQWQAIVDEGVNSHYHEAVPLSLLRDELTQRLDQERISQRFLAGPVNICTLMPMRSIPFKVVCLLGMNDGIYPRALPPLGFDLMSAQPKRGDRSRRDDDRYLFLEALMSAQSRLYISYIGRSIQDNSERFPSVLVQELVDYIGQSHYLPGDEACNCDESERRVIAHITCHHSRMPFDPVNYVPDELQSYAREWLPAAKKAGTPQTDFIQALEPRAIDTLTFEQLQRFWAHPVRAFFQQRLQVNFRSEESEIPDAEPFILDGLERFKLNSQLLNALVDEEDASKLFRRYRASGLLPYGAFGEIVWDAQCEEMRALADRVIACRQPASSIEIDLDCNGMHLSGWLTHVQSDGLLRWRPSMLSVSHGLQLWLEHLVYSASGHEGESRLFVRKDGEWRFPRMEPEQALMYLSLYIEGYRQGMNKPLLLLPESGGAWIKACYDAQNDAMLTDEASLQKARSKFLQAYEGNMMVRGEGDDVWYQRLWRTLEPEYFDIITQEAQRYLLPLYKFNQS

SEQ ID NO: 7795 - protein, 1182 aa, Enterobacter cloacae
ERMTHTAEPLDPLSLPLQGERLIEASAGTGKTYTIAALYLRLLLGLGGNAAFSRPLSVEELLVVTFTEAATAELRGRIRSNIHELRIACLRQTTDNPLYASLLDEIADKQQAAQWLLLAERQMDEASVFTIHGFCQRMLSLNAFESGMLFEQQLIEDESELRYQACADFWRRHCYPLQRDIAEAVHALWKGPEELLRAIDRYLQGEAPVIKSPPPADETLASRHEKIVAKIAALKQKWNESVGEIDAIIENSGIDRRKFNRGNQGKWIEKISAWAQEETRGYQLPDALEKFSQRFLTERTKADGIVPEHPLFVAIEALLAEPLTLNDLMITRAMTEIRQAVAREKRRRGELGFDDMLSRLDEALSSENGEALASAIRTRFPVAMIDEFQDTDPQQYRIFRRIWRQQPDTALLLIGDPKQAIYAFRGADIFTYMKARSEVVAHYTLDTNWRSAPGMVESVNALFSRMETAFMFKEIPFLPVKSAPKNASLRFEVSGAEQPAMTFWLLEEEGYGVADYQAAMAQHCAAQIRDWLSAGNRGEALLWKGEQANPVKASDITVLVRSRQEAALIRDALTLLDIPSVYLSNRDSVFDTLEAQEMLWLLQAVLAPERENTLRSALASSMLGLNARDIDELNHDENAWDAVVEEFVHYRERWQKRGVMAMLRELMTRRQIAENMLASSGGERRLTDILHISELLQEAGTQLESEHALVRWLAQQIADPNSNASSQQMRLESDKHLVQIVTIHKSKGLEYPLVWLPFIANYRVQDQAYYHDRETFDAVLDLSKAETSVELAEAERLAEDLRLLYVALTRSVWHCSLGVAPVFRRRGEKTGESDFHLSALGRLIQHGEPKDAAGLRLCIESLCGDDIALHIPSLPDNSRWEMAQEPVTDLNARQITRVLADDWRVTSYSGLQQHGQSIAQDLMPKLDVDAAGVGDVPVEPTLTPHQFPRGASPGTFLHSLFEELDFTQPVSEEWVLKMLQSGGYDAHWQPVLTDWINAILQAPLTAQGFSLRQLTAKNKQVEMEFYLPVAGPLKADALDALIRQYDPLSAGCPPLNFRQVQGMLKGFIDLVFRHEGRYYLLDYKSNWLGENSAAYTQQAMAAAMQMHRYDLQYQLYTLALHRYLRHRIADYRYDDHFGGVIYLFLRGVDAADPRSGIFSTRPDAELINKMDNLFAANTEEMA

SEQ ID NO: 7796 - protein, 450 aa, Enterobacter cloacae
TFTKGCIMVKERRTELVQGFRHSVPYINTHRGKTFVIMLGGEAIEHENFSSIVNDIGLLHSLGIRLVVVYGARPQIEANLAAHHHEPIYHKHTRVTDAKTLELVKQAAGLLQLDITARLSMSLNNTPLQGAHINVVSGNFIIAQPLGVDDGVDYCHSGRIRRIDEDAIHRQLDNGAIVLMGPVAVSVTGESFNLTSEEIATQLAIKLKAEKMIGFCSSQGVVNDEGVIVPELFPNEAQARVEALEAEGDYYSGTVRFLRGAVKACRSGVRRSHLISYQEDGALLQELFSRDGIGTQIVMESAEQIRRATINDIGGILELIRPLEQQGILVRRSREQLEMEIDKFTIIQRDNLTIACAALYPFPEEQIGEMACVAVHPDYRSSSRGELLLERVAAQARQMGLSKLFVLTTRSIHWFQERGFTPVDIDSLPESKKEMYNYQRRSKVLMADLG

SEQ ID NO: 7797 - protein, 241 aa, Enterobacter cloacae
  UNSURE (18)
SSDGDLRYLSFIPLTELXMQYPINEMFQTLQGEGYFTGVPAIFIRLQGCPVGCAWCDTKHTWDKLADREVSLFSILAKTKESDKWGAGSAEDLLAIIGRQGWTARHVVITGGEPCIHDLMPLTELLEKNGYSCQIETSGTHEVRCSHSTWVTVSPKVNMRGGYDVLSQALERADEIKHPVGRVRDIEALDELLATLTDEKQRVIALQPISQKDDATRLCIETCIARNWRLSMQTHKYLNIA

SEQ ID NO: 7798 - protein, 583 aa, Enterobacter cloacae
AARRAPLSARCLLMSEKHPGPLVVEGKLSDAERMKVESNYLRGTIAEDLNDGLTGGFKGDNFLLIRFHGMYQQDDRDIRAERAEQKLEPRHAMLLRCRLPGGIITTKQWQAIDKFAHDNTIYGSIRLTNRQTFQFHGILKKNVKPVHQMLHSVGLDALATANDMNRNVLCTSNPYESELHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGFLPLEHTLAVAEAVVTTQRDWGNRTDRKNAKTKYTLERVGVETFKEEVERRAGIKFEPIRPYEFTGRGDRIGWVKGIDNKWHLTLFIENGRILDYPGRPLKTGLLEIAKIHKGEFRITANQNLIVASVPESEKARIEELAREHGLMNAVSVQRENSMACVSFPTCPLAMAEAERFLPSFTDKVEAILEKHGIPDEHIVMRVTGCPNGCGRAMLAELGLVGKAPGRYNLHLGGNRIGTRIPRMFRENITEPEILDSLDVLIGRWAKEREAGEGFGDFTVRAGIIRPVLDPARDFWE

SEQ ID NO: 7799 - protein, 249 aa, Enterobacter cloacae
PREVIMSVLDLNALNALPKVERILALAETNAQLEKLDAEGRVAWALENLPGDYVLSSSFGIQAAVSLHLVNQIRPDIPVILTDTGYLFPETYQFIDELTDKLRLNLKVYRATESAAWQEARYGKLWEQGVEGIEKYNEINKVEPMNRALKELNAQTWFAGLRREQSGSRATLPVLAVQRGVFKVLPIIDWDNRTVYQYLQKHGLKYHPLWDQGYLSVGDTHTTRKWEPGMAEEETRFFGLKRECGLHEG

SEQ ID NO: 7800 - protein, 124 aa, Enterobacter cloacae
NPAVESSGKLWDDDAVFSGGRMGKLTLLLLALLVWLQYSLWFGKNGLHDYSRVSDDVAAQQATNAKLKARNDQLFAEIDDLNGGQEAIEERARNELSMTKPGETFYRLVPDASKRNQGSAQNNR

SEQ ID NO: 7801 - protein, 185 aa, Enterobacter cloacae
YKSDAPGRLTARGILSYPYDPSGEGIMRIGHGFDVHAFGGVGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLVKAAK

SEQ ID NO: 7802 - protein, 280 aa, Enterobacter cloacae
PSSYASGCRQVALPPVLSGNLSTRRVIMRILLSNDDGIHAPGIQTLAKHLREFADVQVVAPDRNRSGASNSLTLESSLRTFTFENGDIAVQMGTPTDCVFLGVNALMRPRPDVVVSGINAGPNLGDDVIYSGTVAAAMEGRHLGFPALAVSLNGHTHYDTAAAVTCSILRALGREPLRTGRILNINVPDLPLDEIKGIRVTRCGSRHPADQVIPQQDPRGNTLYWIGPPGDKCDAGPDTDFAAVDEGYVSVTPLHVDLTAYSAHDVVSDWLDRVGVNAQW

SEQ ID NO: 7803 - protein, 67 aa, Enterobacter cloacae
  UNSURE (29)
  UNSURE (53)
  UNSURE (67)
RQIPGCWKLAPVQGIRPRSWPTLCTMSVXVERIKGLQWQARRRLKQLDLHKFXLQPPRAWKDHAWVX

SEQ ID NO: 7804 - protein, 213 aa, Enterobacter cloacae
  UNSURE (204)
RGSGHLWPARHHYQKRSGRDLIVMKTVLDNLKGKLVVSCQALENEPLHSPFIMSRMALAAAQGGAAAIRANSVVDIEAIKGLVSLPVIGIIKRDYPDSEVFITATLKEVDELMAVAPEIVALDATARKRPGGVSLDMLIAQIRTRYPSLLLMADIATVQEAVTAQALGFDCVGTTLYGYTAETAGHSLPENDCAFLKELRSAVXIPGDCRKVT

SEQ ID NO: 7805 - protein, 603 aa, Enterobacter cloacae
RRMTTQAPPSNLLPLNPEQLARLQAATSDFSPTQLAWVSGYFWGMLNQQPGAVAGVPPTAVEIPAITLISASQTGNARRVAEALRDDLLAAKLNVNLVNAGDYKFKQIASEKLLVVVASTQGEGEPAEEAVALHKFLFSKKAPKLEGTAFAVFGLGDTSYEFFCQSGKDFDSKLAELGAERLLDRVDADVEYQAAAAEWRARIVEVLKARVPKETPAQAAVTAAGTVNEIHTSPYTKEAPLTASLSVNQKITGRDSEKDVRHIEIDLGDSGLRYQPGDALGVWYQNDPALVKELVELLWLKGTEPVQVEGKTLPLSEALQWHFELTVNTANIVENYATLTRSESLLPLVGDKAKLQQYAATTPIVDMVRFSPAQLDADALIGLLRPLTPRLYSIASSQAEVENEVHITVGVVRYDIEGRARAGGASGFLADRVEEEGEVRVFIEHNDNFRLPANPETPVIMIGPGTGIAPFRAFMQQRAADEAPGKNWLFFGNPHFTEDFLYQVEWQRYVKEGVLTRIDLAWSRDQKEKVYVQDKLREQGAELWRWINDGAHIYVCGDANRMAKDVEQALLEVIAEFGGMDAETADEFLSELRVERRYQRDVY

SEQ ID NO: 7806 - protein, 216 aa, Enterobacter cloacae
ALPALGRTRSAGRQVMAAHDENVVWHPHPVTVAQREQLHGHRGVVLWFTGLSGSGKSTVAGALEEALHQQGVSTYLLDGDNVRHGLCSDLGFSDEDRKENIRRVGEVASLMADAGLVVLTAFISPHRAERQMVRERVGQNRFIEVFVDTPLAICEARDLKGLYKKARAGELRNFTGIDSVYEAPESPEIHLEGQQLVTNLVSQLLDLLRRDDIIRS

SEQ ID NO: 7807 - protein, 269 aa, Enterobacter cloacae
LSRAKRFIAWFRMRLNAIRAPHKTIDNQAQDYDMAATFSDVCAVVPAAGFGRRMQTECPKQYLSIGDKTILEHAVAALLAHSRVKRVVIAISPGDALFAQLPLANHPQITVVDGGAERADSVLAGIQAAGNAQWVLVHDAARPCLHHDDLSRLLALSETSNVGGILAAPVRDTMKRAEPGKPAIAHTVERVDLWHALTPQFFPRELLHDCLTRALKEGATITDEASALEYCGFHPTLVEGRADNIKVTRPEDLQLAEFYLTRTTPQEKA

SEQ ID NO: 7808 - protein, 90 aa, Enterobacter cloacae
EKEALADEDTLPQSERAAAVIAGLGGKDNLDDVDCCATRLRVTVKDGSKVNESALKATGARGVIVRGNGVQVIYGPHVTIIKNEVEEILS

SEQ ID NO: 7809 - protein, 798 aa, Enterobacter cloacae
QKRAGHYLSLVRGKMAQRGDEFWIEIQDIRHCVEDEGDTLTLLWMLEGRAELNTDAGRDTLEANTLAIINRHRRWQFTSETANVTLRVTLSGRWVVQLCNDFFAHDYAVPAEAGGVWPQCDALRDLLRQLLVVTLINDPHRYRLEAYRWLSEILLLLTSRFQQPARMLSRELSSAHSKRIARVIERINASYSRRITLAEIAASEYVSEAWLSRLFRKEVGISFMQYITRLRLEKAANALRLTNRPLHQIALEQGFASTRMMSDRFRRVHNMSPGEFRKARRQHPEAARVRADRREQRYPVAVDKLFSLLNEPVARGWGASPLVVHPQQEQRLDLEQLNPLSASLRRMRVVITLRELDDLLREDVRQNLEAINEAIPIEGIDIAEPFLSSRLFATGWDDPQMAGYACWYNLHQLFTWLAKKQWTVLLHTGVTTRRDLLTRFLQQSVNHFAPEITAGWHFVMHWSTQASEETREQVWLAQQKAIRTYLPQAKFGLWHRFAPVSAGVSDDTLFSSAILMQADFLACSADANELLDPAQLEVTPLSSTENYPILKVRQILAALRLRKCSLPVWLLSWNTLTGNTRATNGWFFRGALLMQNLLGLSEQVWLAGFWLNSGLQGEARANNTIDTSSLALQYNHGLPRPVYWVLWLWQRLRGEVLVNDKRVLLTRHRNGYQLLLRNVVVFNPLLSSEEAFIQRFRQQYHLHLKGMRGKWRIKCHLFDQHNGALYPLLEGVGSESGPDEEMWRWIAHKARPTLSVRDERLYDGWQLSESLESNALVLYEFTPLVPHEAETEEIHSPR

SEQ ID NO: 7810 - protein, 480 aa, Enterobacter cloacae
LLIPIRNFIRSKPPPIVPLFVVVSELLPVDYLPLFAALKDRPVLVVGTGEIADRKIAFLQRAGAQVQIVAEADFAESQIDSVVLVIAATEDRALNSRISDAAQARHRLVNVVDDQPLCSFIFPSIVDRSPLLVAISSGGTAPVLARVLREKIEALLPTSLGRMAEKASYWRNHLKTRLTSVTERRRFWERVFRGRFASLMQAGNETAAQQILEDELDNPGSTGGEIILVGAGPGDAGLLTLRGLQVLQDADVVFYDHLVTDGIRELIRRDAEQICVGKRAGEHSVPQHDTNQMLIAAAKAGKTVVRLKGGDPFIFGRGGEELQAAAEAGVPFQVVPGITAASAVTAYAGIPLTHRDYAQSVTFVTGHYKADSTPFDWSHLAQSRQTLAIYMGTMKAADISEQLIQHGRDAATPVAVISRGTRVDQHVAIGTLQDLATLAKDAPMPALIVVGEVVQLHSTLAWFQHTTDTEGFGASVINLA

SEQ ID NO: 7811 - protein, 305 aa, Enterobacter cloacae
GTVMDQKRLTHLRQLEAESIHIIREVAAEFSNPVMMYSIGKDSSVMLHLARKAFYPGTLPFPLLHVDTGWKFREMYEFRDRTAKAYGCELLVHKNPEGVAMGINPFVHGSAKHTDIMKTEGLKQALNKYGFDAAFGGARRDEEKSRAKERIYSFRDRFHRWDPKNQRPELWHNYNGQINKGESIRVFPLSNWTELDIWQYIYLENIEIVPLYLAAERPVLERDGMLMMIDDDRIDLQPGEVIKKQMVRFRTLGCWPLTGAVESSAQTLPEIIEEMLVSTTSERQGRVIDRDQAGSMELKKRQGYF

SEQ ID NO: 7812 - protein, 477 aa, Enterobacter cloacae
GAAMNTTIAQQIADEGGVEAYLHAQQYKSLLRFLTCGSVDDGKSTLIGRLLHDTRQIYEDQLSSLHNDSKRHGTQGEKLDLALLVDGLQAEREQGITIDVAYRYFSTEKRKFIIADTPGHEQYTRNMATGASTCDLAILLIDARKGVLDQTRRHSFISTLLGIKHLVVAVNKMDLVDYSEARFDEIRQSYLTFAEQLPGNLDIRFVPLSALEGDNVASQSGNMPWYSGPTLLEVLETVEIQRVVDTQPMRFPVQYVNRPNLDFRGFSGTIASGSVKVGQRVKVLPSGVESAIARIVTFDGDLDEAGAGEAVTLVLKDEIDISRGDLLVDAQETLAAVQGASVDVVWMAEQPLTAGQSYDIKIAGKKTRARVDGIQFQVDINNLTHRDVSELPLNGIGLVDMTFDEPLVLDPYQQNPVTGGLIFIDRLTNVTVGAGMVREPNAQAAVASEFSAFELELNALVRKHFPHWGARDLLGGK

SEQ ID NO: 7813 - protein, 115 aa, Enterobacter cloacae
VTVTGLAMRNSENYMITTGSEPLTTDDETTWSFPGAIVGFVSWLLALGIPFLIYGGNTLFFFLYTWPFFLALMPVAVVVGVALHSLFNGKLLYSTLITIATVVVIFGLLFLWLMG

SEQ ID NO: 7814 - protein, 359 aa, Enterobacter cloacae
SRGAAGEGGQMTDFDNLTYLHGEPQGKGLLKANPEDFVVVEDLGFEPDGEGEHILVRILKNGCNTRFVADALAKFLNIHAREVSFAGQKDKHAVTEQWLCARVPGNAMPDLSKFELEGCKVLEYARHKRKLRLGALKGNAFTLVLREVTEREDVEKRLKAINERGVPNYFGAQRFGIGGSNLLGALRWAQSGAPVRDRNKRSFWLSAARSALFNQIVSERLKKPDANQVVVGDALQLAGRGSWFVATADEMADVQSRVDAKTLMITAALPGSGDWGTQGEALAAEQSAVADAPELQSLLVREKVEAARRAMLLYPQQLSWNWWDDVTVELRFWLPAGSFATSVVRELINTSGDYANIAE

SEQ ID NO: 7815 - protein, 120 aa, Enterobacter cloacae
CGVGLVRSGRSERAMVSKRVQTLLEQLRAQGIANEQVLDALAQVPREKFVDEAFEHKAWENVALPIGQGQTISQPYMVARMTELLELTPDSRVLEIGTGSGYQTAILAHLVHHVCSRGTD

SEQ ID NO: 7816 - protein, 350 aa, Enterobacter cloacae
GLTMFSAMRHRFVALALGVCFILPAQAKNPSYGEIASMQARHIATVFPGRMTGTPAEMLSADYIRQQFADMGYESDIRAFHSRYIYTTRNKTQNWHNVTGSTVIAAHEGKTAEQIIIMAHLDTYTPLSDADVDNNLGGLTLQGLDDNAAGLGVMLELAERLKNIPTKYSIRFVATSGEEEGKLGAENLLKRMSAEEKKNTLLVINLDNLIVGDKLYFNSGQSTPSSVRKLTRDRALALARTHGVYAATNPGGNPEYPKGTGCCNDGEVFDKAGIPVLYVEATNWALGKKDGYQQRSKSKAFPDGTSWHDVRLDNQQHIDKALPQRIEHRSRDVVKVMLPLVKELAKAGKA

SEQ ID NO: 7817 - protein, 430 aa, Enterobacter cloacae
LNCMKNNQNKAVALQQKIAFSGSTIVIDSKLSSFGRKRITKMTHPIIEALRGNEARFTELRRYFHQHPEIGFEEHNTSDRVAALLQEWGYEVHRGLAKTGVVGTLKVGNGHKRLGLRADMDALPMQENNGKAWSSTVEGKFHGCGHDGHTTTLLYAAEYLARTRNFNGTLHLIFQPAEELLYGGRVMVEDGLFDLFPCDHIFGLHNMPSQPLGKIGLRDGAMMASSDTLHIEVNGVGGHGAVPEHTVDATLVACHITIALQSIVSRNITPFQPAVVTVGSIQAGHAPNIINDKVLMKLTVRTLDERVRQTVLQRIHDIAVAQAESFNATATIRHINGSPVLKNNPQANEMVRSVATDLFGQDAVAEVNAFMGSEDFAFMLEKNPNGCYFTLGAGDEPDRCMVHNPGYDFNDNILLTGAALWAALTEHNLR

SEQ ID NO: 7818 - protein, 474 aa, Enterobacter cloacae
FAPSREGCTMSTVSLTGASAYAGNDRLLAGIVMSVLTFWLFAQSVINVVPAMQNSLDIALETLTLAVSLSALFSGCFVVACGGFADKYGRMRLTMIGLILSMIGSGLLFISWEPVLFLLGRAIQGLSAACIMPATLALIKTWYDGKARQRAISFWVIGSWGGSGLSSFVGGAIATTLGWRWIFIFSMVVALAALLIIRATPESRSHDACRHKLDISGLVSFVLMLVLFNLFISKGHSWGWSSSLSLLVLCGAVIALMCFVVTGRRKGDAALIDFALFKNRAHSASVFSNFLLNGCIGTMMIASIWLQQGHHLSPLQTGMMTLGYLVTVLAMIRVGEKLLQRYGARLPMMTGPLLTATGISLISCTFLSKEVYIVTVFLSNILFGLGLGCYATPSTDTAVMNAPENKVGVASGIYKMGSSLGGAMGIAVTASLYALWLPMGTASAAQYALLFNSAICLGSAVVTWALLPTTKAPR

SEQ ID NO: 7819 - protein, 177 aa, Enterobacter cloacae
LSFLTIKAIKQLSEIKQQKSINTMNTRRRQFRAVLVNDKNCAFRYYAAVFSAFLRAMMSTTLFKDFTFEAAHHLPHVPAGHKCGRLHGHSFMVRLEITGEVDPHTGWIMDFAELKAAFKPTYDRLDHYYLNDIPGLENPTSEVLAKWIWDQMKPLVPLLSAVMIKETCTAGCVYRGE

SEQ ID NO: 7820 - protein, 107 aa, Enterobacter cloacae
HFRAISWLHINGREWKHIREVLIYAFIYEGVPSWDKTDGVVTIHVPDQPPIETRLTEGENRRTLCAIARLVNENGAIKVERINQYFKGQDEMDRAFGWGFRWSAGSK

SEQ ID NO: 7821 - protein, 101 aa, Enterobacter cloacae
GQLMINNDYPLNTLNQLRPLLIGFRKANGLTQKDLSERLGVTQQTYSRLEANPASASIERLFKVFTVLGVKISFSSATTSSERKQTEDIYKLNSPAPQEDW

SEQ ID NO: 7822 - protein, 275 aa, Enterobacter cloacae
EEIKMREPRPRHTLQVIRVPSLEVQDLGLTSFDSWLDEHGYDKTNARNNRTIWAREGGWHLKRCRNLETGTDDFWFIAFDGKGGKIYPLKTQRDYRAAYRKLEAEGYAPAVIEQMTTGAAYNLAYPRSTLKQVETATSEPMRKPDVDIQGEHCERVVTQRSGVAQGKFKALLIENFAGRCAVTGWVNGGVLDAAHIEHGTRYNPSNGILMTPTMHALFDADLMGIDPATLTVHFKPGIEVGELFEGRKITPLVYDLDLERLAVRWAEYQGLAQDQ

SEQ ID NO: 7823 - protein, 174 aa, Enterobacter cloacae; identical to SEQ ID NO: 7138

SEQ ID NO: 7824 - protein, 195 aa, Enterobacter cloacae
TKTAQLKSSELTSTSKARTKWTGHLAGDFAGAPVLNNTATKETGMSFFDKVKGAINSGRDELTRQVGRFKNKKFMQGTVAVCARIAVSSDGVSSEEKQKMMGFLRSSEELKVFDTNEVIEFFNKLVSSFDFDVEIGKGETMKYILALKDQPEAAQLALRVGIAVAKSDGNFDQDEKLASREIAIALGFDPAEFGL

SEQ ID NO: 7825 - protein, 210 aa, Enterobacter cloacae
LFYPGLLMQPSFNCLQELKMAVSLVKGGNVSLTKEAPTMNVAMVGLGWDARVTDGQGFDLDASVFAVGEDGKVLSDAHFIFFNNKTSPDGAVEHQGDNRTGEGDGDDEQVKIDLTKVSADIKKLVFAVTIYDAEARKQNFGMVSNSFMRVYNNDNGTEIARFDLSEDASTETAMVFGELYRHGAEWKFKAVGQGFAGGLAALASQHGVNI

SEQ ID NO: 7826 - protein, 420 aa, Enterobacter cloacae
SKIRRVNVNLQSGQNIPLQQSAIRLNLQYPTKSGFKGEPDTCLFLLNAQGKVSGDSDFIFYNNLSSPEGAVKLVTGSQQSSIEIALDRVPANISKIAITVVIDGEDTISGLSSLSMQAQGIAEFQAETQGRSEKAIILGEVYRHNGAWKLRALGQGFNGGLEPLAISYGVDVAQPAPQPAKPARISLEKKLETRSPRLVSLAKKASVSLTKNKLDTLEAAVAFVLDASGSMSGQFSKGNVQSVLDRIAVLAAQFDDDGEMDVWGFGEKHKKYPNVTLDNLDTYIQSIRGAGKRSAWENLPGLGGTNNEPPVMEEIVDYFKDSKIPVYVVFITDGGISKTRAIKDAIRRSANYPIFWKFVGLGGSSYGILKNLDDFTDRRVDNTHFFAMDDFGSISDEKLYDNLLEEFRPWIDETKRLGIL

SEQ ID NO: 7827 - protein, 452 aa, Enterobacter cloacae
IHLHHRRIGNYMSRKQQRLVIWMNGIKIGYWEKSKGVDSLEYLPEWVADEQGRPLSLSLPFTPGNQVWRGNVVRDYFDNLLPDSEGIRRRLAMRYKADSLEPFDLLTELGKDCVGAIQLLHDGDEPTDLYSVKYHPLTESEIAATLRNTTETLLPGRPEDNDDLRLSIAGAQEKTALLWHEDRWCMPEGNTPTTHIFKLPLGLVGNMKADMSSSVENEWLCSVLLDQYGLPVARTQIAHFEDQKALVVERFDRKWSGDGQWIIRLPQEDMCQALGVSPLRKYQADGGPGISEIMEVLSNSDRAERDKAQFFMTQIIFWMMAATDGHAKNFSISIGPQGRYHLTPLYDVLSAWPVIGHGNNQISWQKCKLAMAVRGSSNYYQIYRIQRRHWIRHGEITGLSKQQTEAMIEEIIARTPGVIERVSGLLPDQFPQQLAESIFDGMRQQCRRLAEK

SEQ ID NO: 7828 - protein, 94 aa, Enterobacter cloacae; identical to SEQ ID NO: 7141

SEQ ID NO: 7829 - protein, 347 aa, Enterobacter cloacae
NMVSTHIGFPTETVIVFIALSVGAIFIDLFMHRDDKPISLKSAALWSVFWVVVAMAFAGFLYIHHGAEVASLFVTGYALEKVLSVDNLFVMMAIFSWFAVPDRYRHRVLYWGIIGAIVFRGIFVAIGTSLLSLGPYVEVVFAIIVAWTAVMMLKSGDDDDEIEDYSQHLAYRMVKRFFPIWPKLRGHAFLLNQKEVDAELAKPENSDVTIGRGKKAALYATPLFLCVAVVELSDVMFAFDSVPAIIAVSREPLIVYSAMMFAILGLRTLYFVLEALKQYLVHLEKAVIVLLFFIAAKLGLNATDHIWHHGYSIAATTSLYVVLGVLALGILASVMFPGKPESEEKGS

SEQ ID NO: 7830 - protein, 201 aa, Enterobacter cloacae
TITNRRGYFMSVSLSKGGNVSLSKAAPSMKNVLVGLGWDARSTDGQDFDLDASAFLLASNGKVRGDSDFIFYNNLTSSDGSVTHTGDNRTGEGDGDDESLKIKLDAVPSEVDKIIFVVTIHDAQARRQSFGQVSGAFIRLVNDDNQTEVARYDLTEDASTETAMLFGELYRHNGEWKFRAVGQGYAGGLASVCAQYGINAS

SEQ ID NO: 7831 - protein, 77 aa, Enterobacter cloacae
CCQLTDLVYDGVFEVLQWLLFLSAVPPVQLLTGWCVTAKAPPDISAISALTAVKHGNCSSLTPLLNPVRTRKSLIWP

SEQ ID NO: 7832 - protein, 680 aa, Enterobacter cloacae
GMTKRLTWEQKSIVSHDTGHALVKAVPGSGKTTTLVKRVERLVKTGTDPRSILILMYNKSAQVSFTEKLKTALMSSVIPEIRTFHSLALKIVGYGERQQIIKKKDLITPSDYRYEQLVKQAYRYGFDHEANYIDPNEIENFELFIARCRAAAVTPVDAANDPTFSNIKREFIHAYGRYCELLEENSLRTFDDCLIEAVALLRNDSSLGAHFKHIIVDEYQDVNLIQHDMTRLLSKSDTSVMAVGDVNQCIYEWRGARPDFIGGLFERHYPNTKVFQLSCTFRFGHELSLMANSVIRRNSTKLTKLCVSHPSTPKTEVRLHFDNCLSKVLSNLSVSSGTQAILSRTKANLAEAEIALRLCGLPYRYLNGSSALHTRTEIGILVVGVLLSVYGDLRLLENHPNKQAIVYGFLKEAGFSWQKGQFKAALSGLMAPHADLWSALGQLFEGAQYQKDRLGRLATICQKDGEETPAIDVLRRLSMEGFIDSVGSEGVTRTGSNDQQRGVVRIGELLDSSKIDSRTFLNLILNPGEAATDCDPFILSTLHGSKGLEWDNVILIGLNEQEFPGGKPDDVYSVRTSMNTPPAEEEIEEERRLFYVGITRTKQQLNLVVPLDEGLARWLKNRWDSTPKKSPIATRFVYEAGWTACAVTSDAIYNSTVEKQKADFSKFHQWYLRDLQRLKV

SEQ ID NO: 7833 - protein, 815 aa, Enterobacter cloacae
TLTAQVEKQHKSALDSLLISEGEQASRLALLLQPPGKINGKNVLQHIDRLNSIAALGLPDGIALSVHQNRLLKLAREGRKMSSRDLAKFTDVRRYATLVCIITEARATLTDEVIDLHERILGSLFSRAKRTQAERLQQTGKLIQSKLKQYVTVGQALLNARESGEDPWTAIEDVLPWQEFINSVEETRFLSRKGNFDALHLITEKYSTLRKYAPRMLSALQFMATPAAQALSDALDTITEMYRKQLRKVPPSAPTGFIPESWRKLVLTPSGIDRKYYEFCVLNELKGALRSGDIWVKGSRRYKNFDDYLIPTAEFEKSRHNDQLQLAVQTDSQAYLQARMTLLASRLEEVNAMALAGDLPDVDISDKGVKITPLENSVPSGVSPFAGLVYGMLPHPKITEILEEVDSWTGFTRHFAHLKNNNVRPKDGRLLLTTILADGINLGLTKMAESCPGATRSSLEGIQAWYIRDETYSAALAELVNAQKERPLAAFWGDGTTSSSDGQNFRVGSHGRYAGQVNLKYGQEPGVQIYTHISDQYSPFYAKVISRVRDSTHVLDGLLYHESDLEITEHYTDTAGFTEHVFALMHLLGFAFAPRIRDLHDKRLFIHGKAERYPGLQSVISTTCLNIKDIESHWDEVLRLATSIKQGTVTASLMMKKLASYPKQNGLAKALREIGRIERTLFMLDWFRDPGLRRRVQAGLNKGEARNALARAVFLHRLGEIRDRGLENQSYRASGLTLLTAAITLWNTVYIERAIESLKRKGIPINEQLVSHLSPLGWEHINLSGDYVWRNNLKLGSGKYRSLRTVDTALYKKQS

SEQ ID NO: 7834 - protein, 341 aa, Enterobacter cloacae
AFIRRTIMENIALIGIDLGKNSFHIHCQDRRGKAVYRKKFTRPKLIEFLATCPATTIAMEACGGSHFMARKLEELGHFPKLISPQFVRPFVKSNKNDFVDAEAICEAASRPSMRFVQPRTESQQAMRALHRVRESLVQDKVKTTNQMHAFLLEFGISVPRGAAVISRLSTLLEDNSLPLYLSQLLLKLQQHYHYLVEQIKDLESQLKRKLDEDEIGQRLLSIPCVGTLTASTISTEIGDGKQYASSRDFAAATGLVPRQYSTGGRTTLLGISKRGNKKIRTLLVQCARVFIQKLEHQSGKLADWVRDLLCRKSNFVVTCALANKLARIAWALTARQQTYVA

SEQ ID NO: 7835 - protein, 98 aa, Enterobacter cloacae; identical to SEQ ID NO: 7150

SEQ ID NO: 7836 - protein, 360 aa, Enterobacter cloacae
AAVHSTASRSTTYHLPAVRSVLSWIFLGGYAVMTTQSSSIQYAYALDGEGTLTHIGAALRSHTYTCPGCKSPLTPVMGEFNAKHFRHSEECCALETYLHKCGKEAFFYRYQQALSREMPISLELERRVACNGSHLALVRDEARQCVKSVPARYNLTQFFDQAELEKHDKVTGLRPDVMLYDTTGERRCYVEICVTHPCSQDKIEAGIPILEFKVQSASDIQMLLTGAYSIKEKILRVFNWLPPFQSVDTCSGVCSVGNVDMSVWSLSGSGRLNEQTMPLAEVDLTINSDVNTWPRSLGAAELADNLRAFIRHADPHSLFPNCIMCEQAGRWEDGYLQCHSKAKIVPYTEARQCANYKVKA

SEQ ID NO: 7837 - protein, 875 aa, Enterobacter cloacae
RLFFEILRVRCFFCSDWHATPGNIRRYVLYLYIETLKQRLDAINQLRVDRALAAMGPAFQQVYSLLPTLLHYHHPLMPGYLDGNVPQGICLFTPDETQQHYLTELELYRGMPPQDSPKGELPITGVYSMGSTSSVGQSCSSDLDIWVCHQSWLDNEERQLLQRKCSLLESWAASLGVEVSFFLIDENRFRHNESGSLGGEDCGSTQHILLLDEFYRTAVRLAGKRILWNMVPCDEEENYDDYVMSLYSQGVLTPNEWLDLGGLSSLSAEEYFGASLWQLYKSIDSPYKAVLKTLLLEAYSWEYPTPRLLAKDIKQRLHDGEIVSYGLDAYCMMLERVTEYLTAIEDATRLDLVRRCFYLKVCEKLSRERACVGWRREVVSQLVKEWGWDEARLAMLDNRANWKIDQVREAHNELLDAMMQSYRNLIRFARRNNLSVSASPQDIGVLTRKLYAAFEALPGKVTLVNPQISPDLSEPNLTFIYVPPGRANRTGWYLYNRAPSMDSIISHQPLEYNRYLNKLVAWAWFNGLLTSRTRLFIKGNEVVDLAKLQEMVADVSHHFPLRLPAPTPKALYSPCEIRHLAIIVNLEYDPTAAFRNQVVHFDFRKLDVFSFGEQQNCLVGSVDLLYRNSWNEVRTLHFNGEQAMIEALKTILGKMHQDAAPPDSVEVFCYSQHLRGLIRTRVQQLVSECIELRLSSTRQETGRFKALRVSGQTWGLFFERLNVSVQKLENAIEFYGAISHNKLHGLSVQVETNHVKLPQVVDGFASEGIIQFFFEESGDNAGFNIYILDETNRAEVYHHCEGSKEELVRDVSRFYSSSHDRFTYGSSFINFNLPQFYQIVNVDGRAQVIPFRTQAITPAAPANQETAPLLQQYFS

SEQ ID NO: 7838 - protein, 295 aa, Enterobacter cloacae
RRPDSGQSLTITFCTRAMEQMMQFSKMHGLGNDFMVVDAVTQNVFFSPELIRRLADRHVGVGFDQLLVVEPPYDPDLDFHYRIFNADGSEVSQCGNGARCFARFVRLKGLTNKRDIRVSTANGRMVLSVTDDELVRVNMGEPNFEPSAVPFRANKAEKTYIMRAAEQTVLCGVVSMGNPHCVIQVDDVQTAAVETLGPVLESHERFPERANIGFMQVVKREHIRLRVYERGAGETQACGSGACAAVAVGISQGLLAEEVRVELPGGRLDIAWKGAGHPLYMTGPATHVYDGFIHL

SEQ ID NO: 7839 - protein, 249 aa, Enterobacter cloacae
RGASTRQTGEIMRFYRPLGQISALTFDLDDTLYDNRPVILRTEQESLAFVQNYHPALKTMQNKDFQKLRQSLRETEPEIYHDVTEWRRRAVEQAMLNAGLSAQDAATGAEAAMENFAKWRSRIDVPQETHDTLAKLAEKWPLVAITNGNAQPELFGLGNYFQFVLRAGPHGRSKPFNDMYHLAAEKLDLPLGEILHVGDDLTTDVAGAIRCGMQACWIKPENADLMTTPDSRLLPHVEISRLASLTTLI

SEQ ID NO: 7840 - protein, 340 aa, Enterobacter cloacae
WSETQFVSVCPPNCPIFFALGVPVMLSAFQLENNRLTRLEAEESQPLIDAVWVDLVEPDDDERLRVQSELGQSLATRPELEDIEASARFFEDEDGLHIHSFFFFEDAEDHAGNSTVAFTIRDGRLFTLRERELPAFRLYRMRARSQAMMDGNAYELLLDLFETKIEQLADEIENIYSDLEKLSRVIMEGHQGDEYDEALSTLAELEDIGWKVRLCLMDTQRALNFLVRKARLPGGQLEQAREILRDIESLLPHNESLFQKVNFLMQAAMGFINIEQNRIIKIFSVVSVVFLPPTLVASSYGMNFEFMPELKWSFGYPGAIIFMILAGLAPYLYFKRKNWL

SEQ ID NO: 7841 - protein, 307 aa, Enterobacter cloacae
NARTKLFIKCHHFRRTPPMRTYLGWLLAAVALPLTAYAQEATIKEVHDKPAVKGSIIANMLQEHDNPFTLYPYDTNYVIYTQTSDLNKEAISSYNWSDNARKDEVKFQLSLAFPFWRGILGPNSVLGASYTQKSWWQLSNSGESSPFRETNYEPQLFLGFATDYEFAGWTLRDVEVGYNHDSNGRSDPTSRSWNRIYTRLMAQNGNFMVEVKPWYVVGSTDDNPDITKYMGYYQLKVGYQLGDAVLSAKGQYNWNTGYGGAELGLSYPVTKHVRLYTQVYSGYGESLIDYNFNQTRVGVGVMLNDIF

SEQ ID NO: 7842 - protein, 631 aa, Enterobacter cloacae
TLKFLSQALKIAPVSFLAYGVNVAQAEVLNQESLAKQVLHETFGYQQFRPGQETIIETVLEGRDCLVVMPTGGGKSLCYQVPALVLNGLTVVVSPLISLMKDQVDQLLANGVAAACLNSTQTREQQQEVMAGCRTGQVRLLYIAPERLMLDNFLDHLAHWNPVLLAVDEAHCISQWGHDFRPEYAALGQLRQRFPELPFMALTATADDTTRQDIVRLLGLNDPYIQVSSFDRPNIRYMLMEKFKPLDQLLRYVQEQRGKSGIIYCNSRAKVEDTAARLQNRGFSAAAYHAGLENHIRADVQEKFQRDDLQIVVATVAFGMGINKPNVRFVVHFDIPRNIESYYQETGRAGRDGLPAEAMLFYDPADMAWLRRCLEEKPQGQLQDIERHKLNAMGAFAEAQTCRRLVLLNYFGEGRQAPCGNCDICLDPPKQYDGLMDARKALSTIGRVNQRFGMGYVVEVLRGANNQRIRDMGHDKLPVYGIGKDQSHEHWVSIIRQLIHLGFATQNIAQHSALQLTEAARPVLRGEVELKLAVPRVVALKPRVMQKSYGGNYDRKLFAKLRKLRKAIADEENIPPYVVFNDATLIEMAEQMPLSASEMLSVNGVGTRKLERFGKEFMALIRSHADGDDEE

SEQ ID NO: 7843 - protein, 156 aa, Enterobacter cloacae
ITGGGNPMFQQKKDWETRENAFAAFSMGPLTDFWRQREEDEFMGVGEIPVRFVRFRDEKNDRVIVVCPGRIESYIKYAELAYDLFHLGFDVLIIDHRGQGLSGRMLPDTHRGHVDNFSDYVDDLAAFWQQEVQPGPWRKRYILAHSMGGAISTLFL

SEQ ID NO: 7844 - protein, 152 aa, Enterobacter cloacae
GQDPAVDFTIDIAVAVPVVDTLFDGHPQGIGKAMKFTVVHGFIPVFRDGGSITLNNSRCRKAANSCFCVFSCDDRNRFELTGNLYMKNVFRTLVVLVTLFSLTGCGLKGPLYFPPEDKNAPPPTKPVQSGIESSTPDTNDRGNNGGPTQVNL

SEQ ID NO: 7845 - protein, 302 aa, Enterobacter cloacae
ARMTDGLLATDVNRFLRYLGVERQLSPITLLNYQRQLDAIMQIADEIGLKSWQQCDAATVRGFVVRSRKKNLSPASLALRLSALRSFFDWLVSQGGLKANPAKGIATPKAPRHLPKNIDVDDVNRLLDIDLNDPLAVRDRAMLEVMYGAGLRLSELVNLDLKHLDLESGEVWVMGKGSKERRLPIGRNAVSWIEHWLDLRGLFGADEDALFLSKLGKRISARNVQKRFAEWGIKQGLNSHVHPHKLRHSFATHMLESSGDLRGVQELLGHANLSTTQIYTHLDFQHLASVYDAAHPRAKRGK

SEQ ID NO: 7846 - protein, 738 aa, Enterobacter cloacae
QGFGEWKHLPARHDVTVPMDVSYLLDSLNDKQRDAVAASRTNLLVLAGAGSGKTRVLVHRIAWLQSVENCSPYSIMAVTFTNKAAAEMRHRIAQLMGTSQGGMWVGTFHGLAHRLLRAHHMDANLPQDFQILDSEDQLRLLKRLIKAMNLDEKQWPPRQAMWYINGQKDEGLRPHHIQSFGNPVEQTWQNVYKAYQEACDRAGLVDFAELLLRAHELWLNKPHILQHYRERFTNILVDEFQDTNNIQYAWIRLLAGDTGKVMIVGDDDQSIYGWRGAQVENIQRFLNDFPGAQTIRLEQNYRSTSNILSAANALIENNNGRLGKKLWTDGVDGEPISIYCAFNELDEARFVVNRIKTWQENGGALEQCAILYRSNAQSRVLEEALLQVSMPYRIYGGMRFFERQEIKDALSYLRLIANRNDDAAFERVVNTPTRGIGDRTLDVVRQASRDRQLTLWQACRELLQEKALAGRAASALQRFLELIDALAQETADMPLHVQTDRVIKDSGLRTMYEQEKGEKGQTRIENLEELVTATRQFSYNEEDEDLMPLQAFLSHAALEAGEGQADTWQDAVQLMTLHSAKGLEFPQVFIVGMEEGMFPSQMSLDEGGRLEEERRLAYVGVTRAMQKLTLTYAETRRLYGKEVYHRPSRFIGELPEECVEEVRLRASISRPVSHQRMGSPISETDTGYKLGQRVRHSKFGEGTIVNLEGSGEHSRLQVAFQGQGIKWLVAAYAKLESV

SEQ ID NO: 7847 - protein, 216 aa, Enterobacter cloacae
LTVLFPRELIMLMLFLTVALVHIVALMSPGPDFFFVSQTAVSRSRKEAMMGVLGITMGVMVWAAVALLGLNLILAKMAWLHNIIMVGGGLYLCWMGYQMLRGALKKEESKPEEPKVELATGGRSFVKGLLTNLANPKAIIYFGSVFSLFVGDNVGAGARWGIFLLIVVETFAWFTVVASLFALPAMRRGYQRIAKWIDGFAGALFAGFGIHLIISR

SEQ ID NO: 7848 - protein, 240 aa, Enterobacter cloacae
RVYPSMKQPGEELREPVTELDDSTVVDYLLHNPEFFIRNARVVERMRVPHPVRETVSLVEWHMARSRNHINQLEENMTLLMEQASNNESLFYRLLHLQARLASAHSLEEFLNRFHRWARELGLAGATIRLFPDRWRIGAPSGFTHLALSRQAFEPLRIQRLGHEHHYLGPLNGPELLVVLPEAKAIGSVAMSLMGRDGDLGVMLFTSRDAHHYEQGQGTQLLQEIALMLPELLERWIERV

SEQ ID NO: 7849 - protein, 214 aa, Enterobacter cloacae
KQTIREFQMTFEWWFAYLLTSIILSLSPGSGAINTMTTSINHGYRGAVASIAGLQTGLGIHIVLVGIGLGTLFSRSVLAFEVLKWAGAAYLIWLGIQQWRAAGSIDLHTLSRTQTRGHLFKRAVFVNLTNPKSIVFLAALFPQFIVPHQPQVMQYVVLGATTIIVDIIVMIGYATLAQRIAAWIKGPKQMKALNKVFGSLFMLVGALLASARHA

SEQ ID NO: 7850 - protein, 417 aa, Enterobacter cloacae
KRRQRCAAARITITLKWEAIMTEHEKSSAVVEETRETVDTTSQPETTDTTVEKKNGSNKTSLTLSVIAIAIALAAGVGLYGLVKKQGTNQTATSDALVNQITALQKAQETQKAELEGVIKQQAAALADANSKREELTKQLSEVQEKVATISGTDAKTWLLSQADFLVKLAGRKLWSDQDVTTAAALLKSADASLADMNDPSLINARRAITEDIASLSAVSQVDYDGIILKVNQLSNQIDNLQLADNNDDDSPMDSDGTELSSSLSEWRINLQKSWQNFMDSFITIRRRDETAVPLLAPNQDVYLRENIRSRLLVAAQAVPRHQEETYKQALDNVSTWVRAYYDTNDATTTAFLEDIDKLSQQNITMNVPDKLESQPILEKIMQTRVRNLLAQPGVPAERPAEAPAAAPAPESAPQGE

SEQ ID NO: 7851 - protein, 184 aa, Enterobacter cloacae
LPLPRFLKWHSFILKHKINILLTTRMPLQMSATLTAEETLKLVGEIFVYHMPFNRALGLELERYEKDFAQLSFNNQPMMVGNWAQSILHGGVIASALDVAAGLVCVGSTLTRHDTINEDELRQRLSRMGTIDLRVDYLRPGRGNRFTCTSSMLRAGNKVAVARVELHNEEQVYIASATATYMVG

SEQ ID NO: 7852 - protein, 302 aa, Enterobacter cloacae
RIFPMDAKQTRQGVLLALAAYFIWGIAPAYFKLIAYVPADEILTHRVIWSFFFMIALMSISRQWSGVKTLLKTPKKVFLLALSAVLIGGNWLLFIWAVNNHHMLEASLGYFINPLVNILLGMIFLGERFRRMQWVAVILAFCGVLVQLWTFGSLPVIALGLAFSFAFYGLVRKKIAVEAQTGMLFETLWLLPVAAIYLFGIADSATSHMGSNPWSLNLMLIAAGVVTTIPLLCFTGAATRLRLSTLGFFQYIGPTLMFLLAVVFYGEVPGADKMVTFAFIWVALAIFVADAIYTQRRVRKGL

SEQ ID NO: 7853 - protein, 251 aa, Enterobacter cloacae
RRAPCMSILVTRPSPAGEQLVSRLRALGQVAWSFPLIEFSPGRELPELADQMRLLQEGDLLFALSQHAVEFAHAQLQQQGVRWPHAPRYFAIGRTTALALHTASGIDVRYPLDREISEVLLQLPELQNIAGKRTLILRGNGGRELLGETLRERGADVTFVECYQRCAKHYDGAEEAMRWHARGINTLVVTSGEMLQQLWSLIPLWYRENWLLRCRLLVVSERLANHARELGWQDIRIAENADNDALLRALQ

SEQ ID NO: 7854 - protein, 119 aa, Enterobacter cloacae
RYTAAITKNRNKTMNDSEFHRLADTLWMTIEERIDDWDGDSDIDCEINGGILTLSFENGSKIIINRQEPLHQVWLAAKQGGYHFDLKGDEWVCDRSGETFWDLLEQAATAQAGEDVSFR

SEQ ID NO: 7855 - protein, 321 aa, Enterobacter cloacae
RLIMTVTSMLDNVLRIATRQSPLALWQAHYVKQRLEACHTGLRVELVPMVTRGDVILDTPLAKVGGKGLFVKELELALLENRADIAVHSMKDVPVEFPEGLGLVTICEREDPRDAFVSNRYDSLDALPAGSVVGTSSLRRQCQLAERRPDLVIRSLRGNVGTRLGKLDNGDYDAIILAVAGLKRLGLEERIRVALPPELSLPAVGQGAVGIECRLDDVRTQALLAPLNHDDTAVRVKAERAMNTRLEGGCQVPIGSYAELTDGELWLRALVGAPDGSHMVRGERRGKPQDAEALGVSLAEELLNNGAREILAEVYNGEPPA

SEQ ID NO: 7856 - protein, 407 aa, Enterobacter cloacae
KRAARRVMMLKVFLLFILLIAGIVLGPMLAGHQGYVLIQTDNYNIETSVTGLVIILILGVVVLLAVEWLLRRIFRTGVHTRGWFVGRKRRRARKQTEQALLKLAEGDYQQVEKLMSKNADHAEQPVVNYLLAAEAAQQRGDEARANQHLERASELSTKDPIPVEITRVRLQLARNENHAARHGVDRLLEITPRHPEVLRLAEQAYIRTGAWGSLLDIIPSMAKADVGDDEHRDELQRLAWIGLMDQARADLGSDGLKTWWKNQSRKTRQQVPLQVAMAEHLIECDDHDTAQEILLDGLKRQYDDRLVMVIPRLKTNNPEQIEKALRQQIKTVGDRPLLWSTLGQSLMKHGEWQEASLAFRAALKQRPDAFDYAWLADSLDKQHKPEEAAAMRRDGLLLTLQNNGTQQ

SEQ ID NO: 7857 - protein, 407 aa, Enterobacter cloacae
KDIVMNSLLYALFEALRCYRWLRLLACAFIFSSLGNGLTQVVVFGLLLQWSAPSALLTLAFLFATVPGFIGSLIGEKLCQRFSPLYLLMLTEWLGLLALLFPLSGAHYHSIPALLAVQSTEALLSGMSWPALTLLFKRGLHEAELPAATCLENVIFASQVLLGTGLGVVLFQRIPVFALLVIDAASFMGSLVMLFLAERQYVARPAPLPVGDPQPVALRWQTLTLRQKRSLLILPALAAVGSPAMALLPALAQQINPENAAGLALPLLFARSLGQLCGPLLLRKESLTRFAARTPLLLSCLALFLAAYGLLPFLSAWVVLALGMIFIAHLASNIVFAAGTFGVLSNFQAIQISAASGKAWRWQTLSASLFTGLAAMTATILGAAQTLYAVSAIALLLVALVLAHYRE

SEQ ID NO: 7858 - protein, 1026 aa, Enterobacter cloacae
PVNNSTSHSLAVKTPLSRLYLALFSAPLLLFLPADIARAADAFFDGDSRITETLGYTGDVYVGRNQRGNLLIDNGKITAYNINIGRLFDGKIYESVVTVRGPDAELNAVNDRYVLRGDLNLGLGTLRVEEGALASAKEIVVGTTRGYDSHLIATGAGSRVTSNFLSVGTDLGARSTLAIEDGAALNTAYDARIGNGTGPGETDTLSPKATVTGSGSQWNVGRTLTLYGDLDVLNGGTVNVGGVQVAGVSGAGKTAELVIAGEDSRFTSGSSVSVGDYGNGVLSVIDGGSFSAGSNALIVGTSGSGSNRGALIIGSRGNMDTGTGLTEPTLGTAGGAGTLDAKTAISLRGGLFGSYVYFNHTDGNYIFSNTMSGEGDVINTSGQTTLNGDLSALKANVTARGGKVIIASNINTQPEDDIFDVQTLSAENGGTLILNATAGSDVSNGVGYSSAASIKSGGTLGGNGTLGQTEILSGGHISPGDGTIGTLTLKRYLNFIGESFYDVDIAGDGRSDQLLVSGKTTISNQAKVQVTALDPQTSYKTGQSYRILTSDGGIDGEFAGAISKSAFLDVALKQSTNAVDLTIAQKETGGENPGGENPGGENPGGENPGGENPGGENPGGENPGGENPGGENPGGENPGGENPGGENPGSGKPGIFQTVAQSSNQWNTAGALSTLTQSGQSLALYNSLLLLSAPEAREAFNQLSGEVYPSMQSNLIAGSTQVFNVLNQRMQRAFDNDSLPIPPLAMSLVQQPEPQNNGVWGQTFSSWSRNSGDGNVGKLDGNTTGFLLGADRKLADHNVRVGGYFGYSRGDYDVDSRRSSTDTDNYHLGLYAAGQQDAFSLRGALGYTWHKIEGERNVDFSGFSDRLKSDYDANSLLAFTEAGYRFGQPDRNIEPFVNLSYIRLHTDSFREDGGAAALSVRNETMNTFYTTLGLRGVTELPKHVNLYGSLGWQHAYGDKNTSSRMAFAGSDAFITQGQAVDEDVMVGDIGVSVQLSRAATLDVGYQGQYGADTRVNSVNANLRWSF

SEQ ID NO: 7859 - protein, 272 aa, Enterobacter cloacae
PGGSPPFFRDEKNASARVRKEPRMSDQTLKATRQQSLITLLSQSDWLTTEVLAEKLSVSKETIRRDLKSLQQQGKLLRQHGRARLIHPDSRDSGEPFGARLKSHYADKADIARHALGWISEGMTIALDASSTCFHLARQLPDIDLTVFTNSLPVCHEMAKRERITLICSGGTLERKYRCYVNPALVTQLKGLEIDLFIFSCEGVDEHGVLWDPSEHNAGFKALLLNRASQSLLLIDKSKFMRASEVKIGQLSQVTQIIQSDKRQAARDGLTR

SEQ ID NO: 7860 - protein, 115 aa, Enterobacter cloacae
  UNSURE (51)
  UNSURE (53)
  UNSURE (54)
LLRNAGRVRRRRHPAGKAARAFVLLRGRFLFADQTNLQVARLMQRVHYLHXPXXGFSIIDGFIRAEEDGGVFLAAGELVQRRNNRGIRYRIVAQEHGLMALHLFITRRQEAEKVV

SEQ ID NO: 7861 - protein, 670 aa, Enterobacter cloacae
APLRRQTREQSLRHVRCDFTLLRMNMLNTRFSVSLIVIGWLCLSASLCAQPLSFMAPEERPQLEASKPWPENQFLVLAYHDVEDDAADQRYLSVRTSALNEQISWLLHNGYHAISVQDILDAHEGKKALPPKAVLLSFDDGYSSFYTRVWPLLQAWNVPALWAPVGSWVDTPANQKVNFGGLMTPRDRFATWDMVRELSQSPLIEIGSHTWASHYGIPANPQGSREPAIANRFFDNATGHYETDEHFNQRIAADVRKVTDKITQVTGKAPRAWVWPYGAANGTSLAIAQKQGYQLAFTLEDGLANVRDLGNIPRLLIAGNPSIKTFANTVSRVQEFEPVRVMHVDLDYVYDPDPAQQTKNINKLVQRVYDMKISHVFLQAFSDPRGDGRISALYFPNRRLPVRADLFNFVAWQLQTRAGVKVFAWMPVLSFDLSPALPRVQRRERQTGELTVAAEPYIRLSPWSPQVRQQVTEIYEDLARYASFNGILFHDDAVLTDVDDAGQDTTRQKSQRLIGFTRTLSQAVKNIRGPQIKTARNMFALPILEPESEAWFAQNLDDFLAAYDWTVPMAMPLMESVPAEESNAWLTRLVKAVAERPGALNKTIFELQARDWAQKPQRAVADGRLVEWMRVLQLNGIKNYGYYPDDFLNNQPDISRIRPEFSSYWYPDND

SEQ ID NO: 7862 - protein, 148 aa, Enterobacter cloacae
REHSMNESTLILTEHRLAPRLFDAALTLIAWGGFLFFLYARLWMQLTEEGDHRWNAIIASFNTVLVYLLIAAFNGWLLILWYQYNRRRAHVRRRHPEMLRHDELAQSFNVTPQIMSEMSQYNLLTVYHDQIGRIIDLKISEQQDEKEE

SEQ ID NO: 7863 - protein, 403 aa, Enterobacter cloacae
NYEASSLSIPCREGEFAQRRVLPSLSADTVENILFSLSSRHRMKTLFRKFTDKKGDIMSWHPYTGRYENMQYRYCGKSGLRLPALSLGLWHSFGHVQPLDSQRALLRKAFDLGITHFDLANNYGPPPGSAEENFGRLLREDFAGYRDELIISTKAGYDMWPGPYGSGGSRKYLLASLDQSLNRMGVEYVDIFYSHRVDENTPMEETAAALAHAVQSGKALYVGISSYSTERTAAMTKLLREWKIPLLIHQPSYNLLNRWVDKTGLLDALEKNGTGCIAFTPLAQGLLTGKYLNGIPDGSRMQREGKKVRGLTEKMLTEANLSSLRLLNEMAHARGQTMAQMALSWLLKDERVTSVLIGASRPEQLEENVQALNNLRFSEDELMRIDQHVADGELNLWQASSDK

SEQ ID NO: 7864 - protein, 807 aa, Enterobacter cloacae
LHYVILLSHHNIIVPAFTAPPVLVQADESVYEHQIQQARNGNYALFLDYLQRYEQQHALTPGQVADWLQVASWAGRDDEVIRVWQRYGIYMPLPARAIAAVAQSRRNQKAWPSALSLWKEALSLAPDNDDYRIGYVKTLADASKDRLALSEARQLVKDNPSPAHLETLSYVWMRQGKNRDRLLADMRALSAAPGNEALLRETIDALTDNRVSTPALWLSQNAALSPAERRRLERNAAAERVRLADVPGRTEKERLRLAQNALDRYHALLSRWQNDPQAAEDVILARIDRLGALYAQGNYRQVISEYESLTAAQHPVPDWAIGWVISAYLQEKNTVAAFSLVQRYPHYASDPQDEEHALFYAWLDTGQYQAARRYVERETRSVPWTRYDFGSPAAQPNDRWLTGQSLKFNYLLATNALPEAEKLSYRLASTAPGNQGLQIDYAALLQARGLPRAAEQKLKRAEALEPTNLELEKQQAYVAMDLQEWRQMDLLADNVIARAPADRSARRLDRLRMVHHMSELRLNAAKGLHSDNPVSGSHDMNWDATLYGPPVADNWRLFAGTRYAQGNFDEGKGISRHLLGGVEWRPRDLTLEAELSGNRYHGKNRPGARLSTTYSLSDNWQVSGNLERLSRATPLRALRNGISANRGEGGVRWYQNERREYQFNAAISRFSDHNRRQEYTLSGKERLWQTPTLTLDLEPGIAASKNSLRNTLYYNPARDLSVTAALSVDHEMYRHYDTLWSQQFVAGGGSYWQKNQSPGAVTLLGYGQRIQWNNVVDTGVMLNWDKRPYDGKRESNLSVTLDATLRF

SEQ ID NO: 7865 - protein, 477 aa, Enterobacter cloacae
TASKITVITPTTSSTTNLIFRVSGLNFLRTGILTMTDRIIAFSILCLVFGLPLGVAALFTGELILDFVFFWPLFMSVLWVTGGLYFWFQLERHWSWDNATPAPALAGEPLISILIPCFNEERNARETISAALDQRYWNVEVIAINDGSSDNTAEVLQQLAREQPRLRVINLAENQGKAVALKAGAAAARGDLLVCIDGDALLDRDTAAYLVAPLIQYPHVGAVTGNPRIRTRSTLIGRIQVGEFSSIIGLIKRTQRIYGRVFTVSGVIAAFRRQALADVGYWSPDMITEDIDISWKLQLRHWDIFFEPRALCWILMPETLKGLWKQRLRWAQGGAEVFLVNLRKMARWEHHRMWPLFLEYALSTLWAFAYGATVVLFILSHIIPLPANLAVASLFPPAFTGLLLGVMCLLQFLVSLYIERRYERKVAGSLFWVIWFPMVYWMIGLFTTLVAFPKVMLKRKRARARWISPDRGKGSIQ

SEQ ID NO: 7866 - protein, 178 aa, Enterobacter cloacae
AVVFQHLVGGMKVHQVQFVGGFDQLLLGAFGNGEVLAGIVVDNVAVGANVRLLQGVVFIEPFSVELAVVLQPRAADFQQFTVDLRLRNTVFRLLRLDHPAEDLGIVERVMKRIATVLHAQTQLARPLLPHRQRGVNNVLLGNAHSVIQQLGNDGDVAGLMKLTALLPDEQRTGLRRAF

SEQ ID NO: 7867 - protein, 326 aa, Enterobacter cloacae
LTEVALSYTRPAHYARIVKRFLHLLLHCLNTTPKRQANMSDNTYQPPKVWEWKQNNGGAFANINRPVSGATHEKELPVGAHPLQLYSLGTPNGQKVTIMLEELLALGVTGAEYDAWLIRIGEGDQFSSGFVDVNPNSKIPALRDHSTTPPTRVFESGNILLYLAEKFGHFLPKDPAGRTETLNWLFWLQGAAPFLGGGFGHFYNYAPVKIEYAIDRFTMEAKRLFDVLDKQLARGRYVAGEEYTIADMAVWPWFGCVALGSVYNAAEFLDAGKYTNVQRWAKDVANRPAVKRGRIVNRTNGELNEQLHERHSASDFDTQTEDKRQG

SEQ ID NO: 7868 - protein, 93 aa, Enterobacter cloacae
TLDDFLGFLAPRDEEVKGHKSMFLGNDPVTDASVIPALDQLTGGKKDTTVFFRADKTVDYRKTQLGEMKVMDTLHQAGYLKIGLVGEEKAAAK

SEQ ID NO: 7869 - protein, 176 aa, Enterobacter cloacae
QKQRVIQRQRLAALRQRGERASGIPLVAALGHGLENARLAAARVFTSGVFTTRILTARIFTSGVFTARILTARVFASGVFTTRILTARVFASGIFSSRILATGLFLRDGQIDGIGALLKRHVEEGGFGDRAGELTVNSPVGGQNAVALARFIAGLRIQRGDLYLSLIADGGFARYQ

SEQ ID NO: 7870 - protein, 214 aa, Enterobacter cloacae
KEAPLGQNYALVVDDHPLVASGIANFLITHCQFKQACVVTNEDDCYRQIRDHGPPRLLVIDFWLSSGTALKLLKEVKQLYPQVRLLVVSGDDNNDIWRKVNAAGGHGFVLKSEPPEMFSRAVFALTDNQTWFPEGNEISVKANNEKLSKFNLTPRQIDVLNMIRRGLPNKRIAAQLSISEPTVKEHISNILKKIGVNSRVEAITLLHGKQEPSE

SEQ ID NO: 7871 - protein, 175 aa, Enterobacter cloacae
DILSAGFVCRQDFMERFFENAMYASRWLLAPVYFGLSLALVALTIKFFQEIFHVLPNIFSVAEADLILVLLSLVDMTLVGGLLVMVMFSGYENFVSQLDIAEHKEKLSWLGKMDASSLKNKVAASIVAISSIHLLRVFMDAKNVPDNKLMWYVIIHLTFVLSAFVMGYLDKISKK

SEQ ID NO: 7872 - protein, 558 aa, Enterobacter cloacae
IFETTFSFYADSITKKVYFLQYLPITRGVLASGRIHPHGKEYSMKMLRNFTIRFVMLTILGIFCVMWAGVGLYSTWSLSRVSDGNDVDRLLVRQMTVLSQGNDQYFRFVTRLSRAMEVKAAGGTPDLAPAQQALDNMSKKLAEMKAISPGPMDEKVSAQVISTWQALLDQGVTPQMAQAKQATLEGYRQHANNVTPPLSRAFGSAAENFNNTAAKALDSTRVVVDGLTSMTRTVIITATIVGLLILLFTDRYLVAILVKPLDRIRQQFRQIAQGDLSQPIESLGRNCVGQLVPLLSAMQDSLREAVSTIRSGSENIWRGATEISSGNNDLSSRTEEQAAALEETAASMEQLTATVKLNAESARQASQLADVASSTASRGGSLVEDVVTTMSGISDSSKKIAEITTVINSIAFQTNILALNAAVEAARAGEQGRGFAVVAGEVRNLASRSANAAKEIEGLIADSVARVEQGAQLVNDTGTTMEAILRDVTEVTVIMKQIATASEEQSKGISQVGVAITQMDGVTQQNASLVEQVSAAAAALERQTEELQRSVQKFRLTA

SEQ ID NO: 7873 - protein, 623 aa, Enterobacter cloacae
VGHMRKGTLSSDAPFGTLLGYAPGGVAIYSSNYGSLDPRRYPEDAEFRSYIGNEYMGHKWQCVEFARRFLFLNHGFVFTDVGMAWEIFSLRFLRQVVNDNILPLQAFANGSKRAPQAGALLIWQKGGEFHETGHVAVITQLLDDRVRIAEQNVIHSPLPMGQQWTRELRLSVEDGCYTLHDTFNDTEILGWMIQTEETEHSIPQPEIDGELLKISGARLKNNRQFDGKWLNENDALQQAYVRANGHVINNDPCQYFTITESAEQELIKATNELHLMYLHATDKVLKDDSLLALFDIPKILWPRLRLSWQWRRHHMITGRMDFCMDERGIKVYEYNADSASCHTEGGLILEEWVKNGYRGTGHNPAEGLLEELTGAWKHSHARPFVHIMQDNDIEEDYHVLFIQRSLIQAGFETKILHGLGALSWDAAGQLIDDEGRHVNCVWKTWAWETAIEQIREVSETEYAAVPIRTGHPQGEVRLIDVLLRPEVLVFEPLWTVIPGNKAILPVLWQLFPNHRYLLDTDFEVNDLLKRTGYAVKPIAGRCGSNIDLIGAQDELLDQSSGKFVDRKNIYQQLWCLPKVDGRYIQVCTFTVGGNYGGTCLRGDNSLVVKKESDIEPLIVVKDN

SEQ ID NO: 7874 - protein, 129 aa, Enterobacter cloacae
TVRNAVQVFSGEQALCQRGKGDTARSVFLQRVQQAGLVDPAVKQVVRRLVDQKRDLPLAQQFGHRRRAFRGVRRNADIQRFSALHRVCQRSGGLFHRRVFVYAVRIENIHILHTHAVQALVEAGEQVLT

SEQ ID NO: 7875 - protein, 353 aa, Enterobacter cloacae
MLYTHSSHQNRGNAMSKIKSYAAPQAGAELELYEYDAGELKAEDVEVQVDYCGICHSDLSMIDNEWGFSSYPLVAGHEVIGRVVALGSAAQDKGLKVGQRVGIGWTARSCGHCDACISGNQINCLEGATPTILNKGGFADKLRADWQWVIPLPDSIDIESAGPLLCGGITVFKPLLMHHITATSRVGVIGIGGLGHIAIKLLHAMGCEVTAFSSNPAKEQEVLAMGADKVVNSRDPQALTALAGQFDLIINTVNVDLDWQPYFEALAYGGNFHTVGAVMKPLPVPAFTLIGGDRSVSGSATGTPYELRKLMKFAGRTKVAPTTELYPMSKINEAIQHVRDGKARYRVVLKADF

SEQ ID NO: 7876 - protein, 959 aa, Enterobacter cloacae
PEYGNLEIMEKTYNPRDIEQPLYEHWEQQGYFKPNGDESKESFCIMIPPPNVTGSLHMGHAFQQTIMDTMIRYQRMQGKNTLWQAGTDHAGIATQMVVERKIAAEEGKTRHDYGRDAFIDKIWQWKAESGGTITRQMRRLGNSVDWERERFTMDEGLSNAVKEVFVRLYKEDLIYRGKRLVNWDPKLRTAISDLEVENRESKGSMWHIRYPLADGAKTADGKDYLVVATTRPETLLGDTGVAVNPEDPRYKDLIGKFVVLPLVNRRIPIVGDEHADMEKGTGCVKITPAHDFNDYEVGRRHQLPMINILTFDGDIRESAEVYDTKGNESDVYSSDIPAEFQKLERFAARKAIVAAVDALGLLEEIKPHDLTVPYGDRGGVVIEPMLTDQWYVRADVLAKPAVEAVENGSIQFVPKQYENMYFSWMRDIQDWCISRQLWWGHRIPAWYDNEGNVYVGRTEEEVRQENNLGADVALRQDEDVLDTWFSSALWTFSTLGWPENTDALRQFHPTSVMVSGFDIIFFWIARMIMMTMHFIKDEDGKPQVPFHTVYMTGLIRDDEGQKMSKSKGNVIDPLDMVDGISLEELLEKRTGNMMQPQLAEKIRKRTEKQFPNGIESHGTDALRFTLAALASTGRDINWDMKRLEGYRNFCNKLWNASRFVLMNTEDQDCGFNGGEMTLSLADRWILAEFNQTVKAFRDALDSYRFDIAAGILYEFTWNQFCDWYLELAKPVMNGGSEAELRGTRNTLITVLEGLLRLAHPIIPFITETIWQRVKVIAGINPDTIMLQPFPAFDAAKVDEAASADTEWLKQAIVAIRNIRAEMNIAPGKPLELLLRGCSEAAVRRVTENNTFLKTMARLESITVLPADDKGPVSVTKIIDGAELLIPMAGLIDKDAELARLAKEVAKVDVEIGKIESKLANEGFVARAPEAVIAKERERLVAFADAKTKLIEQQAVIAAL

SEQ ID NO: 7877 - protein, 198 aa, Enterobacter cloacae
GVSFLKTPRLHSPFCGAINSSCVSIFVMSKAMSVITPVATTMRRITKQDNPAIAAVIRTVSAEYGLTADKGYTVADPNLDELFQLYSQPGHAYWVIEQDGQVVGGGGIAPLLCSEPDICELQKMYFLPTIRGQGLAKKLALVALEHAHSQGFKRCYLETTAFLKEAIGLYEHLGFEHIDAPLGCTGHVDCEVRMLKSL

SEQ ID NO: 7878 - protein, 200 aa, Enterobacter cloacae
GKTQRRDRDVRWRCGRSSCSIGRVLPGRSNDKRRGGVPLTRALHLNPRQETPYMKNATFYLLDNDTHQDGLSAVEQLVCEIAAERWRAGKRVLIACEDEQQAIRLDEALWARPPESFVPHNLSGEGPRGGAPVEIAWPQKRNSSARDILISLRTDFADFATAFTEVVDFVPYEESLKQLARERYKAYRLAGFNLNTATWK

SEQ ID NO: 7879 - protein, 523 aa, Enterobacter cloacae
GIYADILPSGCLYSTQDYERTCIMSTPLLIARTLEKELFLLPAMANRHGLITGATGTGKTVTLQKLAESLSETGVPVFMADVKGDLTGVAQEGAASEKLLERLKNIGITDWTPHGNPVVVWDIFGEKGHPVRATVSDLGPLLLARLLNLNDVQSGVLNIIFRIADDQGLLLLDFKDLRAITQYIGDNAKSFQNQYGNISSASVGAIQRGLLTLEQQGAEHFFGEPMLDIKDWMRTDSSGKGIINILSAEKLYQMPKLYAASLLWMLSELYEQLPEAGDLEKPKLVFFFDEAHLLFNDAPQVLLDKIEQVIRLIRSKGVGVWFVSQNPSDIPDNVLGQLGNRVQHALRAFTPKDQKAVKAAAQTMRVNPAFDTETAIQALGTGEALISFLDAKGSPTVVERAMVIAPCSRMGPVTDDERNGLINHSPVYGKYEDEVDRESAFEMLQKGVQATAESQDAPAAKGQSVAVDDGILGGLKDILFGSTGPRGGKRDGVVQTMAKSATRQITNQIVRGMLGSLLGGRRR

SEQ ID NO: 7880 - protein, 1500 aa, Enterobacter cloacae
SSVGSPTSLGRFTDMLYDKSLEKDNCGFGLIAHIEGEPSHKVVRTAIHALARMQHRGAILADGKTGDGCGLLLQKPDRFFRIVAEERGWRLAKNYAVGMLFLNQDPEKAAASRRIVEEELQRETLSIVGWRDVPTNEGVLGEIALSSLPRIEQIFVNAPAGWRPRDMERRLFIARRRIEKRLQDDKEFYVCSLSNLVNIYKGLCMPADLPRFYLDLADLRLESAICLFHQRFSTNTVPRWPLAQPFRYLAHNGEINTITGNRQWARARTYKFQTPLIPDLHDAAPFVNETGSDSSSMDNMLELLLAGGMDIVRAMRLLVPPAWQNNPDMDPELRAFFDFNSMHMEPWDGPAGIVMSDGRFAACNLDRNGLRPARYVITKDKLITCASEVGIWDYQPDEVVEKGRVGPGELMVIDTRGGRILHSAETDNDLKSRHPYKEWMEKNVRRLVPFEDLSDEEVGSRELDDDTLASFQKQFNYSAEELDSVIRVLGENGQEAVGSMGDDTPFAVLSSQPRIIYDYFRQQFAQVTNPPIDPLREAHVMSLATSIGREMNVFCEAEGQAHRLTFKSPILLYSDFKQLTTMTEEHYRADTLDITFDVTETSLEETVNALCDKAEQMVRNGTVLLVLSDRNIAKNRLPVPAPMAVGAIQTRLVDKSLRCDANIIVETASARDPHHFAVLLGFGATAIYPYLAYETLARLVDTRAIDKDYRAVMLNYRNGINKGLYKIMSKMGISTIASYRCSKLFEAVGLHNEVANLCFQGVVSRIGGAGFADFQQDLVNLSKRAWLARKPLEQGGLLKYVHGGEYHAYNPDVVRTLQQAVQSGEYSDYQQYAELVNNRPAATLRDLIALNPGEEAVSIDEVEPASELFKRFDTAAMSIGALSPEAHEALAEAMNSIGGNSNSGEGGEDPARYGTNKVSRIKQVASGRFGVTPAYLVNADVIQIKVAQGAKPGEGGQLPGDKVTPYIAKLRYSVPGVTLISPPPHHDIYSIEDLAQLIFDLKQVNPKAMISVKLVSEPGVGTIATGVAKAYADLITIAGYDGGTGASPLSSVKYAGCPWELGLVETQQALVANGLRHKIRLQVDGGLKTGLDIIKAAILGAESFGFGTGPMVALGCKYLRICHLNNCATGVATQDEKLRKNHYHGLPFKVTNYFDFIARETRELMAQLGVKRLVDLIGRTNLLKELEGFTAKQQKLELSKLLETAQPHPGKAVYCTENNPPFDNGVLNAQLLQQAKPYVDEKQSKTFWFDIRNTDRSVGASLSGYIAQTHGDQGLASDPITAHFSGTAGQSFGVWNAGGVELYLTGDANDYVGKGMAGGLLAVRPPVGSAFRSHEASIIGNTCLYGATGGRLFAAGRAGERFAVRNSGAITVVEGIGDNGCEYMTGGIVCVLGKTGVNFGAGMTGGFAYVLDEDGEFRKRVNPELVEVLDVDTLAIHEEHLRGLITEHVQHTGSSRGEEILANWPAFSAKFALVKPKSSDVKALLGHRSRSAAELRVQAQ

SEQ ID NO: 7881 - protein, 475 aa, Enterobacter cloacae
GIQMSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMTGVRQTDKRVAIIGAGPAGLACADVLTRNGVKAVVFDRHPEIGGLLTFGIPAFKLEKEVMTRRREIFTGMGIEFKLNTEVGRDVQLDDLLKDYDAVFLGVGTYQSMRGGLENEDAPGVYDALPFLIANTKQLMGYGETADEPFVSMEGKRVVVLGGGDTAMDCVRTSIRQNAAHVICAYRRDEENMPGSKREVKNAREEGVEFQFNIQPLGIEVNANGKVSGVKMARTEMGAPDAKGRRRAEIVAGSEHVIPADAVVMAFGFRPHSMEWLAKHSVELDSQGRIIAPEGSDNAFQTSNPKIFAGGDIVRGSDLVVTAIAEGRKAAEGIMNFLEV

SEQ ID NO: 7882 - protein, 554 aa, Enterobacter cloacae
TKFWETMSRFFFNDRKQLVNDAIEGILLSAPHGNLVKLDIDPAIRVVARGDWDKSRVAVISGGGSGHEPAHAGFVGKGMLTAAVCGDLFASPSVDAVLNAIVAVTGDRGCLLIVKNYTGDRLNFGLAAEKAKRYGLKVEMVIVADDIALPDNKQPRGIAGTALVHKIAGYAAEQGKSLNDVRDIAQQACDNLWSLGVAMQTCNLPGSDDEGGRIKQGHVELGLGIHGEPGASVVDTQNSKAIIDTLVTPLRAQAGEGRFAVLINNLGGVSALEMALLTKELAHSALKENIAYLIGPAPLVSALDMKGFSLTLLKLNDFFEKAIHAEVETLGWQKPVAFAPLRTVPHSALHDRVEYAPSDNTEVSEAVASVTKTLIQLENRLNALDAKVGDGDTGSTFAQGARDITQRLEENNLPLNDVPTLLLLVGERLATVMGGSSGVLMSIFFTAAGQKLHDGQPLPEALLSGLAQMKQYGGADLGDRTLIDALQPALEALQKGNIQAAAQAAQQGAEATAKMAKAGAGRSSYVNKENLDGVMDPGAVAVAEVFKTMVDAKR

SEQ ID NO: 7883 - protein, 343 aa, Enterobacter cloacae
KPSRAIDPGHRRQRLKMAGLSPFFGTVYQIMQLQKLVNMFGGDLLQRYGQKVHKLTLHGGFSCPNRDGTIGRGGCTFCNVASFADEAQQHKSIAEQLAHQASLVNRAKQYLAYFQAYTSTWAEVQVLRSMYQQAVAQANIVGLCVGTRPDCVPDAVLDLLSEYKEKGYEIWLELGLQTAHDKTLHRINRGHDFACYQRTTRLARQRGLKVCSHLIVGLPGEGRQHGLETLEKVVETGVDGIKLHPLHIVKGSIMAKAWEAGRLCGIELDDYTVTAGEMIRHTPPEIVYHRISASARRPTLLAPLWCENRWTGMLEINRYLQENGVQGSALGRPWVPPLPATAA

SEQ ID NO: 7884 - protein, 315 aa, Enterobacter cloacae
QTSQHAAYYLVGNLTRRAFCHGLNHAIAFAAAWPGAAEQNIFQPAENAVVHGNRLPFCGRRILRFGSRLHPFLQHLERRFAIHLVFILSVHRGVVNQAVAFIVRYRTHARAGRNHHRALDNCRAAFCIEERNQRFTGAQRLNGGFGIKGRIDTHGLRRGFHRFLIFRRKGAQGVLHAVTQLPQYVVRNIRRVLRHKPDPDAFGADQADNLFNFIQQHLRRVVKQQVRFVKEEHQFGFFQIACFRQLFVQFREHPQQAGGVKLRHLVELLCAQNVDDAFAAAVGTHPVFDIQHWLAEEVFGALLLQRQEPALNGAH

SEQ ID NO: 7885 - protein, 224 aa, Enterobacter cloacae
QMKKVVLASMLVMFVSSAFAADTAVLKVTGVLTNSSCIPEISGGGVVDYGTIHLSALNTTAINQLGQKDFSLSITCPALTKAGFSVSDDRTGTAPNIMVKDGAGNGNDIIQPLNMFGLNKTAGNVNIGNYTIFVKNDTITADGATVGAIYSADNGTSWSDNGTLMVNDGSQIVSVATVGSTAPVAFKNLVIPMAVSAAIQDTNTLAITDDTNMDGQATFTIKYL

SEQ ID NO: 7886 - protein, 179 aa, Enterobacter cloacae
LPGTQTSRGYEIMSTAKLVKTKASNLLYTRNDVSDSDKKATIELLNRQVVQFIDLSLITKQAHWNMRGANFIAVHEMLDGFRTALVTHLDTMAERAVQLGGVALGTTQVINSKTPLKSYPLDIHTVQDHLKELADRYAIVANDVRKAIGEAKDEDTADIFTAASRDLDQFLWFIESNIE

SEQ ID NO: 7887 - protein, 246 aa, Enterobacter cloacae
KKDENPVIEFKNVSKHFGPTQVLHNIDLNIRQGEVVVIIGPSGSGKSTLLRCINKLEEITSGDLIVDGLKVNDPKVDERLIRQEAGMVFQQFYLFPHLTALENVMFGPLRVRGASKAAAEALAKDLLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGNPQTLIANPPSQRLQEFLQHVS

SEQ ID NO: 7888 - protein, 775 aa, Enterobacter cloacae
  UNSURE (539)
PHTEPGMPGFFMPDCSQKLPSAPRALYLSFCTIFLSEDAVPWILLLLFSLFSAPSLAVTLPGVTTGATASQQNAPPEPDAEKKKAAYGALADVLENDTSRQELIDQLRKVAATPPQDPVPAVAPPEAEEEKTVLENVTDISRRYGEALSSRFAQLYRNLVGTSHKPFNPHTFSAAATQFAILAGAVFIFYWLLRLSVWPLYRKMGQWGRKKNQHKSSWLHLPAMITGAFVIDLLLLALTLFVGQLLADRLNTGNKTIAFQQGLFLNAFALIEFFKALLRLIFCPRVPDLRPFAISDQSAKYWAVRLSVLSGLIGYGLLVAVPIISNQVNVQFGALANVLIMLCITVWALYLIFHNKKAITDSLLHLADRSLSFFSLFIRAFALVWHWLASAYFIVLCFFSLFDPGNSLKFMMGATFKSLAIIGIAAFVSGLLSRWLSKTITLSPQVQRNYPELQKRVNGWMTVSLKVARILTVCVAIMLLLNAWGLFDFWNWLHNGAGEKTVDILIRIALILFFSAVGWTLLASLIENRLVSDVHGRPXPSARARTLLTLCRNALAVIISTITIMIVLSEIGVNIAPLLAGAGALGLAISFGSQTLVKDIITGIFIQFENGMNTGDLVTIGPLTGTVERMSIRSVGVRQDTGAYHIIPWSSITTFANFVRGIGSVVANYDVDRHEDADKAKQALRDAVNELMEMEDIRGLVIGEPSFAGIVGLTNTAFTLRVSFTTQPLKQWTVRFALDSMVKKHFDLANVRAPVQTYQVLSPPASPLPPQEPTL

SEQ ID NO: 7889 - protein, 99 aa, Enterobacter cloacae
EESPVVSPEDVIMKKYLTFIIAGALAGASFSAWSVQPLTDSNDTSQLRAAGTVSVSRASNLDDLQNKLAEKARQEGAKGFVVNAAGGDNHMYGTATIYK

SEQ ID NO: 7890 - protein, 860 aa, Enterobacter cloacae
TRSLIVLPGNKIIMYSHKKPFTCRFSSLLMAICCLAMAIFAQQVLADDYFNPALLDIDNPQQGKTDLSVYEKGPGQAPGKYQVAIFINNNKIDTRDVTFNLVKDPQGTSTLQPCFTLDELKSLGIKTQKYPQLRAKGQCADLHAIPSASATFRVRNQQLLLSIPQKALGQVPRGYIDPKEFDEGINAGLLNYSVNASQSHARQQGEENSSSQYVNLRPGFNIGAWRVRNYSTWNRSTTGHEEEQKFTSVYTYAQRDIVAMKSDVTVGQSTSPSDVFDSVPYTGVELKSDSDMLPDSEKGYAPIIRGSAHSNAQVVVRQNGYIIYQNTVAPGAFEINDLYPTGSSGDLQVTVKETDGSESHFVVPFASVPVLQREKNLRYSVTAGRYRSYDKDVEKTPFAQGSAIYGLPFGFTVYGGVQQSNHYQSQAIGAGKNMGDLGAFSIDVTRARALLKKQQSSKGQSWRIRYSKDFAGSGTNFTLAGYRYNSKGFYTLDDTMESYTRSDNWSAPQQRRARTEATIDQTLPEGWGSVTLSMVKETYWSQSQNMTSMSVSYNNSWHGVSYSLSYSMNKNTQDSDEDGNEVTNDNQFSLSVSVPLDRWMHNTWATYNLNNTKDGTTQNIGLNGTALKEDNLNWNIQEGLSSTGSGNSTSINADYKATYGEVSAGVSQDKYQQTLNVGLQGGVVAHANGITLSQPLGDTIALVKAPGTHGTHITNQTGVETDFRGYTVVPFVTAYRRNTIALDTETLPDNADVTHAAQIVTPTRGAVVRASFNTRVGNRVLMTLTQKGKPLPFGATVTTEDKDSEFIVGNDGQTYLSGLPQQGHLYVSWGQGANEHCVADYALTDEKEQTSIINAAAQCH

SEQ ID NO: 7891 - protein, 170 aa, Enterobacter cloacae
VTNMKKTIAFLTMGLLAQAHADDIQIQMTGNIYANTCIIDSASRNLTVDLGQTVSGSFKDVGDTGEWKDFSLSVSHCPATLALATAFFYGQADSVHPTKFANIGSAKGLALELADRQDKILIAPQAAFNAAINPSDHTATFLLSARYYATSMPVTAGTFSSVIQVTFTYQ

SEQ ID NO: 7892 - protein, 407 aa, Enterobacter cloacae
KRRPPTTRSQTRPWSRRLSPSSTTGIRRILMRSNALSWRRVRALCVKETRQIVRDPSSWLIAVVIPLLLLFIFGYGINLDSSKLRVGILLEQQSEEALDFTHAMTGSPYIDATISDNRQELIQKMQAGKIRGLIVIPVDFAANMARANTDAPIQVITDGSEPNTANFVQGYAEGIWQLWQMQRAEDRGEEFEPLIDVQTRYWFNPAAISQHFIIPGAVTIIMTVIGAILTSLVIAREWERGTMEALLSTEVTRVELLLCKLIPYYFLGMLAMLLCMLVSVFILGVPYRGSLVVLFFITSLFLLSTLGMGLLISTITRNQFNAAQVALNAAFLPSIMLSGFIFQIDSMPAVIRAVTYIIPARYFVSTLQSLFLAGNIPVVLIINTLFLMASAVMFIGLTWMKTKRRLD

SEQ ID NO: 7893 - protein, 271 aa, Enterobacter cloacae
NWHDFFIVPEVLAGDRPVDIKGNAMKSVLKVSLAALTLAFAVSSQAADKLVVATDTAFVPFEFKQGDKYVGFDVDLWAAVAKELKLDYTLKPMDFSGIIPALQTKNVDLALAGITITEERKKAIDFSDGYYKSGLLVMVKADNNDVKSVKDLDGKVVAVKSGTGSVDYAKANIKTKDLRQFPNIDNAYMELGTNRADAVLHDTPNILYFIKTAGNGKFKAVGDSLEAQQYGIAFPKGSDDLRNKVNGALKTLKENGTYNEIYKKWFGTEPK

SEQ ID NO: 7894 - protein, 242 aa, Enterobacter cloacae
RPVALTLTGPTFFVFHHGIQEYIMQFDWSAIWPAIPLLLEGAKMTLWISVLGLVGGLIIGLVAGFARTYGGWIANHIALVFIEVIRGTPIVVQVMFIYFALPMAFTDLRIDPFSAAVVTIMINSGAYIAEITRGAVLSIHKGFSEAGLALGLSRRETIRHVILPLALRRMLPPLGNQWIISIKDTSLFIVIGVAELTRQGQEIIAGNFRALEIWSAVAVVYLIITLVLSFVLRRLERRMKIL

SEQ ID NO: 7895 - protein, 193 aa, Enterobacter cloacae
KRPGNVFARNISGFTMNKVALGLFIAATVGCSASAFAATNGEGQINFTGEIIDSACQVVNGLSNPLDVQLGKVSKTVFTGAGSTSTLTKFDIKLTNCPETVTSAAINFGGTPDADNNAALALTPDTDAATGVAIQLVDTSGQPVSLYTPSKQYPLASGTAVNDLEFGARYIQTQAAVTAGPANSVSTFTVIYN

SEQ ID NO: 7896 - protein, 227 aa, Enterobacter cloacae
EIFMRHGYLLSILLLVAASAQAGVVINGTRLVYQGDKKESSLGLSNPDTTDYLVQSWVDSGGKNQAKAPFLITPPLFRLDAKEDNVLRVVRTGGNLPEDRESLYWLNIKAIPSSKHVEGVNTLQIAINTRIKLLYRPSAVKGRPEDVADKLEWHREGNDLVVNNPTPFFMNFQTVTLNGQKVKKATWAVPKTETHFALPGNVGGSTVAYSIITDYGSISQTWSKPVH

SEQ ID NO: 7897 - protein, 354 aa, Enterobacter cloacae
RMRKSKPASLTLPRSVTDPPFRLTIMQMIKQCFFLLVLGTAALFMPHAKATCTTPDLPKMINMASISVPTTLAVGATIPGTEQSVHVAGHCDQSIDSGLEIVSCYYGTGAEIPGLKGVYESGVPGVGVALMNDQGQRISGAGGVQCDSRGTPVGYVSGDGTQSFNFDVTLELVKTSDAVTSGTLVQSQTEFGIGVFGHEGIGSPNHIAYAGNVILHQVTCSVSPKNLTVNLGDFPVSDFMSVGFLSSPAQTFNITVNCDTTVQPELKITSANSYETAFEGVIKLTKQTGMATGVGVRMLFDDRIATFDTYVNTQSQAVANETLEIPFQVRYEQISDVVTPGPANTVATITLAYK

SEQ ID NO: 7898 - protein, 344 aa, Enterobacter cloacae
SDPARLNAKEPEVMKKPVAIILVVVVLLAAGTGGWLWYQSQQDRGLTLYGNVDIRTVNMSFRVGGRLASLNVDEGDAIKAGQTLGMLDKAPFENALMQAKAGVSVAQAQYDLMLAGYRDEEISQAAAAVKQAKAAYDYAQNFYNRQQGLWKSRTISANDLENARSSRDQAQATLKSAQDKLSQYRTGNRAQDIAQAKASLEQAQAQLAQAELDLHDTTLIAPSDGTLMTRAVEPGSMLSAGSTVLTLSLTRPVWVRAYIDEPNLGQMQPGRELLLYTDGRPDKPYHGKVGFVSPTAEFTPKTVETPDLRTDLVYRLRIIVTDADDALRQGMPVTVTLNDGERHE

SEQ ID NO: 7899 - protein, 94 aa, Enterobacter cloacae
TDQENMMASGWANDDAVNEQINSTIEDAVARARGEIPRGESLTECEECGDPIPEARRKAIPGVRLCIACQQEKDSKNATHSGYNRRGSKDSQLR

SEQ ID NO: 7900 - protein, 87 aa, Enterobacter cloacae
PMKTIKYAVAAVALSALSFGAFAVEPVSSTQAQDLNKIGVVSAEGATTLDGLEAKLAEKAAAAGASGYTITSTNGNNKLSGTAVIYK

SEQ ID NO: 7901 - protein, 231 aa, Enterobacter cloacae
LIFNAAMNTTPATTKGEQAKSQLIAAALAQFGEYGLHATTRDIAAQAGQNIAAITYYFGSKEDSYLACAQWIADFIGTSFRPHVEEATALFSQPEPDRAAIRQLILNACHNMIRLLTHDDTLNLSKFISREQLSPTAAYQLVHDQVIAPMHSHLTRLIAAYTGRDASDTDTILHTHALLGEVLAFRLGRETILLRTGWTQFDEDKAAQISQVITCHVDLILQGLTQRSQKS

SEQ ID NO: 7902 - protein, 584 aa, Enterobacter cloacae
TTGNDMNDAVIQLNNLVKRFPGMAKPAVAPLNCTIQKGYVTGLVGPDGAGKTTLMRMLAGLLKPDEGSASVLGLNPIKDDAALHGILGYMPQKFGLYEDLTVMENLNLYADLRSVTGETREKTFARLLEFTSLGPFTDRLAGKLSGGMKQKLGLACTLVGEPKVLLLDEPGVGVDPISRRELWQMVHELAGDGMLILWSTSYLDEAEQCRDVLLMNEGELLYQGEPTELTQTMAGRSFLLHSAQESNRTLLQRVLKLPQVSDGMIQGRSVRVILKKEATADDIRRAQGMPEIDMTETSPRFEDAFIDLLGGAGTSESPLGAILHTVEGTPGETVIEAKSLTKKFGDFAATDNVNFAVKRGEIFGLLGPNGAGKSTTFKMMCGLLVPTSGKALVLNMDLKVSSGKARQHLGYMAQKFSLYGNLTVEQNLRFFSGVYGLRGRAQNQKIGRMCDAFGLTDIASQATDALPLGFKQRLALACSLMHEPDILFLDEPTSGVDPLTRREFWLHINSMVEKGVTVMVTTHFMDEAEYCDRIGLVYRGKLIAHGTPDDLKAQAADDSQPDPTMEQAFITLIHDWDKENTHAQ

SEQ ID NO: 7903 - protein, 468 aa, Enterobacter cloacae
WSGRFGVFMSFDSLGLNPEILRAIAEQGYVEPTPIQQQAIPAVLQGRDLMASAQTGTGKTAGFTLPLLELLVKNQPHAKGRRPVRALILTPTRELAAQIGENVREYSRYLNIRSLVVFGGVSINPQMMKLRGGVDVLVATPGRLLDLEHQNAVKLDNIEILVLDEADRMLDMGFIHDIRRVLAKLPTRRQNLLFSATFSDEIKALAEKLLHNPLEVEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIERLLKKEIPRIETPGYEVDPSIKAEPIQNGRQGGGRGQGGGGRGQQPRRSEGGAPKSSGKPPRRNNDSKPAGGNPWRSGEGKPAGEGQRRRRPRKPANPQ

SEQ ID NO: 7904 - protein, 102 aa, Enterobacter cloacae
TSPIRSQYSASSIKWVVTITVTPFSTMLLICNQNSRRVRGSTPDVGSSRNRISGSCINEQASASRCLKPSGSASVACEAISVRPKASHMRPIFWFCARPRRP

SEQ ID NO: 7905 - protein, 144 aa, Enterobacter cloacae
PRCWRALPELTLRSMFSTSALPDVGTSRPHIILKVVDFPAPFGPSRPNISPRFTAKLTLSVAAKSPNFLVSDFASMTVSPGVPSTVCRMAPSGDSEVPAPPSRSINASSKRGEVSVMSISGIPCARRISSAVASFLRITRTERP

SEQ ID NO: 7906 - protein, 751 aa, Enterobacter cloacae
SRAFLFAAAERKCHNSGCLYSISGFPMALTAALKAQIGAWYKALQQQIPDFIPRAPQRQMIADVAKTLAGDDGRHLAIEAPTGVGKTLSYLIPGIAIAREEDKTLVVSTANVALQDQLFSKDLPLLRKIIPDLRFTAAFGRGRYVCPRNLAALASSEPAQQDLLAFLDDELTPNNKAEQEQCAKLKADLDSYRWDGLRDHTSQAIGDDLWRRLSTDKASCLNRNCHYYRECPFFVARREIQEAEVVVANHALVMAALESEAVLPEPKNLLLVLDEGHHLPDVARDALEMSAEITAPWFRLQLDLFCKLVATCMEQFRPKTTPPLAVPERLSEHCEEVYGLIASLNNILNLYLPATQEAEHRFAMGELPQEVMEICQQLAKHLEKLRGLAEMFLNDLSEKTGTHDVVRLHRILLQMNRALGMFEAQSKLWRLASMAQASGAPVTKWATREVRDGQVHLFFHCVGIRVADQLEKLIWRSVPHVVVTSATLRSLNSFSRLQEMSGLKEKAGDRFVALDSPFNHCEQGKLVIPRMNYEPLIDNEEQHIAEMAAYFREQVESKKYPGMLVLFASGRAMQRFLEHVTDLRLLLLVQGDQPRYRLVETHRKRIDNGERSVLVGLQSFAEGLDLKGDYLTQVHIHKIAFPPIDSPVVITEGEWLKSLNRYPFEVQSLPAASFNLIQQVGRLIRSHGCWGEVVIYDKRLLTKNYGQRLLNALPIFPIEQPEVPEVKKRPAKPSAGRTKSIRAKRRGPTGK

SEQ ID NO: 7907 - protein, 331 aa, Enterobacter cloacae
QDDAVRRNVVDYRKIIKEVGRGKNHARDLDQETARALYTHMLNGDVPELEMGGILIALRIKGEGEAEMRGFYEAMQSQTMRLTPPVTKPMPMPIVIPTYNGARKQANLTPLLAILLQKLGFPVVVHGVSEDPTRVLTETILELLGIEPTLHAGQAQAKLEGNQPVYIPVRALCPPLEKQLDMRWRMGVRNSAHTLAKLATPFAEDAALRLSSVSHPEYVTRVGQFFAEIGGRALLMHGTEGEVYANPQRCPQLMLIEPAGTRVVLERGEENCDVILPESKDPQVTAHWIVQCLAGKVPVPQSIKLQMACCLLAAGEVASVEAGLQRVAQSF

SEQ ID NO: 7908 - protein, 341 aa, Enterobacter cloacae
QIIDIQVADFCRFFVRLRQLFTPAPSQGILRGCLKENAMTSQKPGLHPRNRHRSRYDMKALCLSCPELQDFIVQTPAGEPSVNFADPLAVKTLNKALLAHFYGVTHWDIPDGFLCPPVPGRADYVHHLADLLADDNGGVVPKQATVLDIGTGANLIYPLIGAHEYQWRFTGSEIGAEAFASAQAIINANPGLSRAVRLRRQKDAAAIFNGIIHKNEQYDATLCNPPFHDSAASARAGSERKRRNLGQAEDGALNFGGQQQELWCEGGEVAFILRMITESKGFGRQVKWFTTLVSRGDNLPPLYRALTDVGAVKVVKKEMAQGQKQSRFIAWSFMDDNKRRK

SEQ ID NO: 7909 - protein, 147 aa, Enterobacter cloacae
GTYLIIRRPQIETPSPGTRNTGRELTTPTIKELIMADSHSTPDTDQSGTERSLIVGYRPNVFDKSTPKIILSGKWLRAAGFDTGQQVTVKVMKGCIVLVAYNEQEQRLQDDYKRTKAKLIEIEKALAAIQIPHAGKRLAKSNTNHLA

SEQ ID NO: 7910 - protein, 244 aa, Enterobacter cloacae
INSDYLFIGRRIVGLHYAIRHCFENTGDNLINNSPDYYYKSRNNMTNNSQITQHITVALMGGDHYARNGIKTLLSSIRDDLHIIIIEGGYQQLDKALSSIRIDILFISGAEKYHTGYDSLKYLKKIKATQPEVMICLYSTSAHSLLWVREDIDAYISLQNTVYQWRIKLAKMVDSHYRPQKQPAALSLTPGERRVLKELRNGLDIRYIAELEKLSYRRVSALKSSAIRKLGLRNKTDLLVFLTS

SEQ ID NO: 7911 - protein, 256 aa, Enterobacter cloacae
CQRGRHLHRDLFVIFRPGLLAGSDSAFRRRTMRVNTWICLAGTLCSSAVYAGGVGLGATRLVYAGAATQTMMQVRNTHPDATFLIQSWMEDEKGSRTNDFVITPPLYVMKPASESAVKIMFSGNALPSDRETLYWMTVKAIPQQVKNGSGNSLQFASANRIKVFYRPERLREGAGEAWKNLAGAYRAGKVTLTNPTPYYLTTINVKIDGRPVSPVMVPPKASVTLADTFSHASSMSYQTINDYGAWTPVTRTSLSQ

SEQ ID NO: 7912 - protein, 369 aa, Enterobacter cloacae
QRKNDLLCATGRHGCAGQCRRRFGSGDLDDGVSIMRLLFLALFFMSSQALALSWTSDITLSPTPMSWSGPADSIVPGKTIGSEWSASASVSEVFWCGLVFTCSKGTLEPSSSITATGITVILDGANYMVFETGVPGIGFILGLKDYNGTTYVPMQTGITQSYPADGTNGYATALGWSAKVTFIKTGVPLKSGVYQTPTINSAILTAYNNEVKTAQVIINPTTITVTASGCTVGTKSANVDLGTIDVHTLPSVGSTSPSGEFNVSLTCDENVAVNAVMTDQTTPSNTSSVVTLTGDSTASGIGVQFFYNGTGPLMMGPDSSAAGTTGQFFIQTTSAAQTLSLPFQAQYIRTGDLVPGSANALASITFSYQ

SEQ ID NO: 7913 - protein, 402 aa, Enterobacter cloacae
PTEAQSCTPFRRHPHCRLFFAPSVKYCNSVQVKRAQRSNPMIKNLHIQNYRSIRDMSLELEQLNIVFGPNGTGKSNIYKAIYLMHSAAQGQFSQALANEGGILKVFWAGKTRSDQLRRMNLAVETETYEYELQVGFVEKLPYPSQFQLDPVIKEESIWLSGQHRRPSSQLMKRKNQAVFLNNVHHEKVTHSGTLYENESVFGQLGEPHLYPEVSQMRESLRNWRFYHEFSVSSGSAIRAPQVGFRSPVLASDGANLAAAFQTIVEIGDELLLMRILDQAFPGCVFYSDNTGGRFRMMMQREGLSRPLEPAEFSDGTLRFLCLAVALLSPRPPAFIALNEPENSLHPQMLPALASLIAEASRYSQIWLTSHSPELAHLIEKHRSFSLYQLLMAEGETRMERLG

SEQ ID NO: 7914 - protein, 165 aa, Enterobacter cloacae
KEIEMAIPVYLWLEDDAGRKINGSVDIKDREGSIEVIEFMHSIEQSIEKFSGKITSKRICSTYAFMKEIDSSSSYLYKALSTGQTLTRAEFIFYRINYNGLEEAYFKTTLENARVVQIEPLMFDIKLPQNERYTHCEYVDLTYEKITWHYIDGNIIHSDTWKERA

SEQ ID NO: 7915 - protein, 214 aa, Enterobacter cloacae
PVRPAAFRANLVIKKPRNYEMKARLTCHSLLALSIAALLPAGSALAATTSGGTVNFSGKVVTSACAISAGSANIDVDMGEVRTATLAAAGSEASTAKAFSITLEDCEIADTSASTENNPIAATTVAITFTGTPDSTDVNSLAAGVNGGAGSAQHVAIRLYDEQGNVVRLGEPAAAIPLRAGANTLNFSAKYYSPLGNATAGDASAVATYTVTYS

SEQ ID NO: 7916 - protein, 230 aa, Enterobacter cloacae
QSQRYRRRRRQRVSDRPVSAGNLACRMGTRQRPALHDPLCVEPAELSRPHRALFPGGHMSVTVRFLPLILLMVITVPARGYDVLVSVTGNVIGNTCIVSEDSKEQNVPLGTLGVKQFSEAGAVSNIKTPFTLTLEACGPTFAGVKIRFSGTPDDENPQLLKVADGGATGVAVQILDKDSVLIPLDTQTAAYGAAGDDSVKMTFYARLAATGAPVNAGDVSAVATWTTEYQ

SEQ ID NO: 7917 - protein, 250 aa, Enterobacter cloacae
DNSFSSDADMAYSIGEFARLSGITATTLRAWQRRYGLLKPERTDGGHRLYSDEDVQQALKILDWVKKGVPIGQVKSLLERPAPRRANNWQTLQQAMMQKLQEGKIESLRQMIYDAGREYPRPELVTNVLRPLRSQISANVAAAMTLREILDGILIAYTSFCLEGDKKAPGDNVLISGWYLNDPCEIWLEALTRTGQGHRIDILPVPPAALAPEIFPDRKWLLVTSGKLTAARKKQVAQWQQQVSLEVIIL

SEQ ID NO: 7918 - protein, 157 aa, Enterobacter cloacae
IFFRAASANVFLSPTTQQENTMKKTLPLMMLAAMAFAPAAFSAPAGTLSVHVLDQQTGMPPADVTVTLEKQEQDKWTPIASGKTDHDGRIKSLYPQDQDMAPGVYKVTFKTADYFHGKKLDSFFPEVPVLFTVTRTNEKLHIPLLLSQYGYSTYKGS

SEQ ID NO: 7919 - protein, 325 aa, Enterobacter cloacae
DREVHTMTTKPVLGISGCLTGSAVRFDGGHKRMGFVMDELAQWVAFRPVCPEMSIGLPTPRPALRLVMTTGGETEMRFSKAPHDDVTQKMAAFTADYLPKIGDLSGFIVCAKSPSCGMERVRLYDENGNRGRKEGVGLFTAALLETFPWLPVEEDGRLHDPVLRENFVERVFALHELNVMRKNGLTRRALLDFHSRYKLQLLAHHQAGYREIGPFVASLHEWDDLDAFFVAYRDKLMTILKKPASRKNHTNVLMHIQGYFRNQLNSRQRGELRDVILHYRDGLLPILAPLTLLKHYLAEYPDRYLMTQNYFDPYPDDLGLRLAVT

SEQ ID NO: 7920 - protein, 83 aa, Enterobacter cloacae
PPPVPSAPVAPISTSTWGKCVPPRWLPQAVKPVPQKPSPSRWRIAKSPIPPRPRKITPSPQRPWLSPSPVRRTVPMSIAWPRE

SEQ ID NO: 7921 - protein, 865 aa, Enterobacter cloacae
RLWGLDARHPHVIVPIIKTVRRDHMKIKILCATAIALVIRQAVAAESELQFNPAFLNGERANSADLAWVNAGSALPPGEYNLNVYINTQFAFTGNVTFRVAESTAGEALPCLTPAQFAALGIDSRQAKGGELPPAQRCIFLTQSFADTRFDFDQRTLTLNFTVPQSAMRALPRGYVSPESWESGIPAAWLNYVVNGANNDYRGETRTREQQLFVSLNSGANLGAWRLRDFTTWTKESNELTHVQTWLQRDIRALRAQVYAGETFTSSQVFDAVGLRGIALKTDDNMLPASLSGYAPEVRGIARSNATVTVRQNGNVIYQTSVPPGAFVLKDLYPTSSGGDLAVTIQESDGSQTQYTLPFASVPNLVRNGQVKYALGAGKYRPAGNQISPSFAQGELFLGWRYGLTFYGGAQFSDRYTGLAFGIGQNLGRFGAYSLDLTHARSQLADNQHYTGDSVRLRYSKLLNDIGTRVNFFSLRYSTAGFYTLSDTTYKGMAGGAPEQTVEDDGTVTTHYDTVYNLHMSRKAKNQLLLSQPMGEYGALSLSWDQQTYWNTSKTTQSLQFAWNATFRNLSLGISAQRSSGLYDNKKDNILALSLSVPLGNPALSTRLRFTATHADPAGTTASTGVSGYLPGQENLFYSVNQRYSAQQHYGGDAALQYEGAWGDYNLGYSYAGDSRNLSYGMSGGAVLHEDGLTLSQPLGNTNILVKAPGASHVAVLNHKGIKTDSRGYAVIPYATPYRVNQVALDVTTVGNDVELENAIANKIPTDGALVRATLTTRQGAKAMFIVRHAKDVLPFGTLVSSEDDKASGIVGDGGSVYLTGLSAQGTLHAVWGRDSAQRCTIRYALNPQNYHARTGLYSQEAICQ

SEQ ID NO: 7922 - protein, 260 aa, Enterobacter cloacae
PMNITQIRNATQLITYAGKRFLIDPMLAPKGTYPGFPGTARADIRNPMVELPVDVQTLLDADAVIVTHTHADHWDQYAVELIAKGKPIYVQNDSDAALLRSQGFTNLTIMTGETTYGDIRIVKTHGGQHGTDRAYAVPELAEFLGEACGVVFRHPDEKTLYIAGDTIWRDAVAADLQKHQPDIVVLNAGYAHVIGFGPIIMGEEDLLNVHFLLPQAKIVATHMEAINHCLLTRRALREYVDANEISDAVSIPQDGETVIF

SEQ ID NO: 7923 - protein, 167 aa, Enterobacter cloacae
KRRFGYGMGDAASHIIFDNVMLYMMFFYTDIFGIPAGFVGTMFLLARALDAISDPCMGLIADRTRSRWGQVPSMDFVWRYPVRHRLRAGVYHAGPEPQRQNGLRRRYLHPADPALYRGQHPVLRAGRRDHQRPDAAYLPPVLALCAGDGGRYALYGADDAAGEPDWR

SEQ ID NO: 7924 - protein, 418 aa, Enterobacter cloacae
HIVKLKNRSGQRRALIPHHFSKSYHINAPRLKAVLTLFIAFFLCLLVFAIVFNFSETTLARGVLIPAQGDVEVRARESGTLVDFAVRPGQYVKENDPLFTVSQDYGGKQGSVVQFDRQQMEAEKKRSEQRIQAIEDSIASYRKNLAQQLALTDKQIAVSRDKVKKLRALLKNSTDTYEAWKSVSGKGYVSRVDLDKSHNDVLNAQLNLTLEESTILELEARKTSLTDSTQSQIDSLSEEQLYVKNRISEIDRNLSSRGSSTMAMLAPSDGYVVAINFPPGRAITQNSEVVVVIRKNTAATMEGYLYVPATGVGRVAKGDKVKLRFDSWPVDKYGSVEATLSDFYEVNIDAHSALIPLQEGQNYYLAKVRVPSWFTDPDKKKRMLMGGMTVNADIVIDRKPLINLLIAPLERVRKRFID

SEQ ID NO: 7925 - protein, 334 aa, Enterobacter cloacae
RGKERQMPLVNVAIVAVDGFSPFHYSVPCILFGDTVSGEKRFNVTICAEKPGFLTSKDGFALHATQDFSAIASAEIVVVPYWQHVLERPPQTLLDSLVQARDNGAEIVGLCLGSFVLGYAGILSGKRAATHWEFEHQFQTLFPDVRLDINALYVDDGNVITSAGTAAALDCCLYIIRQRFGSVVANQIARRMIVPPHREGGQAQFIAQPVPKDTRDGRINCLIDYLQQHISEPHNLDSLADVVSMSRRTLTRHFIKATGMSVADWLTAERLRRSQILLESGSLPIESVAEQVGFLSAVTYRQQFKARFGVSPAEWRKTFRVKPYAAKNNAGAME

SEQ ID NO: 7926 - protein, 284 aa, Enterobacter cloacae
MSSHTCGDPGSTSVNRRIHTAPMHKHYIINNIVEFHPAASTLRDINNPDRVVVLNSPAGRCLLLLIDRAGSIVTQQEFLDIVWQSHGMLVSSNTYYQNISILRKGLKKIGFETDPIVTIPRIGLTLASDTQITVRESSPVAPQPAEEQCVEAPAIEEVSASSAPATPVARKPTRWLAVVMGLLIVLAGAGVTGYMNATENRFVEDYRFAASVGACRVYLANDIQTHAERASALTYVEQFKAECAQYPWVYISWYALLPRASVIRCDRPMKEPNRCISDYFLKDS

SEQ ID NO: 7927 - protein, 329 aa, Enterobacter cloacae
MKSVFDSSDGGKSVPEKCLHIGLILWPRYSLLAVSGLLEALRYAAKAQDKLAFKISLISEFPDIPIISNAGIIMRPDSTHAPPDSFNYLAVIGGELQYLDLGYQGDKAYLAHAHHAGVPLIGIGTGSFVLAQEGLLNERRASIHPFHLDAFRQAFPLVYAEQGYDFIDDGDVLTCPGGISTLTLATELIRAHAGDDIASTTCQRLSLVPHEIATPRPANLALIPDSRLRRAVMLIEQFLTRPLTTAGLAREVALSERQLNRLFHAEFGKTAREFIRSARLRYACWLLKNSQQSVTDIAQRMGFSDCAHFIRHFQTEYGCTPGVWRTSQS

SEQ ID NO: 7928 - protein, 163 aa, Enterobacter cloacae
ISLHCCPETLLNRNITMKIEAAHPSQFERLVAVWESSVRATHRFLQESDIAALRPLLLNAYLPNLRVVIARDDVGIIHGFLGVDKNRIEMLFVDDASRGKGIGKMLLQYAIAEFGVNEVDVNEQNPQGVAFYRHMGFEQVGRSELDGQGNPFPLLHMRLSGQA

SEQ ID NO: 7929 - protein, 386 aa, Enterobacter cloacae
LPTAPAAAGGKFRPWILFGAIPFGIVCVLAYTTPDLSLNGKMVYAAVTYTLLTLLYTVVNIPYCALGGVITNDPTQRISLQSWRFVLATAGGMLSTVLMMPLVNLIGGDDKAFGFQGGIAVLSVVAFLMLAFCFFTTKERIQVPPSTTSMREDMRDIWQNDQWRIVGVLTILNILAVCVRGGAMMYYCTWIMGSPEVFVAFLTTYCVGNLIGSALAKPLTDWKCKVSIFWWTNAALAVVSVAMFFVPMHATVLMFGFIFRYRRAAPAGDADSVGNDVRYRRIRRMDQRQTPDRHQLCGHAVRAEARPGAGRGDDRLDAGRRRLRRGGQNPEQRDHQYHYRSVYAGASDLLRAERHHRQTLLHAENPFPDQNPARAGAGCAPQSAGV

SEQ ID NO: 7930 - protein, 399 aa, Enterobacter cloacae
YVYLRPLVKTLLTMLLMGVFFLIRFSLIGPYQRAVDDSIERTAQYESLLVETQKGIITLKANNMEQARDAVMDKSQREHIAGLMRKERLLARFDVASLLVINAEQLLVVCFGAWLILEGQMSIGMLYAYISYKRYFSDAMVQVAQKLLDKNALKGPLDRVGDLLFAPSETSQFGKRIVTSPVCLQFEDVSFAYPGREATLQHINMTLKQGEEAVIVGQSGSGKTTLLRLISGMLLASSGTLRINKIPIEECDLSSLRQHIRIVHADDILFTGSILDNIACFDSAPDKEQVIAACRLAEVDHVVARLPHGYETEMLPGNTFFSAGEMQRLVLARALYSQPKLLLCDEVTANLDKTTAQKVLANLRSLGIGLVFVTHSPDVVGCQGRLYTMENGTLRESEQ

SEQ ID NO: 7931 - protein, 179 aa, Enterobacter cloacae
MKGVLMRLWPVVTGVAIALTLVACKSPTPPKGVQPITGFDASRYLGKWYEVARLENRFERGLEQVTATYGKRSDGGISVLNRGYDPVKNKWNESEGKAYFTGEPTTAALKVSFFGPFYGGYNVIKLDDKYQYALVSGPNRDYLWILSRTPTIPDAVKQDYLNTARGLGFRVDQLVWVKH

SEQ ID NO: 7932 - protein, 163 aa, Enterobacter cloacae
RIASMTRFRQMLYIIVTGLVMAGVLTGYYLWHRTYVQPFSCQANLVQHHPDETLTVWLNYTFDGKFGTLSMNGRAKSDPGKTIDRKISFRVERQDHLYLLTSEKNMTFPDDNVDDSWLEKYEPQFFVYPGKSIYMRINEQHNGNYIFTLGTLPTYVCRGSKKE

SEQ ID NO: 7933 - protein, 144 aa, Enterobacter cloacae
CSASSFVIGVLHQLVTPIQWVMMSDTVEYGEWTNGKRLTGISFAGTLFVLKLGLALGGAMIGWMLAGGGYDAAAKTQNSATISIIIGLFTLAPAICYVLSAIIAKRYYTLKTPFLTKILRELAQGARRNQQEFENLPVSKELQN

SEQ ID NO: 7934 - protein, 792 aa, Enterobacter cloacae
EDESMKISDGNWLIQPGLNVTYPVQVFDVEQQGNDLVVYVAPRDVRERTWQLDTLMFTVRLFAPQEGIVGVRIEHFQGALNKGPHYPLNVLKDVKVEIENNAEFAELKSGSVSVRVTKGEFWALDFLRNGQRITGSQLKNNGYVQDNNTDRNYVFERLDLGVGETVYGLGERFTALVRNGQTVETWNRDGGTSTEQSYKNIPFYLTNRGYGVLVNHPENVSFEVGSEKVSKVQFSVEGEYLEYFVIDGPTPKEVLNRYTRFTGRPALPPAWSFGLWLTTSFTTNYDEATVNSFIDGMAERDLPLHVFHFDCFWMKAFQWCDFEWDPVTFPDPEGMIRRLKEKGLKVCVWINPYIGQKSPIFRELKEKGYLLKRPDGSLWQWDKWQPGLAIYDFTNPDACRWYADKLKGLVEIGVDCFKTDFGERIPTDVQWFDGSDPQKMHNHYAYIYNELVWNVLKETVGEEEAVLFARSASVGAQQFPVHWGGDCYANYESMAESLRGGLSIGLSGFGFWSHDIGGFENTAPAHVYKRWCAFGLFSSHSRLHGSKSYRVPWAYDDESCDVVRHFTQLKCQLMPYLYRQAALAREFGTPMLRAMMLEFPDDPACDYLDRQYMLGDSMMVAPVFSEAGDVQFYLPEGRWTHLWHNDEIEGSRWHKQQHDFMSLPVYVRDNTLLALGNNNQKPDYAWHEGTAFQLFNLSDGATAVSEVPAADGSVLFTLKASRQGDVVTFTGTGDAQNWSVCLRNVQKVGGVKGGSHAGSEWGVVVKAEGDEVMVHLCAVFTSERPIRDYLPQ

SEQ ID NO: 7935 - protein, 338 aa, Enterobacter cloacae
GFLTMQPISGTPPRPPGEGPVTPNTPGEQPLSTQQRTVLERLITRLIALTSQQNAEVWAGVKHDLGVRNDAQLQSRHFPAAEQNLNQRLTSAQQQHTTRQIISQLTELLGQGNNRQAVSDFIRQQYGHTALSQLSPEQLKTVLTLLQSNQLSIPQPQQRPSTERPLQPAEHNTLKQMVTKLAAATGEPTKLIWQSMLELSGVKAGEMIPAKQFTHLVTWLQARQTLSTQSAPTLHSVQAALKQPLEPHEFDTIRDYAQQSWQATPQTVLTTAQVQDVLNQIFVRRAEREGGVPEVRNIQPIYNPLFAPVVDTFKTLSARPGLMLIALVIALAIFWLVA

SEQ ID NO: 7936 - protein, 339 aa, Enterobacter cloacae
  UNSURE (314)
LNEVMVMSQKTLFKQTALAVAVAIVSTSAWSAGFQLNEFSSSGLGRAYSGEGAIADDAGNASRNPALIMMFDRPTFSAGAVYIDPDVNISGKSQFTGADLKADNIAPTAWVPNLHFVAPINEQFGWGASVTSNYGLATEFNNNYPAGEYGGKTDLTTLNLNLSGAYRLNDNWSFGLGFDAVYADAKIERYSGEQTAALPKNSNKIASLKGDEWGYGWNAGILYELDKNNRWGLTYRSEVKIDFDGDYKSGILSPVNGMVPGAGTTIPWGTSNQTVPGSLSLHLPKMWEVSGYNRVAPQWAIHYSLAYTSWNQFXELKSTGSNGQTLFYKEEKLTMLYLS

SEQ ID NO: 7937 - protein, 60 aa, Enterobacter cloacae
LFVARREGSSDGAAASPARTSSAAPSGGWAGSACVAAGSISGSSRSPGLGTSGMAANSSW

SEQ ID NO: 7938 - protein, 100 aa, Enterobacter cloacae
PPSAVPRTCGATRFTTSTPSAGKISEQPQPVNAAPSSATDAEGACQSSTRPTVSMTSDDTATFTPPKRSSIQPNSTRINTNAPPKAVSVKPAIAQPRLMK

SEQ ID NO: 7939 - protein, 723 aa, Enterobacter cloacae
SLHVSFNTSVSRTIKSFESHNSVHLYAEQVRSAIFCGNLHRWAHIAKIVPLPVGRVTYVKQNAIQPANLEFNAEGTPVSRDFDDVYFSNDNGLEETRYVFLEGNHLSTRFPEHPRRLFVVAESGFGTGLNFLTLWQAFDCFRAAYPEATLQRLHFISFEKFPLTAHDLRLAHQRWPELAHWAEQLQTQWPPAIGGCHRLILDDGRVTLDLWLGDINDLTDKLDDSMNQKVDAWFLDGFAPAKNPDMWSPHLFSAMARLARPGATLATFTSAGFVRRGLQEAGFTMRKTKGFGRKRDMLVGVMEQDLAIPAQAPWFARRASTSREVAIVGGGIASALLSLALLHRGWQVTLYCADEAPATGASGNRQGALYPLLSSHDPALFQFFPAAFTFARRLYDSLPVAFDHDWCGVTQLGWDEKSQQKITQMLSLGLPEDIAHAVTAQQVTETTGVDTGCGGIQYPLGGWLCPAELTSAAIALGQSRGLTVHYAHKVQSLSRTAHWKLRFADGKEAQHASVVLANGHHITQFTQTASLAVYPVGGQVSHIPTAPQLSKLRQVLCYDGYLTPQNPSNGHHCIGASYHRGETDMQYSEADQQQNRQRLVDCFPDASWAKEVDVSEGQARCGVRCATRDHLPMAGNVPDYDATLEVYQDLADSKETAVSAPVHPELFMLGGLGSRGLCSAPLLAEALAAQMSDEPVPLDRVTLAGLNPNRLWVRKLLKGKMVK

SEQ ID NO: 7940 - protein, 184 aa, Enterobacter cloacae
RMKKKTSLSEEDQALFRQLMTGTRQITHDTIVHRPQRKKISEVPVKRLLQEQADNSHYFSDEFQPLLSTQGAVKYVREDVSHFELKKLRRGDYSPELFLDLHGLTQMQAKQELGALIAACRREHVFCACVMHGHGKHILKQQTPLWLAQHPHVMAFHQAPKEYGGDAALLVLIEVEEWQPPELP

SEQ ID NO: 7941 - protein, 166 aa, Enterobacter cloacae
QKRCNMQVFIMRHGDAALDAASDSVRPLTVCGCDESRQMATWLKGQKVDIERVLVSPFLRAEQTLDVVGECMNLPSSVDVLPELTPCGDVGLVSAYLQALCNEGVASALVISHLPLVGYLVSELCPGETPPMFTTSAIANVTLDETGKGVFNWQMSPCNLKMAKAI

SEQ ID NO: 7942 - protein, 273 aa, Enterobacter cloacae
ACTLMDNFVDLFMVSPLLLAVLFFVAMLAGFIDALAGGGGLLTVPALLAAGMSPAQALATNKLQACGGSLSSSLYFIRRKVVNLADQKLNILMTFIGSTAGALLVQHVQSDILRQILPLLVICIGLYFLLMPKLGEEDRQRRLHGLPFALIAGGCVGFYDGFFGPGAGSFYALAFVTLAGFNLAKSTAHAKVLNATSNVGGLLLFIIGGKVIWATGFVMMAGQFLGARAGSRLVLSKGQKLIRPMIVVVSAVMSAKLLYDSHGQEILTWLGMN

SEQ ID NO: 7943 - protein, 121 aa, Enterobacter cloacae
SRLYRIITTRRRSRRNASRGRKIFNRGKKMIAEFESRILALIDDMVEHASDDELFASGYLRGHLTLAVAALEAGDDHSADAVHAEVTRSLENAIQAGELSPRDQSLVLGMWDNLFQQAKAK

SEQ ID NO: 7944 - protein, 405 aa, Enterobacter cloacae
MKRAVITGLGIVSSIGNNQQEVLASLREGRSGITFSEEFKDSGMRSHVWGNVKLDTTGLIDRKVVRFMNDASIYAYLSMQEAIKDSGLSEDVYQNNPRVGLIAGSGGSSKAQVFGADAMRSPRGLKAVGPYVVTKAMGSAVSACLATPFKIHGVNYSISSACATSAHCIGNAVEQIQLGKQDIVFAGGGEELGWEMACEFDAMGALSTKYNETPDKASRTYDAHRDGFVIAGGGGMVVVEELEHALARGAHIYAEIVGYGATSDGADMVAPSGEGAVRCMKMAMHGVDTPIDYLNSHGTSTPVGDVKELGAIREVFGDNSPAISATKAMTGHSLGAAGVQEAIYSLLMLENGFIAPSINIEEMDEQAAGLNIVTETTERELTTVMSNSFGFGGTNATLVMRKLKA

SEQ ID NO: 7945 - protein, 333 aa, Enterobacter cloacae
CATFMVCWRQKWHYSPLTAKLAYDQVQAERLSMSWIERIKSNITPTRKASIPEGVWTKCDSCGQVLYRAELERNLEVCPKCDHHMRMSARNRLHSLLDEGSLVELGSELEPKDVLKFRDSKKYKDRLASAQKETGEKDALIVMKGTLHEMPVVAAAFEFSFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPNPDEPREGVVVPDQEPEA

SEQ ID NO: 7946 - protein, 123 aa, Enterobacter cloacae
NQIHLHGSRRRRAAGYRLCVRLRSRNADLPVRPALILFARAYDRVGRVRQRRNPATNLTNASAMQGHFLFLLCALARNFSLPRLAQCKKIVKTIIRSDHLMCAQNFFTGECYESGITAYHPTR

SEQ ID NO: 7947 - protein, 716 aa, Enterobacter cloacae
IMETTSAFNLAVRLDNVAVITIDVPDEKMNTLKAEFGVQVRAMLRQIRENKAIRGLVFISAKPDNFIAGADINMIARAKSAQEAEDLARQGQQVMAEIHALSIPVVAAIHGACLGGGLELALACHSRICTDDAKTVLGLPEVQLGLLPGSGGTQRLPRLVGVSTALEMILTGKQLRARQALKAGLVDEVVPHAILLEAAVERALKGRQAKRPLPVRERILAGPLGRTLLFNMVGKKTEQKTKGNYPAATRILKVIETGLSQGSSSGYAAEAKAFGELAMTPQSQALRGIFFASTEVKKDPGSEAEPAPLRAIGVLGGGLMGGGIAFVTASKGKLPVRIKDINPKGINHALQYSWQNLDRKVKRRHIKASERDKTLAMITGATDYSGFAHRDLVIEAVFEDLALKQQMVADVEQHCAPHTIFASNTSSLPIGDIAAKAVRPEKVIGLHYFSPVEKMPLVEVIPHATTSPQTIATVVKLAKKQGKTPIVVADKAGFYVNRILAPYINEAMRLLTEGEKIEHVDDALVKFGFPVGPIQLLDEVGIDTGTKIIPVLEAAYGDRFAPPANFVSAILKDDRKGRKNERGFYLYAAKGRKSKKQVDPSVYALIPVTGQAKLSAVQCAERCVMMMLNEAARCFGEQVIKSARDGDIGAVFGIGFPPFLGGPFRYMDTLGAGEVVAILQRLASQYGPRFTPCDELLQMAERGQTFWPVRETDCVN

SEQ ID NO: 7948 - protein, 71 aa, Enterobacter cloacae
KIVAVIGLLLEQTFDRNLADFFTLRAMDNGVVRDLTRPGHQLAEESLILLAERCFLFHSSFSSRISDSVPD

SEQ ID NO: 7949 - protein, 324 aa, Enterobacter cloacae
DDHQRASRSVRGDPRGTDRRSDAGDRADGSLPAPARAECGCDDHHSTLVTMKKTAIALLALLVSGASLAATPWQKITHPVAGSAQSIGAFSNGCIVGAQELPLQSDTYQVMRTDQRRYFGHPDLVLFIQRLGNQVHNLGLGTMLIGDMGMPAGGRFNGGHASHQTGLDVDIFLQLPKTRWSSAQLLKPQALDLVSADGKRVVASRWSPEISSMIKLAAEDNDVTRIFVNPAIKQQLCLDAGTDRDWLRKVRPWFQHRAHMHVRLRCPANSLECEDQPLPPPGDGCGYELQSWFEPAKPGTSKPEKKTPPPLPPSCQALLDEHVL

SEQ ID NO: 7950 - protein, 303 aa, Enterobacter cloacae
AGAVLVCCRQRAFRRRADGGQNRGKTGAGVSVLMSDVEQKPVHRIALGIEYDGSKYYGWQRQNEVRSVQEKLEKALSQVANEPISVFCAGRTDAGVHGTGQVVHFDTTAVRKDAAWTLGVNANLPGDIAVRWVKAVPDDFHARFSATARRYRYVIYNQRLRPAVLSQGVTHFYEPLDAERMQRAAQCLIGENDFTSFRAVQCQSRTPWRNVMHINVSRYGAYVVVDIKANAFVHHMVRNIVGSLMEVGAGHQPESWIAELLAAKDRTLAAATAKAEGLYLVSVDYPDRFDLPKPPMGPLFLAD

SEQ ID NO: 7951 - protein, 426 aa, Enterobacter cloacae
QPGIMENKSIPQATSPLAAWLSYLENLHSKTIDMGLERVSQVAARLDVLKPAPFVFTVAGTNGKGTTCRTLESVLMAAGYKVGVYSSPHLVRYTERVRVQNTELAESAHTASFAAIEAARGETSLTYFEYGTLSALWLFKQAQLDVVILEVGLGGRLDATNMVDADVAVVTSIALDHTDWLGPDRESIGREKAGIFRANKPAVVGEPDMPHTIAEVAKEKGARLLRRGVDWQYEVQDNGWRFSDAQGVLESLPLSQVPQPNAATALAALRASGLAVSEQAIRDGIQNALLPGRFQIVSESPRLILDVAHNPHAAAYLAGRLKSLPKTGRVLAVIGMLHDKDIGGTLACMESVVDSWYCAPLEGPRGATAEQLMEHLGKGEIYSSVVSAWRAAMAEAKPEDTVLVCGSFHTVAHVMEVMDAGRTGGE

SEQ ID NO: 7952 - protein, 95 aa, Enterobacter cloacae
AMSKCSADETPVCCCMDVGTIMDNTDCTASYSRVFPNRAEAEETLAALSQRAREVESDPCEIKSTFTEVEGGVQLDIDFVFACEAETLIFQLGLR

SEQ ID NO: 7953 - protein, 447 aa, Enterobacter cloacae
CARKIFLQGSVMSQALPLITRHGDRIAIISGLRTPFARQATAFHGIPAVDLGKMVVGEMLARSEIPPEVIEQLVFGQVVQMPEAPNIAREIVLGTGMNVHTDAYSVSRACATSFQAVANVAESLMAGTIRAGIAGGADSSSVLPIGVSKQLARILVDANKARTTGAKLKLFSRLRLRDLMPVPPAVAEYSTGLRMGDTAEQMAKTYGITREQQDALAHRSHQLAAKAWSEGKLADEVMTAYIPPFREPLVEDNNIRGTSTLEDYAKLRPAFDRKHGTVTAANSTPLTDGAAAVILMTESRAKELGITPLGYLRSYAFTAIDVWQDMLLGPAWSTPLALERAGLTLADLTLIDMHEAFAAQTLANIQLLASERFARDVLGRAHATGEVDQSKFNVLGGSIAYGHPFAATGARMITQTLHELRRRGGGFGLVTACAAGGLGAAMVLEAE

SEQ ID NO: 7954 - protein, 340 aa, Enterobacter cloacae
PQATRVIADLSPSSWQTSRRKLCEHALEERVDKIFVDEAVNELHTIQDMLRWSVSRFSAANIWYGHGTDNPWDEAVQLVLPSLYLPLDIPEDMRTARLTSSEKHRIVERVIRRVNERIPVAYLTNKAWFCGHEFYVDERVLVPRSPIGELINNHFDGLINHQPQHILDMCTGSGCIAIACAYAFPEAEVDAVDISTDALAVTEHNIEEHGLIHHVTPIRSDLFRDLPTLQYDLIVTNPPYVDAEDMSDLPNEYRHEPELGLASGSDGLKLTRRILACAPDYLTDDGVLICEVGNSMVHLIEQYPDVPFTWLEFDNGGDGVFMLTKAQLLDAREYFSIYKD

SEQ ID NO: 7955 - protein, 381 aa, Enterobacter cloacae
SSGLRPVSQRSNTNNNIGAVMAGNSIGQVFRVTTFGESHGLALGCIVDGVPPGIELTEADLQHDLDRRRPGTSRYTTQRREPDQVKILSGVFEGRTTGTSIGLLIENTDQRSQDYGAIKDVFRPGHADYTYEQKYGFRDYRGGGRSSARETAMRVAAGAIAKKYLQQKFGIVIRGCLTQMGDIPLAIKDWEQVELNPFFCADADKLDALDELMRGLKKEGDSIGAKVTVVADGVPAGWGEPVFDRLDADIAHALMSINAVKGVEIGDGFDVVKLRGSQNRDEITKAGFQSNHAGGILGGISSGQQIIANIALKPTSSITVPGHTINRAGDEVEMITKGRHDPCVGIRAVPIAEAMLAIVLMDHFLRQRAQNADVTTTIPRW

SEQ ID NO: 7956 - protein, 179 aa, Enterobacter cloacae
SCESRRSEAQYPDDVYWLNGGRAAGPARTVRHSAPDPAAAGYLYRPLFLTHAKARGRRSTASPSRPAVCADRRWLRRFLRWLLWPGGRLVLRAGIRDAGRVQPRQIHRPRQSPQRDLQRWRSAAVYHWRQGYLGNRVCDDGRAVFGRARRLASGIKQRAKADPPDDCCRLGGDERQTSL

SEQ ID NO: 7957 - protein, 195 aa, Enterobacter cloacae
QPWTGDPHLVGDELMNSTHNYEQLIEIFDSCFADDFNTRLIKGDDEPIYLPADDEVPYNRIIFAHGFYASGLHEISHWCIAGKARRELVDFGYWYCPDGRDAATQGQFEDVEVKPQALEWLFCVAAGFPFNVSCDNLEGDFEPDRIVFQRRVHAQVMEYLEKGIPARPARLIEALQNYYHTPEITAERFPWPEDL

SEQ ID NO: 7958 - protein, 412 aa, Enterobacter cloacae
RYSRREPRGSLFLCLNTELCMKAVTPEKSAPSGNLSLFRIAFAVFLTYMTVGLPLPVIPLFVHQELGYGNTMVGIAVGIQFLATVLTRGYAGRLADQHGAKRSALQGMFACGLAGGAWLLAALLPIDAAYKFALLVVGRLILGFGESQLLTGTLTWGMGLVGPARSGKVMSWNGMAIYGALAAGAPLGLLIHSQFGFAALAGTTMVLPLLAWAFNGSVRKVPAHKGERPSLWSVVGQIWQPGLGLALQGVGFAVIGTFVSLYFMSRGWAMAGFTLTAFGGAFVLMRVLFGWMLDRFGGVKVAVSSLVIETVGLVLLWQAPSASVALLGAALTGCGCSLIFPALGVEVVKRVAPQVRGTALGGYAAFQDISYGITGPLAGLLATSFGYPSVFLAGAVSAVVGIVVTMVAFRKR

SEQ ID NO: 7959 - protein, 388 aa, Enterobacter cloacae
VYFLSNRYSDVKILVDENMPYARELFSRLGEVKAVPGRPIPVSELDDADALMVRSVTKVNEALLTGKGVKFVGTATAGTDHVDDQWLKQAGIGFSAAPGCNAIAVVEYVFSSLLMLAERDGFTLKDRTVGIVGVGNVGGRLQKRLEAWGISTLLCDPPRKDNGDEGDFRTLDELVDECDVITFHTPLFKEGPYKTLHLADEKLIRRLKAGTILINACRGPVVDNAALLACLDEGQELSVVLDVWEPEPDLNVALLDKVDVGTAHIAGYTLEGKARGTTQVFEAYSAFIGHPQQVALDTLLPAPEFGRITLHGLLDEATLKRLVHLVYDVRRDDALLRKVAGIPGEFDKLRKNYLERREWSSLYVMCDDASAAGLLHKLGFNAVHHPAR

SEQ ID NO: 7960 - protein, 339 aa, Enterobacter cloacae
TTMSEGWNIAILGATGAVGEALLETLAERQFPVGEIYALARTDSAGEQLRFGGKSLMVQDAAAFDWTQAQLAFFAAGAQATASYIEEATNSGCLVIDLSGLFSLEPDVSLVVPDVNPFVLADYRNRNIIAVPNSLTSQLLTALKPLIDDGGLSRISVTSLLSASANGKKAVDALAGQSAKLLNGIPIDEDDFFGRQLAFNMLPLLPDREGSVREERRIVDEARKILQDDGLMISANVVQSPVFYGHAQMVGFEALRPLAAEEARDAFGRGEDIVLSEESEFPTQVGDATGSAHLSVGCVRNDYGMPEQVQFWSVADNVRFGGALMAVKIAEKLVQEYLY

SEQ ID NO: 7961 - protein, 223 aa, Enterobacter cloacae
GLDNMDVIRFLIDFILHIDVHLAELVAQYGVWVYAILFLILFCETGLVVTPFLPGDSLLFVAGALSALPTNDLNVHLMVVLMIIAAIVGDAVNYTIGRVFGERLFSNPDSKIFRRSYLDKTHAFYERHGGKTIILARFVPIVRTFAPFVAGMGHMSYRHFAMYNVVGALLWVLLFTYAGYLFGDLPVVQENLKLLIVAIIVLSVLPGVIEIIRHKRAAAKQAK

SEQ ID NO: 7962 - protein, 113 aa, Enterobacter cloacae
WTRGEPVASKFQNRLTGTIVLVALGVIILPGLLDGQKKHYQDEFAAIPLVPKPGDRDEPDMLPAATQALPAQPPEGAAEEVRAGDAAAPSLDPSRLATNNHILHQGSCRSASH

SEQ ID NO: 7963 - protein, 257 aa, Enterobacter cloacae
  UNSURE (252)
VKDYMVARTSRKERFSMFRDRPLKRMKSPRDEDDVEDDIDGLDDDGVGEVRVHRVNTAPGAAHGEHEAPRAPQHQYQPPYASAQPRQPAPPPVEEPVRHPPHQPVQQQPVAPQPVQPQPVQQPAQPVHQPQPVQQPQPVQQPQPQPEPPAPQPAPRAEPEPVAEPEPVVEKPQRKEAVIIMNVAAHHGTHLNGDVLLNSIQQAGFKFGDMNIFHRHLSPDGSGPALFSLANMVNPGTLVFYLGNSTDARKNXISPPA

SEQ ID NO: 7964 - protein, 270 aa, Enterobacter cloacae
IPPAVTISSGRFMHADRSTQRATTRLCIQCGLFLLQHGAESALVEELSTRLGLALGMDSVESSISSNAIVLTTIKDGQCLTSTRKNHDRGINMHVVTEVQHIVILAEHRLLDLREIEKRFNQIKPLRYPRWLVVLMVGLSCACFCKLNAGGWDGAVVTFFASSIAMYVRQLLTHRQLHPQINFCITAFVATTVSGLLLRQPYFASTPTVAMAASVLLLVPGFPLINAVADMFKGHINTGLARWAIASLLTLATCIGVVMAMTLWGLRGWA

SEQ ID NO: 7965 - protein, 492 aa, Enterobacter cloacae
GDCKMKKINHWINGKNVAGSEYFQTTNPASGEVLAEVASGGEAEIHQAVAAAKEAFPKWANLPMKERARLMRRLGDLIDQNVPDIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQIGALISQQHWEKVSGYIRLGIEEGATLLAGGPDKPTDLPAHLKGGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHPIPKWGI

SEQ ID NO: 7966 - protein, 109 aa, Enterobacter cloacae
RRLRRPARMGEPENCRRPRAERPQDRPYLQSDAGQLADQRAGLRCAAGRYVLPRRQRHPRGSLYRPAHRSGAGLRAGKTAARPELHDLRRLQRHGLRHPRPGADRRPLP

SEQ ID NO: 7967 - protein, 113 aa, Enterobacter cloacae
GPYGQRNPVRAGAGRRREDLLTPLIKHVTVGPDRCAPPGFFYLEPSMFGNLGEAKKYLGQAAKMLIGIPDYDNYVEHMKTNHPDKPYMTYTEFFRERQEARYGGSGEGGVRCC

SEQ ID NO: 7968 - protein, 162 aa, Enterobacter cloacae
LAIVSRTIYIHFMDAKMNDTTNALLLDNQLCFALYSANLALNKLYRQLLAPLNLTYPQYLVMLVLWEQDDITVSDIGERLFLDSATLTPLLKRLESAGLIFRQRSRQDERQVAVTLSDAGRALQQQAVTIPHAVGCAAQCDTDTMLALKHQLELLRQQLHRA

SEQ ID NO: 7969 - protein, 147 aa, Enterobacter cloacae
DEEPAMSLEKVVYTAKAKATGGRDGRATSSDGVLDVKLGVPKEMGGMGGEVTNPEQLFAAGYSACFLGAMKFVAARDKFALPKDAFIEGEVGIGPLPTGFGIEAKLNIHVEGMDAAEAKKLVDAAHIVCPYSNATRGNIDVTLNIIA

SEQ ID NO: 7970 - protein, 251 aa, Enterobacter cloacae
WIPRCEMKNVGDLMKRLQKMMPANVKPAFTTGEELLAWQKEQGKIRAAALARENRAMKMQRTFNRSGIRPLHQNCSFENYKVESQGQMNALNQARQYVDEFDGNIASFIFSGKPGTGKNHLAAAICNELLLRGKSVLIITVADIMSAMKDTFSNRETSEEQLLNDLSNVDLLVIDEIGVQTESRYEKVIINQIVDRRSSSKRPTGMLTNHNIDEMTRLLGERVMDRMKLGNSLYVIFDWDSYRSRVTGKEY

SEQ ID NO: 7971 - protein, 162 aa, Enterobacter cloacae
IIMKKQFLISILTGTLLVTGAAQAASWQESLSSAASELTKESGTSQGGLSASSLTGLLSNSSQSLSAGTMNNAAGILEYCAKQKLASVTDTENIKNQVLGKLGLDTQEQKADTNYMDGIQGLLNAQNGQQLNLSTLGNSSLAKQVKTKACDLVLKQGVNFLS

SEQ ID NO: 7972 - protein, 176 aa, Enterobacter cloacae
NCEQRWLMTAFTLRPTRIDDVAALPAIERAAGQRFRDVPELAWLADNEVICVEDHLGYAGRGLSWLALADDRPVGFILAEAHPSSLFIVELSVHLDWQGRGLGRQLIARAVAHARSLGLNSLTLTTFRDVPWNAPFYRRLGFEMLTTLTPELRQKREEETAHGLAYGSRCAMRLPL

SEQ ID NO: 7973 - protein, 437 aa, Enterobacter cloacae
NQNRTAGLRSMGMKGTVFAVALNHQSQRAAWAEAFEKAPYNAPPKTAVWFIKPHNTVIRAGEPIPFPQGETVLSGATVALVVGKTASKVRVEEAAAYIAGYALANEISLPEESFYRPAIKAKCRDGFCPLGEPVAVDNVDNLTIITEINGREADHWNTADLHRNAAELLSALSEFATLNPGDAILLGTPQSRVEIRPGDRVRILAEGFPPLENPVVVERDVTIASRTPPHATLFALGLNYADHASELDFKPPTEPLVFIKAPNTFNGDNQTSVRPNNIEYMHYEAELVVVIGKTARKVSEAEAMDYVAGYTVCNDYAIRDYLENYYRPNLRVKSRDGLTPISPNVVPKEAIPDPHNLRLRTYVNGELRQEGTTADLIFSIPFLIAYLSDFMTLQPGDMIATGTPKGLSDVVPGDEVVVEVEGVGRLVNRIVSEETAK

SEQ ID NO: 7974 - protein, 272 aa, Enterobacter cloacae
KQDIAMLDKHTHTLIAHRLHQAEQSREQIRAISLEYPEITIEDAYAVQREWVSLKIAEGRVLKGHKIGLTSKAMQASSQISEPDYGALLDDMFFHDGSDIPVDRFIVPRIEVELAFVLAKPLRGPNCTIFDVYNATDYVIPALELIDARCHNVDPETQRPRKVFDTISDNAANAGVILGGRPIKPDELDLRWISALLYRNGVIEETGVAAGVLNHPANGVAWLANKLAPYDVQLEPGQIILGGSFTRPVAASRGDTFHVDYGNMGSISCRFV

SEQ ID NO: 7975 - protein, 179 aa, Enterobacter cloacae
AAEITQREVSMQSEERLRFRDAMASLSAAVNVVTTEGDAGRCGITATAVCSVTDTPPSVMVCINANSAMNPVFQGNGKLCVNVLNHEQEIMARHFAGMTGMAMEERFALSCWQKGPLAQPVLKGALASLEGEITQVQTIGTHLVYLVEIKNIILSSEGHGLIYFKRRFHPVMMEMEAAV

SEQ ID NO: 7976 - protein, 772 aa, Enterobacter cloacae
PLTLAFDRSRIAFNHSPIYRALYARGSGTIAPALINTSSQRTLTLFSLHKKPGLTMDTKKLLKHVPWAILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGSSLGEMIKEEMGRVPGTIALFGCFLIMIIILAVLALIVVKALAESPWGVFTVCSTVPIALFMGIYMRFLRPGRVGEVSVIGIVLLVASIYFGGVIAHDPYWGPALTFKDTTITFALIGYAFISALLPVWLILAPRDYLATFLKIGVIVGLAIGIVIINPELKMPAVTQYIDGTGPLWKGALFPFLFITIACGAVSGFHALIASGTTPKLMANETDARFIGYGAMLMESFVAIMALVAASIIEPGLYFAMNTPPAGLGITMPNLHEMGGENTALILAQLKDASAHAAATVSSWGFVISPEQIMQTAKDIGEPSVLNRAGGAPTLAVGIAHVFHKVLPWADMGFWYHFGILFEALFILTALDAGTRAGRFMLQDLLGNFVPFLKKTDSLVAGVLGTAGCVGLWGYLLYQGVVDPLGGVKSLWPLFGISNQMLAAVALVLGTVVLVKMKRTKYIWVTVVPALWLLLCTTWALGLKLFSTNPQLEGFFFMANQYKEKIAAGGADLTAQQIANMNHIVVNNYTNAGLSILFLVVVYSIIFYGIKTWMKVRNVEGRTDKETPYVPVPEGGVKTSSHH

SEQ ID NO: 7977 - protein, 232 aa, Enterobacter cloacae
LTLNSSASVRKRATAEVEKAASAAAKGETMTPIAVTLLTGFLGAGKTTLLRHILNEQHGFKIAVIENEFGEVSVDDQLIGDRATQIKTLTNGCICCTRSNELEDALLDLLDSRDRGDIVFDRLVIECTGMADPGPIIQTFFSHEIICQRYLLDGVIALVDAVHADEQMNQFTIAQSQVGYADRILLTKTDVAGESEKLRERLTRINSRAPIYTVTHGDIDLAQLFNTNGFML

SEQ ID NO: 7978 - protein, 195 aa, Enterobacter cloacae
YVQRPHQHRSGALGDSQPADAGDLYRGGNGHDTLGVTRMGVIDFLLALAQDMLLAALPAVGFAMVFNVPQRALPWCALLGAIGHGSRMIMMTAGFNIEWSTFIASMLVGSIGIQWSRWYLAHPKVFTVAAVIPMFPGISAYTAMISAVKISHFGYSEPQMILLLSNFLKASSIVGALSIGLSIPGLWLYRKRPRV

SEQ ID NO: 7979 - protein, 184 aa, Enterobacter cloacae
ESVMSSRILTTSIAGIDAFMRDPRGVLTHAEGGTLAVFADNAPAFYAVTPERLAQLLEIEAKLSRPASDVMLDNQFFDEPASAPVAVPMGKFPMYAGWQPDADFQRQAALWGIALAQPATPEELAAFTAYWQAEGKVFHHVQWQQKFARSLQINRASNNGQPKRDINAFSEPDKKIPDGFRGAK

SEQ ID NO: 7980 - protein, 777 aa, Enterobacter cloacae
AISRLSVRHDEDLLLSELMSLVLFLASIGVYAWKAGRHTWWFVATLVVLGIFIVLNITLYASDYFTGDGINDAVLYTLTNSLTGAGVGKYILPGLGLVVALVGIFAALAWVLRRRRHRPHHHGYSLLALCLALASVDASPAFHQITELVKSQSRDGDPDFAAYYKEPSKKIDNPRLNLVYIYGESLERTYFDNDAFPNLTPELGALKNQGLDFSHTMQLPGTDYTIAGMVASQCGIPLFAPFEGNASASMSSFFPQNICLGDILKNSGYENYFMQGANLRFAGKDVFLKSHGFDHLYGSEELKTTVADPAYRNDWGFYDDTVLDETWKKFEELSRAGKRFSLFALTVDTHHPDGFVSRTCKRQGYDIDGKNNKSFSAVTCSQEHIAALIEKIKASPYFKNTVIVVSSDHLAMKNSAWDELNKLDRSNLFFVLRGDKPQQEIIAAKRNSMDNGATVLDILGGDNFIGLSRSTLSGQSLSEIFLNMKEKILAWKPDIIRLWNFPKEIKDFTIDQDKKMIAFSGSHFRLPLLLRVSDNRVEPLPESEYSAPLRFQLAEFAPRDNFVWVDKCYKMGQLWSQQLSLSTDWCVSQGQLGGEQAVQHVDKPQWQGKTAFKDTVIDTARYQRNVDLLKIVDNDIRYKADSFIFNVAGAPEEVKQFSGISRPESWGRWSNAQLGDEVKIEYTHPLPEKFDLVITARAFGPNANRPIPVRVGDKEQTLTLSNDVTTSTLHFDNPTRSNTLVIVPPDPQSTNEGNILGHAPRKLGIGMVEIKIVSSAG

SEQ ID NO: 7981 - protein, 379 aa, Enterobacter cloacae
GRSGRPAPGERRGVWPGVVHLDPGRQQSAASGAQHRSGHGVRQHPERARPAPAVWRREGLRHRARRRRVQLRGIRGDEERVHLHGRPSDSKVGDLKMGKLALAAKITHVPSMYLSELPGKNHGCRQGAIDGHKEISKRCRELGVDTIIVFDTHWLVNSAYHINCADHFSGVYTSNELPHFIRDMTYDYDGNPELGQLIADEAVKLGVRAKAHNIPSLKLEYGTLVPMRYMNADKHFKVVSISAFCTVHDFADSRRLGEAIISAIEKYDGTVAVLASGSLSHRFIDDQRAEEGMNSYTREFDRQMDERVVKLWREGQFKEFCSMLPEYADYCYGEGNMHDTVMLLGMLGWDKYDGKVEFLTELFASSGTGQVNAVFPLPA

SEQ ID NO: 7982 - protein, 129 aa, Enterobacter cloacae
GVVMPHFIAECTNNIREQADLPGLFAKVNEALAATGIFPLGGIRSRAHWLDTWQMADGKHDYAFVHMTLKIGAGRSLESREEVGEMLFALIKTHFAELMAGRYLALSFELDELHPTLNYKQNNVHALFK

SEQ ID NO: 7983 - protein, 338 aa, Enterobacter cloacae
SKRPGSPQACLTTRRTAWRGWRTNSRHTTCSLSQDKSSSAARLPARLPPAEATPSTSTTATWAPSAAALCKEMTMQNAFKAALKAGRPQIGLWLGLTSSYSAELLAGAGFDWLLIDGEHAPNSVQTILTQLQAIAPYPSQPVVRPSWNDPVQIKQLLDVGAQTLLVPMVQNADEARLAVSATRYPPAGIRGVGSALARASRWNRIPEYLHQANDAMCVLVQIETREALKNLPQILDVEGVDGVFIGPADLSADMGFAGNPQHPEVQAAIEQAIAQILSAGKAPGILMANEQLAKRYLELGALFVAVGVDTTLLARSAEALAARFTDVTTAVDNNKSVY

SEQ ID NO: 7984 - protein, 454 aa, Enterobacter cloacae
TYDVERNMTTSTLHNKAVEHRVINKLFRRLIVFLFILFVFSFLDRINIGFAGLTMGKDLGLTSTMFGLAATLFYVTYVLCGIPSNIMLAKIGARRWIAGIMVVWGIASTCTMFATSPETLYVLRMLVGIAEAGFLPGILVYLTWWFPAYHRARANALFMIAMPVTMMLGSILSGYILAMDGLWNLKGWQWLFLLEGLPSVVLGVVTWFYLNDTPDQATWLDDDEKQALKTMIAREQELAIAHAATPRSTLREVLTPAVLLYTLAYFCLTNTLSAINIWTPQILQSFNTGSSNIVIGLLAAIPQFCTILGMIWWSRRSDRLKERKKHTILPYLFAAAGWMLASATDHSLIQLLGIIMASTGSFTAMAIFWTTPDQVISLQSRAVALAVINAIGNVGSAVSPLLIGILRDATGSFSSGLWFVAGLLVVGALVLTRIPMTRRESLEREPDIAAQKIH

SEQ ID NO: 7985 - protein, 313 aa, Enterobacter cloacae
GAAMCQSPITNIDISKEYDESLGTDDVHYQSFARMAAFFGRDMQAHRHDQYFQMHFLDTGQIELQLDDHRYSVQAPLFVLTPPSVPHAFITESDSDGHVLTVREDLIWPLLEVLYPGTREAFGLPGICLSLADKPDELAALKHYWQLIARESTEQLPGREHTLVLLAQAVFTLLLRNAKLDDHASGGMRGELKLFQRFNQLTDAHYHEHWTVPEYASELHLTESRLTDICRRFANRSPKRLIFDRQLREARRLLLFSDSTVSEIAWQLGFKDPAYFARFFNRLTGCSPSAYRAQKVPVSPVPLTPALSQMERE

SEQ ID NO: 7986 - protein, 561 aa, Enterobacter cloacae
SLAKSTCRCPNRPFTFRPSHASIKQQKQNINLTTIFRYEVPMKPEDFRADAKRPLTGEEYLNSLQDGREIYIYGERVKDVTTHPAFRNAAASIAQMYDALHKPDMQDTLCWGTDTGSGGYTHKFFRVAKSADDLRQQRDAIAEWSRLSYGWMGRTPDYKAAFGCALGANPAFYGQFEQNARNWYTRIQETGLYFNHAIVNPPIDRHKPADEVKDVYIKLEKETDAGIIVSGAKVVATNSALTHYNMIGFGSAQVMGENPDFALMFVAPMDAEGVKLISRASYEMVAGATGSPYDYPLSSRFDENDAILVMDHVLIPWENVLIYRDFDRCRRWTMEGGFARMYPLQACVRLAVKLDFITALLKKSLECTGTLEFRGVQADLGEVVAWRNMFWALSDSMCSEATPWVNGAYLPDHAALQTYRVMAPMAYAKIKNIIERNVTSGLIYLPSSARDLNNPQIDQYLAKYVRGSNGMDHVERIKILKLMWDAIGSEFGGRHELYEINYSGSQDEIRLQCLRQAQSSGNMDKMMAMVDRCMSEYDQHGWTVPHLHNNTDINMLDKLLK

SEQ ID NO: 7987 - protein, 567 aa, Enterobacter cloacae
FLPLTLICPFSDPPLWNRMVAHGDAHVLHLREYLEAVLAAFAPGAGGLHAAKRLAQVAHVLGVDEHHARFDVARQTQHFADVLGPDVRRQAILHVVRQAQAFRFVLKRQQAGHRPEDLFLRHAHAVIDIRQHGRAQEVAAFQVRRQIGRFVRAARQQGCPLFNAEADIAGDFFPVLLADERANLGVWIGRVAHAQAVGALGKAFDELRVDALLDEDARAGGAAFAVDGENGEQGGVQRALDVRVFKNQHRRFAAQLHRILLQPGVFHDVTPGGGAAGEGDGAHVMMTHQRVARRGAIALHHVEHARRNARFEGQLAQTVGGQRGEFRHLQHRGVTQRETGRDLPGGGHKRHVPRRHQRADTHRLHQGVVEHLVVDRVGFAVHLLAHLGEELEVVRGARNEHVFGLVDRQAGVGGLHRGNVRHVLVNQIPQATHQARTLLHRQVGPFRERLFGGGNGLMDFGFAPGGYFSQHLAGGRVSGLEVLTSGDVFPVDPVVNLFHFAVSSLTIRFTRRPTPSTSTTTSSPGTTSDSPFGVPVAIMSPGCRVMKSLRYAIRNGMLKMRSAVVPS

SEQ ID NO: 7988 - protein, 595 aa, Enterobacter cloacae
TWKPTYCRAGRRVKTLNSRMIFVKFSLSRPKILYLSEERENMLNRIKIVTSLLLVLAIFGLLQLTSGGLFFNALKHDKENFTILQTIRQQQSTLNGSWVALLQTRNTLNRAGIRYMMDQNNIGSGSTVAELMQIASASLKQAEKNWADYEALPRDPRQSDAAALEIKRNYDIYHGALAELIQLLGAGKINEFFDQPTQSYQDGFEKQYVTYLQQNDALYQTAVEDSNSSYRQAIWVLISVLAAVLVVIVAVWLGIRQALISPLNRLIDSIRHIASGDLVKRIDVEGSNEMGELADSLRHMQGELVRTVGDVRNGANAIYSGASEISMGNNDLSSRTEQQAASLEETAASMEQLTATVKQNAENARQASNLALSASETAQKGGKVVDNVVQTMRDIAGSSQKIADIISVIDGIAFQTNILALNAAVEAARAGEQGRGFAVVAGEVRNLAQRSAQAAREIKSLIEDSVGRVEIGSTLVESAGETMGEIVNAVTRVTDIMGEIASASDEQSRGIDQVGLAVAEMDRVTQQNASLVEESAAAAAALEEQASRLTQAVAVFRIQQEQMKAREFASAKSVAAPVVARKPATADAGDNWETF

SEQ ID NO: 7989 - protein, 151 aa, Enterobacter cloacae
CKGKVMHDSLTIALLQAREAAMGYFRPIVKRHNLTEQQWRIVRVLAEHPSMDFHDLAFRTCILRPSLTGILTRMERDGLVLRLKPVNDQRKLYVSLTKEGNALYQRAQAQVEEAYQQIEAEYTPEKMTQLTALLEEFIELGNRHIAARDEE

SEQ ID NO: 7990 - protein, 274 aa, Enterobacter cloacae
FCVVVWFCPAPFLAAKAQLIFNVIESFSQVIFGIINMIMRLAPIGAFGAMAFTIGKYGVGTLVQLGQLIVCFYITCILFVVVVLGSIARATGFSIFKFIRYIREELLIVLGTSSSESALPRMLDKMEKLGCRKSVVGLVIPTGYSFNLDGTSIYLTMAAVFIAQATNSHMDIFHQITLLVVLLLSSKGAAGVTGSGFIVLAATISAVGHLPVAGLALILGIDRFMSEARALTNLVGNGVATIVVAKWVKELDHKKLNDTLNNRTSEDKTPGLSS

SEQ ID NO: 7991 - protein, 500 aa, Enterobacter cloacae
SGVHMQGTKIRLLTGGLLMMAAASYVQADALQPDPAWQQGTLANGFQWQVLSTPQRPSDRIEIRLSVNTGSLTESTQQTGLSHFIPRLALTQSGSLQAVQVRSLWQQAIDPKRPLPPAVVSYDYTMFNLSLPNNRNDLLKEALTYLSDATGKLAITPETVNYALSNSDMVATWPTDTKEGWWRYRLKGSTLLGHDPAEPLKQPVDAEQVKSFYQQWYTPDAMTLIVVGNVDSRAVIEQINKAFGDLKGKRETPAPVPTLSPLRPETVSIMTDTVRQDRLSMMWDTAWQPIRESSALLRYWRADLAREALFWHVQQTLSKNNVKDIGLGFDCRVLFQRAQCAINVESPGDKLNANLGVVAKELAKVRKEGLSEEEFNALVAQKSLELQKLFATYARADTDILISQRIRSLQNQVVDIAPEQYQKLRQDFLNGLTVEMLNQDLRQQLSQDMALILLQPKGEPEYDMKELKATWNAIMATAPQPAQTAADDLHQDASDIPQGQ

SEQ ID NO: 7992 - protein, 273 aa, Enterobacter cloacae
LSDESRKAIPYNRTSEMKSEQVIQRLSTTPEASIENLQEHRYWLQCERAYTYQPIYRTDGRLMAIEVLTVVTHPSNPSQRIAPDRYFAEVAVRQRIDVLEEQLRMLATKQAFFKQHGILASVNVDGPTLMALRQNATLQALIATLPWMRFELVEHVQLPQDSSFASMCEFGPLWLDDFGTGMANFSALSEVRYDYIKVARDLFIMLRQTPEGRNLFTMLLQLMNRYCQGVIVEGVETLEEWRDVQNSPAAAAQGYFLSRPVPMDTLEKVITSL

SEQ ID NO: 7993 - protein, 253 aa, Enterobacter cloacae
IMSERIALVTGGSRGLGKNAVLKLAAEGTGIILTWNNSQQEAQEVVREIEGKGGKAAALQLNVGDTASFSRFAQKVKDTLKHVWQRDTFDYLVNNAGTGLYAPYTETTEAQFDDAMNIHFKGPFFLTQQLLPLIKDGGRILNVSSGLARFTQPGSGTYAAMKGAMEVLTRYQAKELGARGISVNIIAPGAIETDFGGGRVRDNAELNQLLASQTALGRVGLPDDIGDAIAALLSDKLGWMNAQRIEVSGGMFL

SEQ ID NO: 7994 - protein, 228 aa, Enterobacter cloacae
FVTSPFIEFFLKKCLCRIPLRYSQRSKTMRVIMFDRQSLFIHGAMYSLQKLIPKIDMTGTRQTDELWAQLSASPSAIVMIDGYLIRDNGVALLEEIMDRFPTSRVVLVLTKKERRWVEQMFQRNVVAIIPRNANPERFSAVLDSVSRGMVCFPGEWLKQHTSQDELAVLSERQREVLKLLAAGESNKEIGRNLNISAATVKAHLETLFRRLDVKNRTQAAMYYTRATA

SEQ ID NO: 7995 - protein, 742 aa, Enterobacter cloacae
IDDLPQFTAERHRLPAGPVSAAPPGSFPPRLALKSSTLNPITEQYAQRRMRASFTYFNRTAFMTNPLLTPFSLPPFSKILPEHVVPAVTQSLDNCRAAVESVVAQGGPYTWENLCQPLAEVDDVLGRIFSPVSHLNSVKNSPELREAYEQTLPLLSEYSTWVGQHEGLYKAYRDLRDGDHYAELNTAQKKSVDNALRDFELSGIGLPKEKQVRYGEIAARLSELGNQYSNNVLDATMGWTKLITDESELAGMPESALAAAKAQAEAKEQEGFLLTLDIPSYLPVMTYCDNQALREEMYRAYSTRASDQGPNAGKWDNSPVMAEILALRHELAQLLGFDSYADKSLATKMAENPQQVLDFLTDLAKRARPQGEKELAQLRAFAKAEFGVDELQPWDIAYYSEKQKQHLYSISDEQLRPYFPENKAVNGLFEVVKRIYGITAKERTDIDVWHPDVRFFELYDDKNELRGSFYLDLYARENKRGGAWMDDCVGQMRKADGSLQKPVAYLTCNFNRPVSGKPALFTHDEVITLFHEFGHGLHHMLTRIETAGVAGISGVPWDAVELPSQFMENWCWEPDALAFISGHYETGEPLPKELLDKMLAAKNYQAAMFILRQLEFGLFDFRLHAEFSPEQGAKILETLAEIKKQVAVIPGPTWGRFPHAFSHIFAGGYAAGYYSYLWADVLAADAFSRFEEEGIFNRETGQSFLDNILTRGGSEEPMELFKRFRGREPQLDAMLEHYGIKG

SEQ ID NO: 7996 - protein, 153 aa, Enterobacter cloacae
SVRILKREPDRLLVILSLNCLSGHWGAVAQEPCFVGGRRGGCMISTVALFWALCVVCIVNMARYFSSLRALLVVLRGCDPLLYQYVDGGGFFTSHGQPSKQMRLVGYIYYQRYRDHHDEEFIRRCERLRRQFILTSALCGLVVVSMIALMIWH

SEQ ID NO: 7997 - protein, 428 aa, Enterobacter cloacae
NGFVISFYAGATTEETLQSAAVNEEDFDVERFDAVVIGAGAAGMFCAAMAGQAGRRVLLLDNGKKPGRKILMSGGGRCNFTNLYVEPAAYLSQNRHFCKSALARYTQWDFIELVGKHGIAWHEKTLGQLFCDDSAQQIVDMLVAECEKGGVVMRLRTEVLDVARDEQGYTLQLNGETVSADNLVIASGGLSMPGLGASPFGYKIAEQFGLKVLPTRAGLVPFTLHKPLLEQLQTLSGVSVPSVITAEDGTVFRENLLFTHRGLSGPAVLQISSYWQPGEFVSVNLVPDCDLDAFLNEQRAAHPNQSLKNTLAMQLPKRLVECLQVLGQIPDVALKQLNSREQETLVETLTNWRVQPNGTEGYRTAEVTLGGVDTNELSSRTMEARNVPGLYFIGEVMDVTGWLGGYNFQWAWASAWACAQALADVRGQ

SEQ ID NO: 7998 - protein, 286 aa, Enterobacter cloacae
PAAVQKSLWSCSNASVAASRSWMRCWSITESKADCYVKICLVDETGAGDGALSVLAARWGLEHDEDNLMALVMTPEHLELRKRDEPKLGGIFVDFVGGAMAHRRKFGGGRGEAVAKAVGIKGSYLPDVVDATAGLGRDAFVLASVGCRVRMLERNPVVAALLDDGLTRGYADPEIGSWLQERLQLIHASSLTALTDITPRPQVVYLDPMFPHKQKSALVKKEMRVFQSLVGPDLDADGLLEPARQLATKRVVVKRPDYAPPLADVATTNAVTTKGHRFDIYSGTPE

SEQ ID NO: 7999 - protein, 283 aa, Enterobacter cloacae
GTIMARGRRLKSYLDYENALGDGIGVGYGQSYQPWLRAQDVKSRGNRSIVFGLKTFRNHHLLSSVESNFFYLAEFNDSVIDIREQFPLFPLRLTQQIANHLHFQHPMVRGVRGVPVEVLNVMTTDFLLTLRTPEGGLRYKAIAVKHNESIPEREAQKLEIERMFWQLIDVEFQIYVGSELNNVVGKNICWATSVLRDGSEFYDKYPLDKILWKLKPDVYPIVGLRAMISSIFGVDAQEAMMLLQAMIGLKMINVDLSYPILETGLIKIISNDHYIGLNANGYY

SEQ ID NO: 8000 - protein, 315 aa, Enterobacter cloacae
GRRIMNLIRRVSAIYKEQELPEYRGNPLIEALPEALTEDEVLLEMSYFPEIDEKIRWTAPANVREQYVERIKKFRCPQTNLIQAYKMILRALRESYAARNPLKSGTIQYLHYYGNERPDIEPESGYFKSQAEIITIVGMSGSGKTTMIEQVMDHFPQIIEHSSYKGVFPGFSKQIVWVKINCPYNSSVRDLCEEILQKLDDAIGIERTTPEIRNGALARQIAQRIKSSFLGILVIDEMQRLKFSRTGGESKLIDFLHEIVDSMGVSMVFCGNHPFDETLTKKMRIARRAESGGYMKIKNVRYDSQDWQSFIHYLW

SEQ ID NO: 8001 - protein, 694 aa, Enterobacter cloacae
TIVLEASSSGKGTTMTKTTRVISWTAGIFLLLIVVLIIIIATFDWNRLKPTINQKVSTELNRPFAIRGDLGVVWERQKEETGWRSWVPWPHVHADDIILGNPPDIPEVTMIHLPRVEATLAPLALLTKTVYLPWIKLQQPDARLIRLSEKNNNWTFDLASSGDKDQNAQPSSWSFRLDNILFDRGRIAIDDKVSKADVEILVDPLGKPLPFSEVTGSKAKGDDSKAGDYVFGLTAKGRYNGQPLTGKGKIGGMLALRSEGTPFPVQADFRSGNTRVAFVGTVNDPMNMGGVDLQLKFAGDSLGELYDLTGVLLPDTPPFETDGHLVAKINTEKSSVFDYRGFNGRIGDSDIHGTLTYTTGKPRPKLEGDVESRQLRLADLGPLIGVDSGKGTKSKEVKKDVQPAGKVLPYDRFETDKWDVMDADVRFKGRKIEHGSTLPLSNLSTHIILKNADLRLQPLKFGMAGGTISSNIHLEGDKKPMQGRAEIQARRLKLKELMPDVELMQKTLGEMNGDADIRGTGNSVAALLGSGNGNLKLLMNDGLVSRNLMEILGLNVGNFIIGQIFGDDEVRVNCAAANLDLVNGVARPQIFAFDTENAVINVTGTASMASEQLDLTIDPESKGIRIITLRSPLYVRGTFKDPQAGVKAGPLIARGAVAAALATLVTPAAALLALISPSEGEANQCRTILSQMKK

SEQ ID NO: 8002 - protein, 566 aa, Enterobacter cloacae
  UNSURE (554)
TQMDIIRNSVWLSQGTDLLAEGLYRVLDFDRKVDLLILFKIKSERTGKPIPFSFSMFKYYIESNSITCKDYIYPSYMLVDEKELTDKDRGRRDENYNIIKDLVDDRMFLFDYALHKKSHLLMDYSRNKKISQYTIRTLLALYWRHGQDIYALLPAFSNCGAAGKSRIKHEIKLGNSKKNRALPNERSRVFILNERDINNIRKSLITYHYKVNGDTIKKTLERHIDLYFRDEIKTANLENRAPYVPSLKQFSYWNKKLFTKDFSINKKNTKKEIDLKMRALLGSVANTTVLPGDVFEIDSTVADVHLISSLNRRKVIGRPTIYTVVDRATRMIVGLHVSLYHASWRAARQALANCFMPKKEYCRLFGISITDDDWPCSHIPLTLMCDNGEMIGLKPQEEMTPLTKLEFAPVGRGDRKSIVERCFGILNDEVIHRLIGTTRRGKIVKGEPTPQSRACLTIQEVTSLLIREILAHNQRTYEELAYINPLLIENDLVISPKNSWMISLKHGRFSARAVGADEVIARLLIPVNANITAGGIQYNNLFYECDPEIASGVXVFGRTTCEARIE

SEQ ID NO: 8003 - protein, 501 aa, Enterobacter cloacae
RPMLHLFAGLDLHTGLLLLLALVFVLFYEAINGFHDTANAVATVIYTRAMRSQLAVVMAAVFNFFGVLLGGLSVAYAIVHMLPTDLLLNVSSGHGLAMVFSMLLAAIIWNLGTWYFGLPASSSHTLIGAIIGIGLTNALMTGTSVVDALNIPKVLGIFGSLIISPIVGLVVAGGLIFILRRYWSNTKKRARIHLTPAEREKKDGKKKPPFWTRIALIISAIGVAFSHGANDGQKGIGLVMLVLIGVAPAGFVVNMNASGYEITRTRDAVNNVETYFQQHPDLLKKATGVDQLIPSPESGATTAPGEFHCHPANAINALERAKGMLADIESYDKLAVEQRGQLRRIMLCISDVTDKVAKLPEVNADDQRLLKKLKGDMLNTIEYAPIWIIMAVALALGIGTMIGWRRVATTIGEKIGKKGMTYAQGMSAQMTAAVSIGLASYTGMPVSTTHVLSSSVAGTMIVDGGGLQRKTVTNILMAWVFTLPASILLSGGLYWISLKLI

SEQ ID NO: 8004 - protein, 480 aa, Enterobacter cloacae
AGSCRSNRSHRWKLLISGIQSRQFTIKDNAMTKHYDYIAIGGGSGGIASINRAAMYGQKCALIEAKELGGTCVNVGCVPKKVMWHAAQIREAIHMYGPDYGFDTTINHFDWDKLIASRTAYIDRIHTSYDNVLGKNNVDVIRGFARFVDAKTIEVNGETITADHILIATGGRPSHPHIPGAEYGIDSDGFFELPALPERVAIVGAGYIAVELAGVINGLGAEAHLFVRKHAPLRSFDPLIVDTLVEVMNAEGPTLHTNAVPKAVVKNADGSLTLELEDGRSQTVDCLIWAIGREPATDNFNLAATGVKTNEKGYIVVDKFQNTSVPGIYAVGDNTGAVELTPVAVAAGRRLSERLFNNKPDEHLDYSNIPTVVFSHPPIGTVGLTEPQAREQYGDDQVKVYKSAFTAMYTAVTSHRQPCRMKLVCVGPEEKIVGIHGIGFGMDEILQGFAVALKMGATKKDFDNTVAIHPTAAEEFVTMR

SEQ ID NO: 8005 - protein, 443 aa, Enterobacter cloacae
ENIMQATATTLNEGAEHVPVNSRNKVVVASLIGTAIEFFDFYIYATAAVIVFPHIFFPQGDPTAATLQSLATFAIAFVARPIGSAVFGHFGDRVGRKVTLVASLLTMGISTVAIGLLPTYETIGILAPVLLALARFGQGLGLGGEWGGAALLATENAPARKRALYGSFPQLGAPIGFFFANGTFLLLSWLLTDEQFMSWGWRIPFVFSAVLVLIGLYVRVSLHETPVFAKVAAAKKQVKVPLGTLLTRHLRVTVLGTFIMLATYTLFYIMTVYSMTFSTAAAPVGLGLPRNEVLWMLMMAVIGFGVMVPIAGLLADKFGRRSSMIVITSLIILFALFVFPPLLGSGSPALVMAYLLIGLSLMGLTFGPMGALLPELFPTEVRYTGASFSYNVSSILGASVAPYIATWLQANYGLFYVGVYLAAMAALTLIALLLTHETKHQAL

SEQ ID NO: 8006 - protein, 150 aa, Enterobacter cloacae
GRSNTMAYKHILIAVDLSPESKVLVDKAVSMARPYNAKVSLIHVDVNYSDLYTGLIDVNLGDMQKRISEETHHALSELSTNAGYPITETLSGSGDLGQVLVDAIKKYDMDLVVCGHHQDFWSKLMSSARQLINTVHVDMLIVPLRDEEDE

SEQ ID NO: 8007 - protein, 568 aa, Enterobacter cloacae
KIAGKNPYLLRQKPEVLNTMFNQKLQTAEDIEFDIAEELRYETDPCELKLDEMIEAEPEPEMIEGLPASDALTPADRYLELFEHVQSSRLFADSKTFPDCAPKMDPLDILIRYRKVRRHRDFDLARFVKNHFWLPEDYSKEYVSDPGLSLKEHIDNLWPVLTREPQDHIPWSSLLALPQAYIVPGGRFSETYYWDSYFSMLGLAESGRNDLLKCMADNFAWLIERYGHIPNGNRTYYLSRSQPPVFALMVELFEEDGVRGAKRYLEHLKMEYAFWMDGAESLLLNQAYRSAVRMPDGSLLNRYWDDRDTPRDESWIEDVETARHSGRPPNEVYRDLRAGAASGWDYSSRWLRDPARLASIRTTQFIPIDLNAFLFKLESAIANISASKGDKETADLFRQKASDRRAAVNRYLWDEENGCYRDYDWRREALALFSAASIVPLYVGMATHEQAERLSDAVKARLLTPGGILATEYETGEQWDKPNGWAPLQWMAIQGFKQYGNDSLGDEIAWSWLHTVNHYYKTHHKLIEKYHIASSTPREGGGGEYPLQDGFGWTNGVVRRLIGLYGEP

SEQ ID NO: 8008 - protein, 116 aa, Enterobacter cloacae
EETLMTGYAMQISSAAIALIKKQQGLSLEKYRDEKGIWVIGYGHVIRQWEKFNGLITPTEAENLLCNDIQLCEALLREMNKRPLTQQQHDALILTLFSFGEESPLPEKILQAVARV

SEQ ID NO: 8009 - protein, 224 aa, Enterobacter cloacae
PLPSGACVYGVAYRTHKRLRGLVASYNSVTSSSTKRKMRVTPENNPQRPTQHLDYEPIKKMDNEPEAPKEPGTASKALGTVTGIAEKIQQIPAIAHLIRAAERFNDRMGNQFGAAITYFSFLSMIPILMVSFAAAGFVLASHPTLLQDIFNKILTNVSDQTLATTLKSTINTAVQQRTTVGIVGLLIALYSGVNWMGNLREAIRAQSRDVWERRPQDQEKIWVK

SEQ ID NO: 8010 - protein, 155 aa, Enterobacter cloacae
LRDFISLIGLLVALVITLSITSVAGSAQQMIISALYLDYIEWLKPAWRGIGLAISIFANYLLFFWIFWRLPRHRPRKKALIRGTLIAAIGFEVIKIVMTYTLPSLVKSPSGAAFGSVLGLMAFFYFFARLTLFCAAWIATAEYKDDPRMPGKTHR

SEQ ID NO: 8011 - protein, 293 aa, Enterobacter cloacae
TVANRQFSGISLPMLSYRHSFHAGNHADVLKHTVQSLIIESLKEKDKPFLYLDTHAGAGRYQLSGEHAERTGEYLEGIARIWQQDDLPAELEPYIGVVNHFNRNGQLRYYPGSPLIARQLLREQDSLQLTELHPSDFPLLRSEFQKDNRARVDKADGYQQLKAKLPPVSRRGLVLIDPPYEIKTDYQAVVTGINEGYKRFATGTYALWYPVVLRAQIKRMIKDLEATGIRKILQIELAVRPDSDQRGMTASGMIVINPPWKLEAQMNNVLPWLHKTLVPAGTGHATVSWIVPE

SEQ ID NO: 8012 - protein, 190 aa, Enterobacter cloacae
QPYNHLQCLRRIVMPALTTARLTCSPLQEQDWPFFLSLQQNPEVMRFVAPARSEADIREAFESRLLPWTPGSSHWLCLMVRETASQTPLGVTGYVHREADCAEVGFLFAPSAQGKGYGFESLRAVCDFALTQGNIRRLTATVTAGNIASRRLLEKTGFQLEGELRESYFLSGQWHNDWLFGLLKKEFPFS

SEQ ID NO: 8013 - protein, 302 aa, Enterobacter cloacae
PTSMDKIHAMQLFLRVAELESFSRAAETLSLPKGSVSRQIQALENALGTQLLHRTTRRVSLTQDGMVYYERAKDLLMNLDELDGMFLHDPSTISGRLRVDMPVAIARNVVIPKLPAFLQQFPGIELELSSSDRLVDVIREGFDCVVRVGNLKDSGLIARPLGKLSVINCASPDYLTRFGYPETLDDLASHALIHYSATLGTRPQGFEYYNGSATRWVKTGGVLSVNSTETYQAACIAGLGIIQVPRVGVRDALRTKKLVEILPQYRAEPMPVSLIYPHRRNLSRRVHVFMEWLTELTKGYVD

SEQ ID NO: 8014 - protein, 329 aa, Enterobacter cloacae
LTIKNTQRTLPLITLFRFTTMSKKIAVIGECMIELSQKGAEVSRGFGGDTLNTSVYIARQVSPDALSVSYVTALGTDSFSQQMLEAWQGENVGTSLIQRMENRLPGLYYIETDSTGERTFYYWRNEAAAKFWLESEAAAAICEELATFDYLYLSGISLAILSQESREKLLSLLRECRANGGKVIFDNNYRPRLWASREETQQVYQQMLECTDIAFLTLDDEDALWGEKPVDEVIARTQAAGVSEVVIKRGAESCLVAVAGEAVTEVPAVKLAKEKVIDTTAAGDSFSAGYLAVRLTGGTPEAAAQRGHLTASTVIQYRGAIIPREAMPA

SEQ ID NO: 8015 - protein, 105 aa, Enterobacter cloacae
KLLQPQQGRQVEVVARFVQKQQIRIAYQRPRQQQPRMLTAAQRGGLQRRFLRRKAHSGQQRLGLPAKTVALTGRQLRQHRIQHGQGIKGLRQMLFHARQQAMSSQ

SEQ ID NO: 8016 - protein, 233 aa, Enterobacter cloacae
HCSSIEVFDALVILSVLLWVPDIHDTTTTRLTEQFHFLKKPEPWLIFAATMFGNAGVFAWFSFVKPFMVNVSGFSEGVMTAIMMLMGLGMVLGNVFSGKLSSRFSPLRIAATTDLVIVASLLALFAFGELKTASLVMGFVCCAGLFALSAPLQILLLQNAKGGEMLGAAGGQMAFNLGSAIGAYFGGMMITLGFSWSYVTLPAAILSFSAMTSLLMYGYLCAKKRQANAGALA

SEQ ID NO: 8017 - protein, 302 aa, Enterobacter cloacae
IEQMEVKMDRVIAAQVYNRICELGSLSAAARALGISRPMVSRYLEQMEKWAGARLVNRSTRKLTLTAAGEKVLQKTRTLSQISQEIEDQSVKDLPSGTLRVACAHFTAMHIIVPVLPDLLQRYPQLRIELDVNNHPVSLVGERIDVAIRITDNPEPGMIARRLGECRSVLCASPHYLASRGVPVQLEDLSRHNCLHYSFFAGQSWRFLTPEGESVTTAVSGNLSASISSLLMEAAINHCGIAMLPEREADAALRQGSLVPVLGAFTPKPIGIFGIYQSRDYQPAAQRVFLDALANHLATRSD

SEQ ID NO: 8018 - protein, 148 aa, Enterobacter cloacae
AKRRARMTIHKHGSAHWSGDIKRGKGTVSTESGVLNQQPYGFNTRFEGEKGTNPEELIGAAHAACFSMALSLMLGEAGYTADSIDTTADVSLDKTDSGFAISKVALQSKVTVPGIDPQQFDGIIQKAKAGCPVSQLLKAEITLDYKLN

SEQ ID NO: 8019 - protein, 264 aa, Enterobacter cloacae
RGQTLLFYITTKVMSMNTTLAGKIALVTGGSTGIGLATAQELAAQGAKVYITGRRQAELDAARADIGAAAVAIRADVSRMADLDAVYAQIAKEEGRLDILFANAGGGDMLPLGAITEEQFDRIFATNVRGVLFTVQKALPLLSSGSSIILTGSTVSIKGTANFSVYSASKAAVRNFARSWALDLQGRGIRVNVVSPGPVKTPGLGDLVPEEQRQGLYDALAAQVPLGRLGAPGEVGKAVAFLASDAASFINATELFVDGGMAQI

SEQ ID NO: 8020 - protein, 125 aa, Enterobacter cloacae
HPVPARRQASRCPSSPSVAPGDPASGYGTPPIKCPAARQSPGPAAKSRRPVPAWRGKRLSNLPQRGDRCEWMCPDRHAPAPLHSGQTEYRAVDPAPAAGGCPARFHRWRGHRPAGGPDRRGSGVK

SEQ ID NO: 8021 - protein, 501 aa, Enterobacter cloacae
KLWGKKREPYMANLPWRVSVRLMALAKKIAMVIGIIVLVLLSVRVYLSQQGPALHHWHTWRADEMSVQEMDNATFAAYVARENAIFTALDAEVTAKVPPAERTPLNRYYRQSLVWPGHFSPDANRSFVLMPAGKPRGGVVLLHGLTDSPYSVRHLAENYQQHGFVAVVPRLPGHGTAPGALTDVDWEAWLAATRLAVREATRLTGNDLPLHLVGYSNGGALAMKYALDALDAPALRQPEQIVLLSPMIGVTAFARFAGFAGLPAMLPAFAKAAWLNISPEYNPYKYNSFPVNAARQSWLLTQALHEQINRGVHDHKLAQLPPILAFQSVMDSTVSTRAVVSGLFDQLPANGSELVVFDINQAGSFRPLFRPSSWTAVADLLPEAKRRYSVTIVTNASPDRFDMVAKKTPAGSTRETVMPLSVAYPQEVYSLSHVAIPFPQDDDLYGRHPAVKNRYGISLGTIALWGETSVLSVGKDALMRVTSNPFYDYMQTRIDSRIGDN

SEQ ID NO: 8022 - protein, 405 aa, Enterobacter cloacae
VTPGNCVKQYRSGVYPIPDPVSVLTTLIYRSQLSLTCTSAALSALVEQARIRNTEQGISGILLSRGRDVLQILEGTEQRVVALFNSIRADDRHTGVVELMRDYGPRRRFEDVGMLLFDLDVQTPKAVLASVLHYSKLESYLTSEERVFKFIQTFITGKTAIPPASDYEPDKWTLSRERAPFGKGLGLLAGQPCQFALQPIVEPSEGKISSLEALIRGNDGGSPEHFFRSLDRELIYEVDLQTKAWTFALAQKLGIGSHKLAVNLLPMSLVNVPGAVEFLVTQIKKHNLQPEQVIIEVTENEMISGFNQFNSAIKQLRAEGVGLAIDDFGSGYAGLSLLTRFQPDKLKIDREIVSDIHLSGPKQAIVKSIISCCTDLEITLVAEGIEQIGAWCCIRPRGDQNRVRR

SEQ ID NO: 8023 - protein, 170 aa, Enterobacter cloacae
AMAFYSSGVEYGIHSLMCMVDAKGNEREMSVREMAALQGVPYDYLGKIFTRLSRAGLVISTEGKGGGFRLARPAELISVLDVAHAIDGEKNMFECREVRQRLAVFDETPPAWVCDGPCGVRSVMDSAQQRMEEELGRHTILDLARKMYRKAPDTFQIEVQEWISDRRSST

SEQ ID NO: 8024 - protein, 511 aa, Enterobacter cloacae
PLAGSPGATDGDDGHLDACLLAGTGCYRSVLRATANSARRRQAGRLARSARPRYRFLSAGRSAGRQRRGVFQRPTAPDSTLPDPGLCASGYCGASGTFRDAGATERGLYSYRPRERVAGVVHRAALRLTQRHDPLHYRARAGAGRSAVRGSPYRNRVCLAGNGSLGGDLHSGAGLPCRHGLRGRGIAGLCLRQSGGGSAVSVDRPANRARRCRMMLTQETPVPVSTAKQRINWAKLFWMLRKSPLTLIGGVIMIVMLLLMVVSPWIVPHDPNALDLTARLQAPSAQHWFGTDEVGRDLFSRVLVGSQQSITAGLAVVVIAGGIGSLLGCLSGVLGGRGDAIIMRIMDIMLSIPSLVLTMALAAALGPSLFNAMLAIAIVRIPFYVRLARGQTLLVRQFTYVQAARTFGASRWHLISWHILRNALPPLIVQASLDIGSAILMAATLGFIGLGAQQPTAEWGAMVAVGRNYVLDQWWYCAFPGAAILITAVGFNLFGDGLRDLLDPKSGGKQS

SEQ ID NO: 8025 - protein, 328 aa, Enterobacter cloacae
FPRAQKANRLPAGTHNRRDAMSEVLLELDSVHVNFPARKNWLGRVTEQVHALNGMDLRIHRGETLGVVGESGCGKSTLAQLLMGMLKPSTGACQRANAAGGMQMVFQDPLSSLDPRLPVWRIITEPVWIQQRRSERERRQLAETLAQQVGIRAEYLDRLPHAFSGGQRQRIAIARALSSDPDIIVLDEPTSALDISVQAQILNLLVALQQQRNLTYVLISHNVSVVRHMSDRVAVMYLGQIVELGPADQVLSQPRHPYTQLLLDSVPRTGEPLDEDLALRKTDLPGNRHLPVGCYFRDRCPLAMQGCERPQPLQPAAEGRSVRCWRNR

SEQ ID NO: 8026 - protein, 306 aa, Enterobacter cloacae
SEEIYVDQLMAMRAFTRVVESGSFTRAADSLNMPIATLSKLVKSLEAHLETRLLHRTTRRVVTTAEGMEYYEKALRVLIDIEDIDTAFRASCCTPKGHLRIDVGGSTARDVLIPLLPDFFQRYPDLRINLGVADRPVDLISGNVDCVIRGGPLDDSSLIARHIGDAGMIACAAPGYLKAHGIPAYPQELRNGHKLISYLSPVTGRAFPFRFLDRGEPLEISVPHHLGVNESNAHLAAALAGLGIIQTFGYAARAHLETGALVEILSDWRPKAYPFHVVYPQSRHLTHRLRVFIAWLAEVFPAAVKG

SEQ ID NO: 8027 - protein, 594 aa, Enterobacter cloacae
YQPTAPRSTGQKDDKQQCQGRIFLKRVSDMDNKLKKHRSLYIPYAGPVLLEFPLLNKGSAFSMEERSSFNLLGLLPEVVETIEEQAERAWIQYQGFKTEIDKHIYLRNIQDTNETLFYRLVQNHLEEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRHPRITDDEYYQFVDDFIQAVKHRWPDVLLQFEDFAQKNAMPLLNRYRDEICSFNDDIQGTAAVTVGTLIAASRAAGSQLSYQKIVFLGAGSAGCGIAEQIIAQTQREGLSEELARSRVFMVDRFGLLTDGMPNLLPFQTKLVQKRENLKNWDTDNEVLSLLDVVRNVKPDILIGVSGQTGLFTEEIIREMHKHCERPIVMPLSNPTSRVEATPQDIIAWTEGNALVATGSPFDPVVWKDKLYPIAQCNNSYIFPGIGLGVIASGASRITDEMLMSASETLAGHSPLVNNGEGLVLPELKDIHKVSRAIAFAVGKMAQQQGVAVKTSADALQQAIDDNFWMPEYRSYRRTSI

SEQ ID NO: 8028 - protein, 571 aa, Enterobacter cloacae
ATMSTLLTAHSLRVDTAFGTLFDSLSFTLKKGDRIGLLGDNGCGKSTLLKILDGTQSPAAGTVSLAGHCLLARVEQHLPETLYPLTMLDAVLAQLPTGERDSLRWKAETLLAGMGFTTQETALQSATLSGGQHTRLLLARALISDPDLLLLDEPSNHLDLPTLLWLEQFLQSWSGSFVLVSHDRQLLDAITNGSWILRDKTLHYFALPCTAARQALEAKDESDALRHKAEQKEIDRVTASAKRLATWGKVYDNEDLSRKAKQMEKQVERLKENQTELTAGSPWTLTLRGDALRADRLLEITDLGVPPAPGLPDLFTLVSARLKSGDRVAIVGRNGCGKSSLLKLIWRHFRDEISDERLKRHPRVSPGYYDQTLHQLPDDTALLDALEPFAPDPQTRKMALISAGFPWARHGQKVSTLSGGERSRLLFVGLTLARYSLLMLDEPTNHLDMEGKEALAETLQQFEGGVLLVSHDRQLISQCCNRFWLIEDGRLSEWHDAEAVFERLREDAGPAVPEASNAALKAPSSASDDLLERLVALETLLEEDLARKPKYQKPQLQAQWRKEIEEIEAQL

SEQ ID NO: 8029 - protein, 349 aa, Enterobacter cloacae
VTAHAGGKCMTFWSIVRQRCWGLILVVAGVCIITFIISHLIPGDPARLLAGDRASDEIVQGIRQQLGLDQPLYIQFGRYVEALAHGDLGTSIRTGRPVAEDLKAFFPATLELAFCSLLLALVIGVPLGILSAVYRNRWLDHLVRLMAMTGISTPAFWLGLGVIVLFYGQLQILPGGGRLDDWLDPPAHVTGFYLLDALLEGNGEVFFNALQHLILPSLTLAFVHLGIVARQVRSAMLEQLSEDYIRTARASGLPGWYIVLRYALPNAMIPSITVLGLALGDLLYGAVLTETVFAWPGMGAWVVTSIQALDFPAVMGFAVVVSLAYVFVNLVVDLLYLWIDPRIGRGGAE

SEQ ID NO: 8030 - protein, 288 aa, Enterobacter cloacae
QRGGMTTKPEVLSRIEATFSQLTPSEKRVASWMLAHVGQIPFETAESVALATATSGITVGRFLRKLGYRNLDDAKKSLRDPHQPWGINERLDSWKQQQPLSDRLQNSLSLEVDAIAHVYQLAQSETFRQVVQQLTHADAVFVLGIQSTRGIANAFFSHLEYLRPRVSYSEGLSGSWVESLNSGFANPYIVLTDTRAYSAIARQYCRVASEKGLAMALITDIWCPWARDYPIDLLQVKTDTGHFWDSLAPVSCLFNLLLSGVVEALGDALPERLAINRQLQQEFGQFER

SEQ ID NO: 8031 - protein, 194 aa, Enterobacter cloacae
RSGAMPEESQLIDVAKTFPTLHIDLKYATADNITGRPIYQHAACLLHTDAATALAKAIGIAALAGLKLVVYDAYRPQQAQSQLWDACPNPEYVVDVAIGSNHSRGTAIDVTLMDEHDNVLDMGAGFDEMHDRSHAWHPSVPPEAQRNRLLLNAVMYGGGFVGISSEWWHFELPNAASYPLLDDQFACYPTTHSL

SEQ ID NO: 8032 - protein, 515 aa, Enterobacter cloacae
FWSPAMKTTLLTTLIAATLALSAPLALAAVPKDMLVIGKAADPQTLDPAVTIDNNDWTVTYPSYQRLVKYKPGTTEVEGDLSTGWKASDDQKEWTFTLADNAKFSDGTPVTAEAVKLSFERLLKINQGPSEAFPKDLKVDAVDEHTVKFTLSQPFAPFLYTLANDGASIVNPAVLKANAADDARGFLAQNTAGSGPFMLKSWRKGQQLVMVPNPHWPGEKPHFKRVSVKIIGESASRRLQLSRGDLDIADALPVDQLAALKQEGKVAVAEYPSLRVTYLYLNNSKPPMNQVDLRRAVSWATDYQGMVKGILSGNGKQMRGPIPEGMWGFDANAMQYSFDEAKAKAALEKVNDKPASLTFLYSDNDPNWEPIALSTQASLGKLGINVKLEKLANATMRDRVGKGDYDIAIGNWSPDFADPYMFMNYWFESDKKGLPGNRSFYENKEVDALLQAALKTTDQAERTKDYQQAQKVVIDEAAYVYLFQKNYQLAMNKEVKGFTFNPMLEQVFNIATMSK

SEQ ID NO: 8033 - protein, 347 aa, Enterobacter cloacae
SVWRWSSRPAGSQIRREAVMSDSVLSIEDLHLSFPIFRGDVHALNHVSLEIGRGEIVGVVGESGSGKSVTAMLAMRLLPEGSYHVHHGRVTLLGEDVLNASEKQLRQWRGARVAMIFQEPMTALNPTRRIGRQMVEVIRQHQSLSRRDAQQKAIALLGEMQIPDAAQVMDRYPFELSGGMRQRVMIALAFSCEPELIIADEPTTALDVTVQRQVLRLLKHKARASGTSVLFISHDMAVVSQLCDRMYVMYAGSVIESGSTQTLIHHPVHPYSIGLLRCAPENGEPREILPAIPGTVPNLSHLPRGCAFRERCFAAGAKCSETPRLISTGAEGQQAACWYPQQERRHV

SEQ ID NO: 8034 - protein, 309 aa, Enterobacter cloacae
ASPVSGILANEEIRTIETFLKNRDMTMTIARLALLTTLFTPAVFAAPLTVDTYNPQEKGIFAVSSTLVSGPKEAVLFDAQFSVKDGEALVEKIRHSGKTLNKIVITSGDPDFYFGLQPLVKAFPNAKVVATQQVVDHIRATKDAKLAFWGPQMKDGAPSQLYLPQVLASTTFMIDGERVNIEEPESYAAYVWIPSAKTILGGTGVSWGIHVWTADTQTPESRKQWQQTLDSMAALKPEHVIPGHYLGTPPAGTGAIDFTRRYLHQFEQALMTHKASTGVISTMKKQWPNLAEASSLELSAKVNTGEMKW

SEQ ID NO: 8035 - protein, 88 aa, Enterobacter cloacae
ITILHAVTLNRQRHGGSMFTYYPAHTTAAQPELVNAIAQGLQAEHGVVTEDDILMELTKWVEATDNDILSDIYQQTINYVVSGQNAPL

SEQ ID NO: 8036 - protein, 340 aa, Enterobacter cloacae
KEKHMKAAVVTQDHQVNVTEKTLRALKHGEALLKMECCGVCHTDLHVKNGDFGDKTGVILGHEGIGIVKEIGPGVTSLKVGDRASVAWFFEGCGHCEYCNTGNETLCRDVKNAGYSVDGGMAEECIVTADYAVKVPDGLDSAAASSITCAGVTTYKAVKVSDIKPGQWIAIYGLGGLGNLALQYAKNVFNAKVIAIDVNDEQLKLAASMGADLTVNSRSEDAAKVIQEKTGGAHAAVVTAVAKAAFNSAVDAVRAGGRVVAVGLPPEAMSLDIPRLVLDGIQVVGSLVGTRQDLLEAFQFAAEGKVIPKVTMRPLEDINAIFKEMEQGQIRGRMVIDLRS

SEQ ID NO: 8037 - protein, 406 aa, Enterobacter cloacae
RTKGSSMKKQILIVGSGFSGMWAAVSAARLSALAGNNSLSIAVLAPVAELRVRPRFYEENVSTMVAPLTELFAELGITFIAGEAQRIDTSSKTVLYRDSNGAIADVAWERLILATGSQTKRPPVAGLAEYAFDIDQLDSARLFEQHLDSLVSRPSTPERNTVVVCGGGFTGIELATELPARLRTRFGANTKTKIIVVERGATIGGRYSEALRNTIEEASSALGVEWRLNSEVEAIDASGVTLKNGERIASATVVWTAGVEANPLSLQIDGERDTQGRLIVTDTLQVPAHREVYATGDMAHAKTDDVGNTALMTCQHAIQLGKFAGHNAAASLLNVEPYPYRQVNYVTCLDLGSWGAVYTEGWDQRIKSVREEGKKIKVAITNELIYPPAADKAVAFAAADPLAKFV

SEQ ID NO: 8038 - protein, 703 aa, Enterobacter cloacae
TERQLIGTEQITFLQSGINALRRVVINYSVVVLTLSGAFQPGEIIMSTGKFILHSGYIPSGDQPEAIARLIAGVEAGATHQTLQGITGSGKTFTMANVIHRLQRPTLILAPNKTLTAQLYLEMKQFFPENAVEYFVSYYDFFQPEVYIPGSDRFIPKDSAINDHLERLRLSTTKALIERQDVIVVASVSSIYGLGDPDAYREIQIPVYPGRQLAQRELIHQLARLQYARTDKTLGRAMFRVRGDVIDIFPADSEHQAIRVELFDDVIESAKWIDPVSGKIAGDIEHYLISPKTLFVTPTAKIPSATKSILTDMEKRVAELNKANRLIEAERLYERVNNDVEMIRELGYCSGMENYSCYFSDRNPELPPTTLLDYLPKNGLLFVDESHVMVPQISAMYSGDQSRKDTLIDFGFRLPSSKNNRPLSFAEFEKIKPQTVFVSATPGKYELQKSKKNVVQQIIRPTGLLDPEIEVRSKDQCVENLLEEIRHCVNRNNRVLVTVLTKKTAEELNDFLTENGILSRYLHSDIKTDERQEIINGLRAGEFDVLIGISLLREGLDIPEASLVAILDADHAGFLRSSHALIQMIGRVARNVEGKAVLYANRITPAMKQAMDETHNRRERQIAYNLEHHIKPVTSVRKRSTEQDESVYPATHTEAFCSTLSELCERITVKEKQLLAIENSGEEKDIEKLRTELSDLYRQFIFM

SEQ ID NO: 8039 - protein, 902 aa, Enterobacter cloacae
APHGKETMTVGSRWFKFDFHNHTPASDDYKVPDLQPREWLLAYMRQQVDCVVISDHNSGAWIDVLKAELANMSRDASSGELADFRPLTLFPGVELTATGNVHILAVLHTQSTSAEVERLLAQCNNNCPISRETPNHHLVLQLGPAGIISNIRRNPEAICILAHIDAAKGVLTSLTNQGELTAAFQSNPHAVEIRHREEEITNGTHRRLIADLPWLRGSDAHHPEQAGVRTCWLKMSEPDFDGLRHALLDPENCVLFDDNPPEAPASHLRSLTFRTRLCQPADQYGASVEFSPFYNAVIGSRGSGKSTLIESIRLAMRKTEGLTVSQRNKLNQFSQMGMGMDADSFIECVFRKEGTDFRLSWRPDGRNELHIFSEGQWVQDNHWSPDRFPLSIYSQKMLYELASDTGAFLRVCDESQVVNKRAWKERWDQLEREYLNEQITLRGHLASQTIADKLQGELSDAERAVSQLRSSAYYPVCTRLATARAELSAATLPLEHHEQHVAGLRAQEKEPVQVPELQVEPSATLTAFMTRLSDVQQKYDQRLDTLLSDYAAELSTIRQDPPLLALEEAVRNQEETVQREAMVLREQGLNPNVLDELMTRCESLKSELRNYADLDGTIAASAARSTGLLAEMRNHRMVLTEKRKAFLSSLSLSALDIKILPLCAPHEDTVSGYQAVTGIGNFADRIYDDGDGSGLLHSFISLRPYSPLPSATENKYLALDTLKALHLAIHREEPGAGSELHGAFRNRLKGLNDAQLDALQCWYPDDGIHIRYQTPGGGMEDISSASPGQKGASMLQFLLSYGTDPLLLDQPEDDLDCLMLSMSVIPAIMANKKRRQLIIVSHSAPIVVNGDAEYVISMQHDRSGLHPGLCGALQETPVKELICRQMEGGEKAFRSRYERILS

SEQ ID NO: 8040 - protein, 146 aa, Enterobacter cloacae
RAFPGLSSGWPPDVPRSKPLQISLHDWLVEKRATLSKKSRLGEAFAYALNQWDALCYYCDDGLAEPDNNAAERALRAVCLGKKNYIFFGSDHGGERGALLYGLIGTCRLNGIDPEGYLRHILSVLPEWPINKVAELLPWNVDLTNK

SEQ ID NO: 8041 - protein, 349 aa, Enterobacter cloacae
SAPLNTGELMITFEIRMEIKVLHKRGMSIRAIARELGISRNTVRSHLKAKSEKPQYSPRPAPSSLLDEYRDYISKRISDAHPYKIPATVIAREIMELGYRGGLTILREFIRKQTLPAQAEPVVRFETEPGRQMQVDWGTMRNGKSPLHVFVAVLGYSRMLYIEFTDNMRYDTLEACHRNAFSFFGGVPQEVLYDNMKTVVLQRDAYQTGQHRFHPSLWQFGKEMGFSPRLCRPFRAQTKGKVERMVQYARNSFYIPLMTRLRPMGITVDVETANRYGLRWLYDVANQRKHETIQTRPCDRWVEEQQSMLALPPEKKQYDVQVDESLMTFDRQPLHHPLSIYDTFCRGAA

SEQ ID NO: 8042 - protein, 80 aa, Enterobacter cloacae
RSEINSSWRTLPDVFLKTIRLPRDLDFEGVSELKIVREGDCIILRPVRPTWCSFAQLEKAEPDFMVERGDVVSDEGRFDL

SEQ ID NO: 8043 - protein, 253 aa, Enterobacter cloacae
TPKLLIVILTFLKEKNMTEQNNFGQYIGSHLDDDVTLSLPDLRQLPGRYCTLQLLSTRHGNDLFQGWHSIEDSRDWTYLPDERPPTKQATHSYIQQLIQQKGVYHYAIIENNSENAVGTLSLYNLDNKNDVAEIGGVHLTPVIKRTSVSTEAIFLILSYVFDVLKYRRCEWQTDRLNSQGMRSAERLGFQKEGVLRNKQILKSRSVDVVMYSIIQDEWERISSAITIWLRTVNFDDRGHQIHPLRHYLATTEP

SEQ ID NO: 8044 - protein, 88 aa, Enterobacter cloacae
MKIMNAEIERQIWHHNLSYLLLAQRVLNHYEDTALFRLGIDKCTGDKLLQLSLPELVRLAERPELITVLRLRDHHQIDVLLSQSTGMG

SEQ ID NO: 8045 - protein, 370 aa, Enterobacter cloacae
HMKSRAAVAFAPGKPLEIVEIDVEPPRKGEVLVKITHTGVCHTDAFTLSGDDPEGVFPAVLGHEGAGVVVEVGEGVTSVKPGDHVIPLYTAECGECLFCKSGKTNLCVSVRATQGKGLMPDGTTRFSYKGQPLFHYMGCSTFSEYTVVAEVSLAKINPQANHEHVCLLGCGVTTGIGAVHNTAKVQPGDTVAIFGLGGIGLAAVQGARQAKAGRIFAIDTNPEKFDLARSFGATDCINPKDYDKPIQDVLIELTGWGVDHTFECIGNVNVMRSALEAAHRGWGQSVVIGVAGAGKEISTRPFQLVTGRVWKGSAFGGVKGRTQLPGMVEDAMKGEIYLAPFVTHTMGLEEINDAFNLMHECKSIRTVIHY

SEQ ID NO: 8046 - protein, 453 aa, Enterobacter cloacae
LAVRKRESLMKESALSAIRSDMQSPETVYGMPAHKDRTAAVNEVHARPHLLITSPQTLLQFAFMTKGDQSGDQRFMVELSDRLGLTPSENSAPLHGITWREGALYCEKHGEFSTYLWSTTCDPRDGQLRGENPFRHGFTPPGSVICGTRLDILPWTAESEAAVTNLDPVSRCYSVTENGRAAIISDFRQDKDGLTRILILERDLTEAQLGALVQRLLEIENYRTLALLSLPLTRTMASELRRVENRLAEITEEMRTGEHRKNEQLLSALTNLAAELEAGAAANLYRFGASQAYYEIVEERLNTLSETPVPGYYTWSDFLQRRIAPAMRTCRSVKERQAKLSDKLMRAISLLRSWIDVELEHQNRDLLASMNNRARQQLHLQQTVEGLSVAAISYYVVSLISYLVKGVPGIHDVMPPELAVAILVPFIVLAIWWVVRRIRNSHTDPEHNENRSD

SEQ ID NO: 8047 - protein, 123 aa, Enterobacter cloacae
LRSETRAAIRVYPHSHRSSHLLRCPGGENALSAYLGDDREYWKQYDTVELIRKAQERLPLLVDQGLNDEFLKTQLQPERLKSVCEDTGHPLTLNLRPGHDHSYYFISSYIGDHIAHHAAALTR

SEQ ID NO: 8048 - protein, 884 aa, Enterobacter cloacae
TMSKKLFGAPPTLTDASNSVVVRGAREHNLKEVDVSVPRDALVVFSGVSGSGKSSLAFGTIYAEAQRRYFESVAPYARRLIDQAGVPDVDAIDGLPPAVALQQQRGTSNARSSVGSVTTLSSLVRMMYSRAGAYPAEQPMLYAEDFSPNTPQGACPSCHGLGHIYDVTEALMVPDPSLSIRDRAIASWPPAWHGQNLRDILVTLGYDVDIPWKELSEEERHWILFTEDTPTVPVYPGLSPEDTRVAVREKMTPGYMGTFTGARRYVLHTFAHTQSALMRKRVSSFMEGKLCPVCHGKRLKPESLSVTFAGVDIGEFMQMPLDQLAELLLPISRGDFSTHHAGADTDRDITRRDRTERAGSGRAVHSVTPDVRRTSALSTEKRLAAQRLTRGVMDRLYQLQKLGLGYLTLDRTTPTLSAGELQRLRLATQLSSMLFGVVYVLDEPSAGLHPADSHALYDALENLRDAGNSVFVVEHDLDLMRRAQWLVDVGPAAGEQGGHILYSGVPEGLKAIAESRTARYLFDEIRPPQSYARQPAGWLKLQDIHRHNLKGLDACIPLGVLTAVTGISGSGKSSLIAQALPELVLSSLGHEPEDVLSEGSDAEGPTVTEKTYGTLTGDTGLIKRLVQVDQKPIGRTPRSNLATYTGLFDHIRKLFAGTPAAKNYHYDAGQFSFNVAKGRCETCEGEGFVSVELLFMPSVYAPCPTCHGARYNPDTLRVRWKERNIAEVLQMTVDEACSFFADVEPVARPLRLLGEIGLGYLRLGQPATELSGGEAQRIKLATELQRSQRGHTLYVLDEPTTGLHASDADRLLVQLQRLVETGNTVVVIEHDMRAVVQADWVMDIGPGAGHEGGNLVAEGTPAQVSQVCESRTAPFIARELSRNW

SEQ ID NO: 8049 - protein, 92 aa, Enterobacter cloacae
EMPSTPEEKKKVLTRVRRIRGQIDALERALENGAECRAILQQIAAVRGASNGLMAEVLESHIRETFDQNDNYSHEVSKSVDDTIELVRAYLK

SEQ ID NO: 8050 - protein, 267 aa, Enterobacter cloacae
HVLQRSRMMVELQHQRLMVLAEQLQLDSLIGAAPALSQQAVDQEWSYMDFLEHLLHEEKLARHQRKQAMYTRMAAFPAVKTFEEYDFTFATGAPQKQIQSLRSLSFIERNENIVLLGPSGVGKTHLAIAMGYEAVRAGIKVRFTTAADLLLQLSTSQRQGRYKTTLNRGVMAPKLLIIDEIGYLPFSQEEAKLFFQVIAKRYEKSAMILTSNLPFGQWDQTFAGDAALTSAMLDRILHHSHVVQIKGESYRLKQKRKAGVIAEANPE

SEQ ID NO: 8051 - protein, 72 aa, Enterobacter cloacae
PVNKIYMLDTNICSFIMREQSEVVLKRLEPAVLRDQRIVVSVITYSEMRFGATGPKASPPREQLVDAFCVPF

SEQ ID NO: 8052 - protein, 95 aa, Enterobacter cloacae
QGQSMPHSPEEKKQALVRVRRIKGQIAALEQAIENEAECSSLLQQLASVRGAVKGLMTVVLESYLREEFPDTNKRRGSQTKSINDAISIVRSYLR

SEQ ID NO: 8053 - protein, 206 aa, Enterobacter cloacae
LSCYVVAELSCRYTEKIMERLEHHASFDGWQEVYQHESGTLGCTMKFGVYTPPQALNGNVPVLYWLSGLTCTEQNFITKSSVQRYAAEHGIMIVAPDTSPRGTDIPDDPDYALGQGAGFYVNATQEPWATHYKMYDYVVNELPSLIEEWFPASDKRSISGHSMGGHGALMIALRNPGRYQSVSAFSPIVAPSQVPWGRKCIVCLSG

SEQ ID NO: 8054 - protein, 210 aa, Enterobacter cloacae
TPDADDAAGTACAGCDGTTCTRTGSGDGVNAAAAGCAATAASLGWRAVVASYRSQGRWVIWLSFLVALLLQIMPWPDDILVFRPNWVLLILLYWILALPHRVNVGTGFVMGAILDLISGSTLGVRALSMSIIAYLVALKFQLFRNLALWQQALVVMLLSLAADIVVFWAEFLVINVSFRPEVFWSSVVNGVLWPWLFLLMRKIRQQFAVQ

SEQ ID NO: 8055 - protein, 200 aa, Enterobacter cloacae
KVSMTSLYLASGSPRRQELLAQLGVSFERIVTGIEEKRAEGESAQQYVSRLAREKAQAGVACVPRDLPVLGADTIVILNGEVLEKPRDADHAARMLRNMSGQTHQVMTAVALADSQYVLDCLVVTEVTFRVLTDEEIAGYIASGEPMDKAGAYGIQGLGGCFVRKINGSYHAVVGLPLVETYELLSNFNSLREGRDNYDG

SEQ ID NO: 8056 - protein, 481 aa, Enterobacter cloacae
MSLNLVSEHLLAANGLSHQDLFSILGQLTERRLDYGDLYFQSSYHESWVLEDSIIKDGSYNIDQGVGVRAVSGEKTGFAYADQISLAALEQSAQAARTIVRDTGDGRVKTLGEVQHAALYTSIDPLQSMSREEKLDILRRVDKVARAADKRVQEVSASLTGVYELILVAATDGTLAADVRPLVRLSISVQVEDDGKRERGSSGGGGRFGYDWFLGDVDGEARADAWAKEAVRMALVNLSAVAAPAGTLPVVLGAGWPGVLLHEAVGHGLEGDFNRRGTSVFSGQMGQLVSSELCTVVDDGTMLDRRGSISIDDEGTPGQYNVLIENGVLKGYMQDKLNARLMGVAPTGNGRRESYAHLPMPRMTNTYMLPGKSTPQEIIESVDYGIFAPNFGGGQVDITSGKFVFSTSEAYLIEKGKVTKAVKGATLIGSGIEAMQQISMVGNDLKLDNGVGVCGKEGQSLPVGVGQPTLKVDNLTVGGTA

SEQ ID NO: 8057 - protein, 76 aa, Enterobacter cloacae
PALSLIKVNMSLFPVIVVFGLSFPPIFFELLLSLAIFWLVRKVLVPTGIYDFVWHPALFNTALYCCLFYLISRMFV

SEQ ID NO: 8058 - protein, 676 aa, Enterobacter cloacae
CQPGFDLPSNRPSPARVWLIAMGIFSIASQHIRFAVKLACAIVLALFVGFHFQLETPRWAVLTAAIVAAGPAFAAGGEPYSGAIRYRGMLRIIGTFIGCIAALTIIILMIRTPLLMLIVCCIWAGFCTWVSSLVKVENSYAWGLAGYTALIIIITIQSEPLLAPQFAVERCSEIVIGIVCAIVADLLFSPRSIKQEVDRELDALIVAQYQLMQLCIKHGDSEEVDKAWSALVRRTQALEGMRSNLNMESSRWERANRRLKAINTVSLTLITQACETYLIQNTRPEVVTDTFRELFDEPVETVQDVHRQLKRMRRVIAWTGERDTPVTIYTWVGAATRYLLLKRGVISNTKISAAEEEVLQGEVVIKPESAERHHAMVNFWRTTLACILGTLFWLWTGWTSGSGAMVMIAVVTALAMRLPNPRMVAIDFLYGTIAALPIGALYFLVIIPSTQQSMLLLCISLAVMAFFIGIEVQKRRLGSLGALASTINIIVLDNPMTFHFSQFLDSALGQLVGCFLAMMVILLVRDNSQARTGRVLLNQFVSAAVSSLTTNTARRKENHLPALYQQLFLLLNKFPGDVARFRLALTMIIAHQRLRNAPVPINDDLSAFHRQLRRTADHVISASSDDKRRRYFKQLLEELDIYQEKLRIWEAPPQVTEPVERLVFMLHRYQNALTDS

SEQ ID NO: 8059 - protein, 320 aa, Enterobacter cloacae
VNHNKEFRMKVAVLGAAGGIGQALALLLKTQLPSGSELSLYDIAPVTPGVAVDLSHIPTAVKIKGFSGEDARPALQGADVVLISAGVARKPGMDRSDLFNVNAGIVKNLVQQIAETCPKACIGIITNPVNTTVAIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRALQGEKGVVECAYVEGDGEHARFFSQPLLLGKNGVEERKSIGTLSAFEQNAMEGMLDTLKKDITLGEEFVNK

SEQ ID NO: 8060 - protein, 339 aa, Enterobacter cloacae
PMKPIFSRGPSLQFRLILAVLVALGVIIADSRLGTFSQIRTYMDTAVSPFYFISNGPRELLDSVSQTLSSRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEDVHRVANERLMQMMPQVLPAPDAMGPPAPVPAPATGLTQPLPDAPPPPQVSGGGQ

SEQ ID NO: 8061 - protein, 501 aa, Enterobacter cloacae
AILTHCVREGIIMTAELLVNVTPSETRVAYIDGGILQEIHIEREARRGIVGNIYKGRVSRVLPGMQAAFVDIGLDKAAFLHASDIMPHTECVAGEEQKQFAVRDISELVRQGQDLMVQVVKDPLGTKGARLTTDITLPSRYLVFMPGASHVGVSQRIESESERERLKKVVSAYCDEQGGFIIRTAAEGISEEDLASDAAYLKRVWTKVMERKKRNQTRYRLYGELALAQRVLRDFADAQLDRIRVDSRLTYEALLEFTAEYIPEMPGLLEHYTGRQPIFDLYDVENEIQRALERKVELKSGGYLIIDQTEAMTTVDINTGAFVGHRNLDDTIFNTNIEATQAIARQLRLRNLGGIIIIDFIDMNNEDHRRRVLHSLEQALSKDRVKTSINGFSQLGLVEMTRKRTRESVEHVLCNECPTCHGRGTVKTVETVCYEIMREIVRVHHAYDSDRFLVYASPAVAEALKGEESHALAEVEIFVGKQVKVQIEPLYNQEQFDVVMM

SEQ ID NO: 8062 - protein, 1282 aa, Enterobacter cloacae
TQFAARFKADKERRVRRLPGILLLTGATLVVIVALLVSGLRLALPHLDSWRPQILAKIESATGLPVDVSHIEASWQNFGPTLDARDIHASLKDGGHLKIKRVTLALDVWQSLLHLRWQFRDLTFWQLQLMTNTPLQSGDSDRGLETSRISDLFLRQFDHFDLRDSEVSFITLSGQRAELAIPQLTWLNGKDRHRAEGQVNLSSLNGQHGVMQVRMDLRDDNGLLNNGRVWLQADDVDVKPWLGELLQQNMQLETARFSLEGWMTLTNGAFASGDIWLKQGGASWKGENHQHQLSVDNLTAHVTQDKGGWQFAIPDTRISMDNKPWPRGALTLAWMPEQDVGGINGKRSDELRIRASNLDLTAIEGLRSMAAKLSPELGEIWLATQPSGQINRLALDIPLQATEKTRFQAAWKNLAWKQWKLLPGAEHFSGKLEGSVENGRLTAEMQDAKMPYETVFRAPLEIEKGNATLNWLKNDKGFQLDGRDIDVKAKAVHARGNFRYLQPEGDEPWLGILAGISTDDGSQAWRYFPENLMGKALVDYLSGAIQGGQADNATLVYGGNPHLFPYKHNEGQFQVLVPLRNATYAFQPDWPALKNLDIELNFLNDGLWMKTDSVALGGVTASNLTANIPDYSKEKLLIDADIKGPGKAVGPYFEDTPLNDSLAATLQQLQLDGDVNARLHLDIPLDGELTTAKGDVRLNNNSLYIKPLDSTLKNLSGQFSFVNGTLKSEPLKATWFNQPVNIDFSTTEGDKAYQVAVNMDANWQPSRMDVLPKPIENAVDGAVSWNGKVAIDLPYHAGARYNVDITGDLKNLSSQLPAPLNKKSGEALPVNVKVAGNLNSFDLTGNAGGTNHFNSRWLLNRKLTLDRAIWTTDSRTTPPLPEQAGVELNLPSMDGAEWLALFQKGVGQNVDQTAQFPQSITLRTPALTLGGQQWNNLSIVSRPTVNGSKVEAQGREINGSLIMRDHAPWQAAIRYLYYNPTFTASKAESTSTSPVSGSGTSRVDFSGWPDLQLRCAECWLWGQKYGRIDGDFAIQGNTLSLSGGLVDTGFGRMTAAGEWVNKPGEQRTSLKGDIKGNKLDAAANFFGISTPLRGSSFDVNYDLHWRAAPWTPDEASLNGILKTNFGKGEIADVSTGRAGQILRLLSFDALLRKLRFDFSDTFSEGFYYDSIRSTAWIKDGVLHTDDTLVDGLEADIAMKGSVNLVRRELDMEAVVAPEISASVGVAAAFVVNPIVGAAVFAASKVLGPLWSKVSILRYRITGPVDKPQINEVLRQPRKEAPQ

SEQ ID NO: 8063 - protein, 319 aa, Enterobacter cloacae
YRACLSEVDVKTLTRKISRTAITMALVILAFIAIFRAWVYYTESPWTRDARFSAEVVAIAPDVAGLITAVNVHDNQLVKKDQVLFTIDQPRYQKALEEAEADVAYYNALASEKRREAGRRNKLGIQAMSREEIDQSNNVLQTVLHQLAKAQATRDLAKLDLERTVIRAPSDGWVTNLNVYAGEFITRGSTAVALVKQNSFYVLAYMEETKLEGVRPGYRAEITPLGSNRVLKGTVDSVAAGVTNSSSTNDSKGMATVDSNLEWVRLAQRVPVRIRLDEQQSNLWPAGTTATVVITGEKDRDASQDSIFRQIAHRLREFG

SEQ ID NO: 8064 - protein, 660 aa, Enterobacter cloacae
CSLAPPSTHGVISRMRLTTKFSAFITLLTGLTIFVTLIGCSLSFYNAIQDKLVNRVESVASVIDTRLITSSFPALSRELDELMVPVDIVQIDIKQGKQTVFSHTRQGSYRPAGTVDQYRDVTVNSLKHPGMTIHLMYQDPMSNYLRSLMTTAPLTIAVAFIVLLIFLAVRWQRRQLSGQELLETRSVRILNGERGPQVRGSVYEWPSRTSSALDVLLSEIQFASDQRSRMDTLIRSYAAQDNKTGLNNRLFFDNQLATLLDDPEKVGTHGVVMMIRLPDFDLLRDTWGQRVAEENLFTLINLLSTFIMRYPGALLARYHRSDFAVLLPHRTLKESESIASQLLKAVDALPQSKMLDRDDMVHIGICAWRGGQSTEQVMEHAEAATRNAVLQGANGWAVYDDTLPEKGRGNVRWRTLIEQMLSRGGPRIYQKPAVMKSGHVHHRELMCRIFDGTEEVISAEYLPMVLQFGLSEEYDRQQITRLIPFLSYWPEENLALQVTVESLIRPRFQRWLRDTLMQCEKSQRKRIIFELAEADVGQHISRLRPVVRLINALGARVAVTQAGLTLVSTSWIKELDVELLKLHPGLVRNIEKRTENQLLVQSLVEACKGTQTQVFATGVRSRSEWQMLTERGVTGGQGDFFAASQPLDTNVKKYLQRYSV

SEQ ID NO: 8065 - protein, 389 aa, Enterobacter cloacae
QRKRAALIFTVADDFCALSLLRVVGKVSGFCFPPQLSGLSLSMLKKFRGMFSNDLSIDLGTANTLIYVKGQGIVLNEPSVVAIRQDRAGSPKSVAAVGHDAKQMLGRTPGNIAAIRPMKDGVIADFFVTEKMLQHFIKQVHSNSFMRPSPRVLVCVPVGATQVERRAIRESAQGAGAREVFLIEEPMAAAIGAGLPVSEATGSMVVDIGGGTTEVAVISLNGVVYSSSVRIGGDRFDEAIINYVRRNYGSLIGEATAERIKHEIGSAYPGDEVREIEVRGRNLAEGVPRGFTLNSNEILEALQEPLTGIVSAVMVALEQCPPELASDISERGMVLTGGGALLRNLDRLLMEETGIPVVVAEDPLTCVARGGGKALEMIDMHGGDLFSEE

SEQ ID NO: 8066 - protein, 557 aa, Enterobacter cloacae
ATAGGAGYLPGETADLGSAAAGYRAGRAAGVYAAPLPECADRQLTKRKPTPKASVFLWLYLFLQVQTFRKGGHMTTQALQDSILFQTGYLVNGIWKTLDTTFDVLNPATGEVIAKVAKAGKAETEEAIVAATKAFPAWRAKTAKERSAILYRWYELIIENKSWLGRLMTTEQGKPLKEAEGEVDYAASFIQWFAEQAKRANGEIIPPVKPGSRILATREPVGVVAAITPWNFPMAMLTRKLGPALAAGCTGVIKPANNTPLSAFALLTLAKQAGVPDGVLNAVAGSTSEISDAIMASHDVRKISFTGSTAVGKTLVRNSAETMKKVSMELGGNAPYIVFEDADIDAAVKGAIANKFRNAGQVCVSVNRFYIQETVYDKFVNQLADAVKALKVGNGLDEGVVVGPLIEPSAVEKVREHVEDAVAKGATVLAGGKPHELGGNFWMPTVLGDCHEGMKLAEEETFGPVAACFRFTSEDEVVMRANNTPYGLAAYFYTQNLSRVFRVSQAIESGMIGINECAVSTELGPFGGVKESGLGREGSVLGLEEFLEVKTLHIGGL

SEQ ID NO: 8067 - protein, 104 aa, Enterobacter cloacae
TGRHLPPACTGWLAMKIYTFDFDEIESQEDFYREFIRAFDLERGSVSNLDMLWDVVTGDRLPLPLEIEFTHLPEKLRRRFGALILLFDEAEEELEGQLRFNVRQ

SEQ ID NO: 8068 - protein, 374 aa, Enterobacter cloacae
CPDNSCYAANRSFFNDTRIMLLKLFRSIVIGLIVAGLLLVAMPSLRQFNKLSAPQFDSTDETPATYNQAVRRAAPAVVNVYNRGLNSSAHNQLEIRTLGSGVIMDDRGYIITNKHVINDADQIIVALQDGRVFEALLVGSDSLTDLAVLKINATGGLPTIPINRKRTPHIGDVVLAIGNPYNLGQTITQGIISATGRIGLNPSGRQNFLQTDASINHGNSGGALVNSLGELMGINTLSFDKSNDGETPEGIGFAIPFQLATKIMDKLIRDGRVIRGYIGIGGREIAPMHTQGGGIDQIQGIVVNEVAPGGPAANAGIQVNDVILSVNGTPAVSALETMDQVAEIRPGSIIPVEVMRNDKKLTIQVTIQEYPATN

SEQ ID NO: 8069 - protein, 353 aa, Enterobacter cloacae
HIRANPPPPSCLEKRLTEDAMKTRKLTEADVTSESVFMLQRRQILKMLGISATALTLTPAAHADLLDWFKGNDRPKAPSGAPLDFTKPAQWQNKLTLTPEDKVTGYNNFYEFGLDKADPAANAGSMKTDPWTLKIDGEVAKPVTLDHHDLTTRFPLEERIYRMRCVEAWSMVVPWVGFPLHKLLALVEPTSNAKYVSFQTRYAPDEMPGQKDRFIGGGLEYPYVEGLRLDEAMHPLTLLTVGVYGKALPPQNGAPIRLTVPWKYGFKGIKSIVSIKLTRERPPTTWNLAAPDEYGFFANVNPHVDHPRWSQATERFIGSGGALDVKRQPTLLFNGYADEVASLYRGLNLRENF

SEQ ID NO: 8070 - protein, 81 aa, Enterobacter cloacae
VRLTAKQITWLKVLLHLAGLLPFIWLFWAASQGQFSADPAKDIQHFTGRMALKFLLATLLVSPLARYAKQPVFTRDGDHVK

SEQ ID NO: 8071 - protein, 474 aa, Enterobacter cloacae
HQDVFGAVLFHSRIRESASMKKKNQLLSALALSVGLSLSASFPASAALPSQVPGQEAIPSLAPMLEKVLPAVVSVQVEGTARQSQRIPEELKKYFGEDAPDQQAQPFEGLGSGVIIDAAKGYILTNNHVISQADKISVQLNDGREFDAKLIGGDDQSDIALLQVQNPSNLTQIAIADSDKLRVGDFAVAVGNPFGLGQTATSGIVSALGRSGLNLEGLENFIQTDASINRGNSGGALLNLNGELIGINTAILAPGGGSIGIGFAIPSNMAKTLSQQLIQFGEVKRGLLGIKGMEMSADIAKAFKLNVQRGAFVSEVLPNSGSAKAGVKSGDVIVSLNDKPLSSFAELRSRIATTEPGAKVKLGLIREGKPLTVEVTLDKSTSSSASAEQISPALQGATLSDGQLKNGTKGISVTTVEKSSPAAQAGLHQDDVIVGVNRTSVQSIAEMRKVLESKPAVIALQIIRGNDTLYILLR

SEQ ID NO: 8072 - protein, 72 aa, Enterobacter cloacae
LMRSSSKQEELVKAFKALLKEEKFSSQGRNCSGVAGTRLRQHQPVEGLSHVNQVWSGAYAQRQNGNGLLPAC

SEQ ID NO: 8073 - protein, 327 aa, Enterobacter cloacae
GPCMQALILEQQDGKTVASVQAIEENRLPEGDVTVDIDWSSLNYKDALAITGKGKIIRNFPMVPGIDFAGRVHTSEDPRFHAGQQVLLTGWGVGENHWGGLAAQARVKGDWLVPMPKGLDGRKAMIIGTAGFTAMLCVMALEEAGIRPDSGEIVVTGASGGVGSTAVTLLHKLGYQVAAVSGRESTHDYLRQLGASRILSRDEFAETRPLEKQVWAGAVDTVGDNVLAKVLAQMNYGGCVAACGLAGGFALPTTVMPFILRNVRLQGVDSVMSPAERRAEAWERLVQDLPASFYEQSATEITLSQAPEFANKIMDNQFHGRALVKIA

SEQ ID NO: 8074 - protein, 157 aa, Enterobacter cloacae
ETSPSSPRRVKQPTPGGTTRQREKFMTWEYALIGLVVGIIIGAVAMRFGNRKLRQQQSLQYELEKNKAELEEYREELVSHFARSAELLDNMATDYRQLYQHMAKSSSSLLPEMTAETNPFRNRLADSEAGNDQAPVQMPRDYSDGASGLLRGGVKRD

SEQ ID NO: 8075 - protein, 145 aa, Enterobacter cloacae
RRLKRYSKKRNSVLRGEIVQALQEQGFDNINQSKVSRMLTKFGAVRTRNAKMEMVYCLPAELGVPTTSSPLKNLVLDIDYNDAVVVIHTSPGAAQLIARLLDSLGKAEGILGTIAGDDTIFTTPANGFSVKDLYEAILVLFEQEL

SEQ ID NO: 8076 - protein, 89 aa, Enterobacter cloacae
IIMKIKTTVATLSVLSVLSFGAFAADTINAEQAQSRQAIGTVSVGAIGTSPMDMHEMLNKKAEEQGASSYRIIEARSGDHWHATAELYK

SEQ ID NO: 8077 - protein, 178 aa, Enterobacter cloacae
KRFTLTQTCPALRNLLAIAPLTAASISASSKTIYGALPPSSIDTFFMVSAELRTSVFPTAVEPVNEILRTSWLAIMASLISEVLPATAFSTPSGTPACFASVSSAKALSGVLFAGLITPVHPAASAGPSLRVSIAIGKFHGVIAATTPTGSRVARIREPGLTGGMISPLARLACSANH

SEQ ID NO: 8078 - protein, 309 aa, Enterobacter cloacae
IMERLKRMSVFAKVVEQGSFTAAARQLQMSVSSISQTVSKLEDELQVKLLNRSTRSIGLTEAGKIYYQGCRRMLHEVQDVHEQLYAFNNTPIGTLRIGCSSTMAQNVLAAMTAEMLKEYPGLTVNLVTGIPAPDLIADGLDVVIRVGALQDSSLFSRRLGSMPMVVCASKSYLAQYGVPEKPADLSNHSWLEYSVRPDNEFELIAPEGLSTKLLPEGRFVTNDPMTISRWLVAGAGIAYVPLMWVINEINSGVLEILFPRYQSDPRPVYALYTEKDKLPLKVQVCINYLTDYFVEVAELFQGMRGRRKE

SEQ ID NO: 8079 - protein, 576 aa, Enterobacter cloacae
IDDNYCSGFFMRQLNRLNQYQRLWHPSAGAPQQVTISELASRCFCSERHVRTLLRQAQEAGWLSWHARSGRGKRGELRFHVTPDSLRNTMMEEALKSGQQHNALELAQLAPEDLRSLLHPFMGGQWQNDTPTLRIPYYRSLEPLQPGFLPGRAEQHLAGQVFSGLTRFNGNSSEPTGDLAHHWEVSADGLRWHFYIRSTLHWHNGDKIETAQLRQSLTALLSQPGMGTLFRSVLRIETTHPQCLTFILHQPDYWLAHRLATYCSRLAHPDYPVVGSGPFRLSVFEPELVRLESHEQYHLGHPLLKAIEYWITPQLFDYSLGTSCRHPVQIAIGEADELASLRLVSNSTSLGFCYLTLKQSPRLSELQAKRLINIIHLSTLLHTLPLNEGLITPTEELLPGWAIPQWPDLTDVALPEALTLVYHLPVELHTMASQLKAYLTRQGCELTVIFHDAKTWDGCQQLADADIMMGDRLIGEAPAYTLEQWLRCDALWPHLLSAPAFAHLQATLDAVQSQADERDRHAGLQAIFSRLMETAVLTPLFNYQYQISAPPGVNGIRLNTRGWFDFTEAWLPPPNA

SEQ ID NO: 8080 - protein, 232 aa, Enterobacter cloacae
SMKRAVVVFSGGQDSTTCLIQALHQYDEVHCVTFDYGQRHRAEIDVARELALKLGARAHKVLDVTLLNELAVSSLTRDSIPVPDYEPDASGIPNTFVPGRNILFLTLTAIYAYQVKAEAVITGVCETDFSGYPDCRDEFVKALNHAVDLGMAKETRFETPLMWLDKAETWALADYWGKLDVVRNETLTCYNGIKGDGCGQCAACNLRANGLNHYFADKAGVMAAMQKKTGLK

SEQ ID NO: 8081 - protein, 368 aa, Enterobacter cloacae
QQFFLCFSLCWAQNDKRITTMNSTWVKHAISEINADYQRSADTHLIRLPLPGFPGIQLYLKDESTHPTGSLKHRLARSLFLYGLCNGWIKEGTTIIESSSGSTAVSEAYFARLLGLPFIAVMPSCTAKRKVEQIEFYGGRCHFVDSACEIYAASEMLARELNGHYMDQFTFAERATDWRGNNNIADSIFRQMTHEPHPLPSYIVMSAGTGGTSATIGRYIRCQGYDTQLMVVDPQNSVFLDYWQSRDASLRSPVGSKIEGIGRPRVEPSFIPDVVDEMLRVPDAASVATAHWLETQLGRKVGASTGTNMWGALQLAARMREEGRTGSVVTLLCDSGERYLDTYYNAEWVQANIGDVEPWKAQISQLVK

SEQ ID NO: 8082 - protein, 521 aa, Enterobacter cloacae
NSMRTRHLVSLVTGVLIFSVLVPVCLSIWLAHRQAEEKFVDALDSYASRVLIRTDRVVAQAKQALTHLQTFHAPPCTPPHLREMRRVAFSWRYIQEVMYIDNLKPLCSSLEQSSDTAILPPPMRITENGYSAWLTSQNDLGIQRYMAVLGKGHYLVMVDPASLVDVVPFGEISMDAALVGSSTHHIFARSNVLDPYILSVVKEQQDVTRVQYNGSMYVMKPVPELGFTVIAWASLKPLAASWHQQLIIWLPAGILLSLVAALIVLRILRRLLSPRHRLIDAINNREIEVHYQPIVALCSGKLVGAEALMRWPQPEGSNLSPNLFVPLAEQTGLISTLTRLVVNEVFEDLGAWLHHHPELHISVNLAPSDLTSPELPRQLSQLLNKWGVHPRQIALELTERGFADPAVSVPAIAAFRRAGHAIYIDDFGTGYSSLSYLQDLDVDTLKIDKSFVDALEYKHVTPHIIEMAKSLKLAMVAEGIETEGQIEWLHRHGVQYGQGWYFSKALPKEDFILWAAHNLRK

SEQ ID NO: 8083 - protein, 512 aa, Enterobacter cloacae
TDIKLYQTTYHFLFSEVPGSIFGENGTMINVQFSNSGLHMSSRRFGSQSLVRLLGHWQQASSRTPLWRQLADALRLLILDGRLALNTRLPGERELATALSVSRTTISSALAHLREEGYLESRHGSGSRAILPDSRAVPTLSTASAALDLSTAALNAGPEIHQAYAHALTAITPNLALTGYDQLGLPALREAIAARYTARGLPTRADEVMVVNGAVSGFALILRMMTGPGDRVVVDHPTYPLAIAAIQGALCRPVGVSLPETGWDTDGFAATLAQTAPRLAYLMPDFHNPTGRCMDAATRQTITDIAAQTRTTLVVDETMVDLWFDAPPPPPLAAFNPEAAVMTLGSAGKSFWGGLRLGWIRASSRTIATLAQTRDTLDLGSPVLEQLATLWLIENSETFLPARREMLAERRDRCGQMLREHFPEWRFQEAEGGLSYWIELPGMLATQLAARAETTGIIMGTGTRFGLSGAFDRYLRMPFSLSPPELEEALLRIKPLWRALNKSVAPVKRSLV

SEQ ID NO: 8084 - protein, 109 aa, Enterobacter cloacae
FPAGETMDEHDTFPQRVWQIVASIPEGCVTTYGEVARLAGSPRAARQVGGVLRRLPEGSTLPWHRVVNRHGAISLTGPDLQRQRQALLSEGVQVSGAGQIDMQKYRWEY

SEQ ID NO: 8085 - protein, 313 aa, Enterobacter cloacae
DYSTHRTTIVSALYSAYLSPRRLLRTTMSQALNNLLTLLNLEKIEEGLFRGQSEDLGLRQVFGGQVVGQALYAAKETVPADRLVHSFHSYFLRPGDSAKPIVYDVEVLRDGQSFSARRVAAIQHGKPIFYMTASFQAPEPGYEHQKKMPPAPSPDDLKSETEIARALAHLLPPQVKEKFLCDKPLEIRPVEFHNPMKGHTAEPARQVWIRANGSVPADLRVHQYLLGYASDFNFLPVALQPHGVGFLEKGMQVATIDHSMWFHRPFDMNEWLLYSVESTSASSARGFVRGEFYTQDGVLVASTVQEGVMRNRG

SEQ ID NO: 8086 - protein, 167 aa, Enterobacter cloacae
RCNRVITCTAAKICQDKEVIPVMTSEPITTKGYCAMQTQIKVRGYHLDVYQHVNNARYLEFLEEARWDGLENSESFLWLTAHNIAFVVVNININYRRPAVLGDVLTVTSEVQQLNGKSGVLSQVVTLEPEGQIVADALITFVCIDLKTQKALPLEGELREKLELMIA

SEQ ID NO: 8087 - protein, 120 aa, Enterobacter cloacae
ITGKIIKRINSMSKSERKFSSTVSHDEAVVKMLRENPSYAQLYLQIALDEIYEDQGIPAYLIALRRVIEARGGIGEISAKAGLSRQQLYRTLSENGNPTLTTLMKITRAAGVKLFDSTVR

SEQ ID NO: 8088 - protein, 206 aa, Enterobacter cloacae
SAFISLMACLTQVLFIVVIRLSFCAQHSEKHRKNCCYLTFKIECKENNFLFEVAMLDKIDRKLLSLLQSDCTLSLQALADAVNLTTTPCWKRLKKLEDDGILLGRVALLDPEKLGLGLTAFVLIKTQHHSSEWYCRFVTQVSDMPEVLGFWRMAGEYDYLMRVQVADMKRYDDFYKRLVNSVPGLSDVTSSFAMEQIKYTTALPIE

SEQ ID NO: 8089 - protein, 594 aa, Enterobacter cloacae
LLKIPSGKDRVRLFAQLSWYFRREWQRYLGAVALLIIIAILQLFPPKVVGYVVDGVTEQHYTAARVMMWVGTLVLTAVVVYLLRYVWRVLLFGASYQLAVELREDFYRQLSRQHPEFYLRHRTGDLIARATNDVDRVVFAAGEGVLTLVDSLVMGCAVLIVMSTQISWELTLLALLPMPLMALAINRYGEQLHERFKLAQAAFSSLNDRTQESMTSIRMIKAFGLEDRQSALFAADAADTGAKNMRVARIDARFDPTIYIAIGMANLLAVGGGSWMVVRGTMTLGQLTSFAMYLGLMIWPMLALAWMFNIVERGSAAYSRIRAMLAEVPVVNDGSEPVPEGPGILKADIRAFIYPQTEHPVLENVSFTLRPGQMLGICGPTGSGKSTILSLIQRHFDVSEGDIRFHDIPLPRLLLDDWRSRLAVVSQTPFLFSDTIANNIALGCPTATQDQIEHVARLASVHEDILRLPQGYDTEVGERGVMLSGGQKQRISIARALLLDAEILILDDALSAVDGRTEHQILHNLRQWGEGRTVIISAHRLSALTEASEILVLQHGHIAQRGQHEQLAGQTGWYRDMYRYQQLEAALDEEVADA

SEQ ID NO: 8090 - protein, 193 aa, Enterobacter cloacae
NDIGWDRSRRCIDDKETSMKLVPMLSGVAMAVALSACADKSADVAVPTATPNGINTLSQQAIRQPNVSGTIWIKQKVALPPDAVLTVTLSDASLADAPSKVLAQRAVRTEGKQAPFSFVLPYNPSDVQPNARILLSAAVTINDKLVFITDTVQEAVNKGGTKIDLTLVPVQQTEVPVATQTNQPTLPTPPTQM

SEQ ID NO: 8091 - protein, 373 aa, Enterobacter cloacae
WRNCVRIETSLFTTPECMKAITLYDVARVAGVKKKKKKKKKKKKKKKKKKKKKKVRQAMAALHYVPNRGAQQLAGKRTRTLGLMTSDLALHAPSQIASAVKSRAVEQGASVLISMVEQPAQCQAALQELLAQRVEALLVNVPLEDALAEMLQEMASPTPVLFLDVSPTARVNSLVFNAEQGAALGAEHLLSLGHQRIALLAGPESSVSARARLAGWKTTLAQAGVEAFAVAQGDWSAASGYEKGHQLLAGAQLPEAIFVANDQMALGVIRACAEKGVAVPGQISVVGFDDTADSAWFSPPLTTVRQAFREAGERSVEWLMAPAHHDECWQEQLPVTLIVRHSTAPRAAQQADREDLAQQLRTLALLAEKLARS

SEQ ID NO: 8092 - protein, 677 aa, Enterobacter cloacae
CAFFVCPDLICASLCELWADNCPVFLSQYAFTRDGQDFPSASGNQSPTAECCYTMMDSLRTAANSLVLKIIFGIIIVSFILTGVSSYLIGGGANYAAKVNGQEISRGQFENAFAGERNRMQQQLGDQYSELAANEGYMKNLRQQTLNRLIDEALLDQYAKSLGLGISDEQVKKAIFSTQAFQSNGKFDNARYNSIVNQMGMTADQYAQALRNQLTTQQLINAVVGTDFMLKGETEKLAALVAQQRVVREATIDVNALAAKQQVSDAEVNAYYEQNKNNFISPEQFRVSYIKLDAAAMQENATDAEIQSYYDQHQDQFTQPQRNRYSVIQTKTEAEAKAVLDELNKGADFATLAKAKSTDIISAKNGGDMGWLEESTTPDELKNAGLKEKGQLSGVIKSSVGFLVARLDDVVAAKTKPLTDVRDDIAAKVKQEKALDAFYALQQKVSDAASNDNESLAGAEQAAGVKAVETGWFSHENLPEELNFKPVSDAIFNGGLVGENGTPGSNSDIITVDGDRAFVLRVSEHKAEAVKPLAEVKDQVVALVKHNKAAQQAKLDAEKILADLKAGKNDALKAAGLSFGEAKTLSRTGQDPVSQAAFGLSLPAKDKPVFGTTTDMQGNVVVLALDEVKAGTLPDAQKKAMVQGITQNNAQIAFEALMSNLRKEAKIKLGDVVTQEQ

SEQ ID NO: 8093 - protein, 681 aa, Enterobacter cloacae
FWMMRCPRLTGVLNIKFCITFASGERGARSSLARTVCRRLPKPVKFWCFSTGILPSVVSMSSSPGRPAGIGICTAINSLKPRWMRRWPMRKFGQMWPTLKRLLAYGSPWRKPLSIAVLLLWIAAIAEVTGPLLISYFIDNMVAKSYLPLGLVAGLGVAYVGLQLTAAGLHYAQSLLFNRAAVGVVQQLRTDVMDAALRQPLSEFNTQPVGQVISRVTNDTEVIRDLYVTVVATVLRSAALIGAMLVAMFSLDWRMALVAITIFPAVLIVMVIYQRYSTPIVRRVRAYLADINDGFNEVINGMSVIQQFRQQARFGERMGEASRSHYMARMQTLRLDGFLLRPLLSLFSALVLCGLLMLFGLTTRGTIEVGVLYAFISYLGRLNEPLIELTTQQSMLQQAVVAGERVFELMDRPRQTYGDDERPLESGSIAFDHVSFAYRDDQLVLQDINLEVPSRGFVALVGHTGSGKSTLASLLMGYYPLTQGEIRLDGRPLASLSHNALRKGVAMVQQDPVVLADTFYANVTLGRPFTPEQVWEVLETVQLADLARGLSEGINTRLGEQGNNLSVGQKQLLALARVLIETPQVLILDEATASIDSGTEQAIQQALAAVRDHTTLVVIAHRLSTIVDADTILVLHRGQAVERGTHRALLEAKGRYWQMYQLQLAGDELAASVREEESLSA

SEQ ID NO: 8094 - protein, 445 aa, Enterobacter cloacae
RSGVVSNSWHTVIGIEKMKKATMKTGLGSLALLPGLAMAAPAVADKADNAFMMICTALVLFMTIPGIALFYGGLIRGKNVLSMLTQVAVTFALVCVLWVVYGYSLAFGEGNAFFGNVNWAMLKNIELTAVMGSFYQYIHVAFQGSFACITVGLIVGALAERIRFSAVLIFVVVWLTLSYIPIAHMVWGGGLLASHGALDFAGGTVVHINAAVAGLVGAYLIGKRVGFGKEAFKPHNLPMVFTGTAILYFGWFGFNAGSASAANEIAALAFVNTVVATAGAILSWVFGEWAVRGKPSLLGACSGAIAGLVGITPACGYVGVGGALLIGIVAGLAGLWGVTALKRVLRVDDPCDVFGVHGVCGIVGCIMTGIFAAQSLGGVGYAEGVTMGHQVLVQLESIAITVVWSGVVAFIGYKLADMTVGLRVPEEQEREGLDVNSHGENAYNA

SEQ ID NO: 8095 - protein, 225 aa, Enterobacter cloacae
KLDINHSAIFTEDGTWYFGEEKMVRRLVQLYVGLGLYGLSTAMFIRSDLGVDPWDVFHLGVAIQTGMSIGTVIILTGAAVLLLWIPLRQLPGLGTISNVICIGLAADASMALIPELTSLPVRITLLVSGIVVNALATGMYIGAGFGAGPRDGLMTGIHARLGWSIRSVRTAIEVTVLIVGYLLGGAFGVGTVLYALTIGPLIQLCLPWFRQRPRIQKAAQPERIV

SEQ ID NO: 8096 - protein, 1036 aa, Enterobacter cloacae
ALRKEVDMSSTLPLTLSALLAKKKKKKKGVTQWNRLAAHAPFHSWRDETFAREDKPSRSKRLLNGIWRFSFFPAPEQVPEAWITDDLADAVEMPVPSNWQMQGFDTPIYTNVTYPINVNPPYLPAENPTGCYSLTFEMDDAWMCSGQTRIIFDGVNSAFHLWCNGQWMGYSQDSRLPAEFDLSAVLRPGQNRLAVMVLRWCDGSYLEDQDMWRMSGIFRDVSLLHKPETRIADYQIVTDLNAECDRAILRVDVALEGTRYAECEVAFTLWRNGEACAQTTQQPGSAIVDERGSWAERLRVAIPVNAPALWSAETPECYRLTISLRDAQGNVLETEACDVGFRRVEISNGQLKLNGKPLLIRGVNRHEHHPEKGQVMDEATMRRDIELMKQHNFNAVRCSHYPNHPLWYTLCDRYGLYVVDEANIETHGMVPMSRLADDPRWLPAMSERVTRMVQRDRNHPSIIIWSLGNESGHGANHDALYRWLKTTDPTRPVQYEGGGASTAATDIVCPMYARVDQDQPFPAVPKWSIKKWIGMPDETRPLILCEYAHAMGNSFGGFASYWQAFRSHPRLQGGFVWDWVDQALTKKAEDGTVFWAYGGDFGDKPNDRQFCLNGLVFPDRTPHPALYEAQRAQQFFTFTLVSTAPLVVEIQSDYLFRHTDNEYLRWSVARDGAVLASGETPLSVAPEGTQHVEIPLPELVAEPGEVWLNVEIVQPQATSWSPPGHRCAWDQWPLPAPLYLAPPKAGGTPPQLTVEDEALDITHQQQRWQFSRLTGNLTQWWNEGAETLRSPLTDNFTRAPLDNDIGVSEATRIDPNAWVERWKAAGMYEMSARLLQCEAEQHNREVIVTTQHVWEHQGKALFMSCKVWRIDDHGVLQGDVQVTVASDIPEPARVGLSVMLADIPETVRWLGLGPLENYPDRKLAAQQGRWALPLEEMQTPYIFPTENGLRCDTRELTFGSHQLQGQFHFSLSRYSQRQLHETTHQHLLREEAGCWLNLDAFHMGVGGDDSWSPSVAPAFILQNRRLRYTFSWQQNG

SEQ ID NO: 8097 - protein, 173 aa, Enterobacter cloacae
PWKPRVFRGKGKLTYTGSLGEVMQESIQAALTVVRARAEKLGINPDFYEKRDIHVHVPEGATPKDGPSAGIAMCTALVSCLTGNPVRADVAMTGEITLRGQVLPIGGLKEKLLAAHRGGIKTVLIPYENKRDLEEIPDNVIADLQIHPVKRIEEVLTLALQNEPSGMQVVTAK

SEQ ID NO: 8098 - protein, 119 aa, Enterobacter cloacae
GHSRTDITAARSRCEGFRCDINYKERKRTVNKSQLIDKIAAGADISKAAAGRALDALIASVTESLQAGDDISLVGFGTFAVKERAARTGRNPQTGKEITIAAAKVPGFRAGKALKDAVN

SEQ ID NO: 8099 - protein, 166 aa, Enterobacter cloacae
RSAKTKGRFRGFFHFCNLLFVPVFPCGYRGMAVNKQGENSMKCGIKALLITLAIATSGMSAGALAASPSSKAQAAQTQADATSQGQVKANATASTKAIEDEGTRVSINTASADDLARVMNGVGLKKAQAIVSYREEYGPFITLDDLKQVPGMGSALVERNLAHLTL

SEQ ID NO: 8100 - protein, 126 aa, Enterobacter cloacae
KTRRVFRDKIMNRDYVVKRYRTRDGKIPFEDWVAKLRRKDPELAFRILLRIDRAEKGNFGDYRYLREGVWELKVDSGPGYRVYFAVQHREILLLLIGGDKKSQKADVMLAIDYWKDHQKDKLHEQK

SEQ ID NO: 8101 - protein, 280 aa, Enterobacter cloacae
PHHISGVIMARLAAFDMDGTLLMPDHRLGEKTLKTLKRLREREVTLTFATGRHVLEMRHLLGTFALDAFLITGNGTRIHSVDGDVLHRQDLNPEVADIVLHSTWDTQASVHVFNDEGWFTGREIPALLHAHVYSGFKYQLIDLRRIPAHKVTKICFCGDHDDLCRLRIQLNEALGERAHLTFSAVDCLEVLPVGCNKGSALAVLSDHLGLTMQDCMAFGDAMNDHEMLSNVGRGLIMGNAMPQLIAALPHLPVIGHCRNEAVSHFLTHWLDKNNLPYSPE

SEQ ID NO: 8102 - protein, 124 aa, Enterobacter cloacae
LRPLPNSDWRGYMKLVTVVIKPFKLEDVREALSSMGIQGLTVTEVKGFGRQKGHAELYRGAEYSVNFLPKVKIDVAIADDQLDEVIDVVSKAAYTGKIGDGKIFVAELQRVIRIRTGESDEAAL

SEQ ID NO: 8103 - protein, 372 aa, Enterobacter cloacae
NARALFMNKVVLYCRPGFEKECAAEITDKAAKREVFGFARVKENAGYVVFECYQPDDADKLARELPFSSLIFARQMFVAGELLKDLPPEDRITPIVGLLQGVVEKGGDLRVEVADTNESKELMKFCRKFTVPLRAALRDAGVLTNYETPKRPVVHIFFIAPGCCYAGYSYTTNNSPFFMGIPRLRFPADAPSRSTLKLEEAFHVFIPADEWDERLANGMYAVDLGACPGGWTYQLVKRNMWVSSVDNGPMAQSLMDTGQVTWLREDGFRYRPNRNNISWMVCDMVEKPAKVAALMASWLVNGWCRETIFNLKLPMKKRYEEVSQNLAYIQQQLDEHGINAEIQARQLYHDREEVTVHIRRWWAAVGGRRDER

SEQ ID NO: 8104 - protein, 153 aa, Enterobacter cloacae
AGSTYCSWNAAKRTGSTVFTVLPFLFLSSAMLCFAPFRFSVEVYMSHHDSVRAQLHAIEALMRQHQLWQDNAPQPDAFASTQPFCLDTLDPFEWLQWVLIPRMHALLEGGHALPASFAVSPYYEMALEATHPARAMMLVELEKLDALFAGDDA

SEQ ID NO: 8105 - protein, 460 aa, Enterobacter cloacae
HQTNRTETCWGARMMTTQSSPIVTDMKVIPVAGQDSMLLNIGGAHNAWFTRNIVVLTDNAGNTGVGEAPGGEVIYQTLVDAIPHVVGQEVARLNKVVQRVHKGNHSADFDTFGKGAWTFELRVNAVAALEAALLDLLGKALNVPVCELLGPGKQRDAVTVLGYLFYVGDRTKTDLPYLERSPGSHEWYHLRHQEALSGEAVVRLAEAAQDRYGFKDFKLKGGVLPGEQEIDSVRALKKRFPEARITVDPNGAWLLDEAIALCKGLGDVLTYAEDPCGAEQGFSGREVMAEFRRATGLPVATNMIATNWREMGHAVMLNAVDIPLADPHFWTLSGAVRVAQLCDDWGLTWGCHSNNHFDISLAMFTHVGAAAPGNPTAIDTHWIWQEGEARLTKNPLEIKNGTIAVPDAPGLGVELDWDQIHKAHEAYKKLPGGARNDAGPMQYLIPGWTFDRKRPVFGRH

SEQ ID NO: 8106 - protein, 449 aa, Enterobacter cloacae
KDRTMSTFSTPVVTSMQIIPVAGHDSMLMNLSGAHAPFFTRNIVVIKDNSGHTGVGEIPGGEKIRKTLEDAIPLVVGKTLGEYKNVLTRVRTTFADRDAGGRGLQTFDLRTTIHVVTGIEAAMLDLLGQHLGVNVASLLGDGQQRSEVEMLGYLFFIGNRKLTPLPYQSQPDEKCDWYRVRHDEAMTPDAVVRLAEAAYEKYGFNDFKLKGGVLAGEEEAEAIAALAKRFPQARVTLDPNGAWSLDEAIKIGKQLKGVLAYAEDPCGAEQGFSGREVMAEFRRATGLPTATNMIATDWRQMGHTLSLQSVDIPLADPHFWTMQGSVRVAQMCHEFGLTWGSHSNNHFDISLAMFTHVAAAAPGNITAIDTHWIWQEGNQRLTKQPFEIKGGMVQVPATPGLGVELDMDQVMKAHELYQKHGLGARDDALAMQYLIPEWRFDNKRPCMVR

SEQ ID NO: 8107 - protein, 550 aa, Enterobacter cloacae
LLRFSMTTNYIFVTGGVVSSLGKGIAAASLAAILEARGLNVTMMKLDPYINVDPGTMSPTQHGEVFVTEDGAETDLDLGHYERFIRTKMTRRNNFTTGRIYSDVLRKERRGDYLGATVQVIPHITNAIKERVLAGGEGHDVVLVEIGGTVGDIESLPFLEAIRQLAVDIGREHALFMHLTLVPYMAAAGEVKTKPTQHSVKELLSIGIQPDILVCRSDRAIPANERAKIALFCNVPEKAVISMKDVDSIYKIPGLLKSQGLDDYICKRFSLNCPEANLSEWEQVIYEEANPGGEVTIGMVGKYIELPDAYKSVIEALKHGGLKNRVSVNIKLIDSQDVETRGVEILKDLDAILIPGGFGYRGVEGKIATARYARENNIPYLGICLGMQVALIEFARNVAGMENANSTEFVPDCKYPVVALITEWRDEDGNVEVRTEKSDLGGTMRLGAQACQLSDDSVVRKLYGEPVITERHRHRYEVNNMLLKQIEAAGLRVAGRSGDDQLVEIIEVPNHPWFVACQFHPEFTSTPRDGHPLFAGFVKAASEYQKRQAK

SEQ ID NO: 8108 - protein, 449 aa, Enterobacter cloacae
  UNSURE (421)
FSQLKIYVVKIFINNQGDKKMMQMFSGASSGGWFEKAQRFGKSFMLPIAILPAAGLLLGIGGALSNPNTLTAYPFLDVGWLQAIFTIMSSAGSIVFANLSVLFAVGVAVGLAKNDKGTAGLAALLAYLVMNATINALLILTGKLAHENPGAVGQGMTLGIQTLETGVFGGVVIGLVTCALHHRFNKIALPQFLGFFGGSRFVPIISSLAAILVGALMTVVWPHFQKLIFGLGGLVDATGYLGTLLYGFILRMLGPFGLHHIFYLPFWTTALGGSEIVNGHLVEGTQRIFFAQLADPNTQHFYEGTSRFMSGRFITMMFGLLGACLAMYHTARPENKKRVAGLLLSAALTSFLTGITEPIEFSFLFIAPVLYVIHALFDGLAFMLAHILHITIGQTFSGGFIDFVLFGILQGEAKTNWMFVXLVGVPWFFLYYCTFRYLIKRFDFATPGP

SEQ ID NO: 8109 - protein, 462 aa, Enterobacter cloacae
TRRKLCFRSATMSTLSHAASSAEKRTNARYWIVVMLFIVTSFNYGDRATLSIAGSEMAKDIGLDPVGMGYVFSAFSWAYVIGQIPGGWLLDRFGSKRVYFWSIFIWSMFTLLQGFVDIFSGFGIIIALFTLRFLVGLAEAPSFPGNSRIVAAWFPAQERGTAVAIFNSAQYFATVIFAPIMGWLTHEVGWSHVFFFMGGLGIVISFIWLKVIHEPNQHPGVNKKELDYIAEGGALINMDQKTQKAKVPFSQKWGQIKQLVGSRMMIGIYLGQYCINALTYFFITWFPVYLVQARGMSILKAGFVASVPAICGFVGGVLGGVISDWLMRRTGSLNIARKTPIVLGMLLSMTMVFCNYVSAEWMIIGFMAMAFFGKGIGALGWAVMADTAPKEISGLSGGLFNMFGNISGIVTPIAIGYIVGTTGSFNGALIYVGVHALVAVLSYLVLVGDIKRIELKPVGERG

SEQ ID NO: 8110 - protein, 521 aa, Enterobacter cloacae
LTNGFTVLQVHTVLAGDGQRFDNAGPGIFKLSLQIVIAMHHKENAQQQTDENGRSEDQNHHARAQAVVGHGVPLWDNQANYVYLRTISAMAQFYSAKRRVTTRQIITVEASDLDPFGQGVARHKGKTLFITGLLPGERADITLTEDKRQYARGQVKRRLNDSPERVTPRCPHFGVCGGCQQQHASTELQQKSKSSALARLVGHDVNDIIADRPWGYRRRARLSLSYQPKTERLEMGFRKAGSSDIVSVTQCPVLVPHLEALLPDVHHCLASLDGVRSLGHVELVLANSGPLMVLRHTAPLSKADREKLERFSHSHELALFLAPQSEILEQVSGEAPWYASDGLRLTFSPRDFIQVNDGVNQQMVANALEWLDVQPTDRVLDLFCGMGNFTLPLARRAASVVGVEGVEALVAKGQENAQQNGLQNVTFFHQNLEDDVTQQPWAKQGFDKILLDPARAGAPGVMQHIIKLAPERVVYVSCNPATLARDSEALLSGGYQIRRLAMLDMFPHTGHLESMVLFEHI

SEQ ID NO: 8111 - protein, 759 aa, Enterobacter cloacae
VWLVDFDRPLSLKERTMVAVRSAHLNKAGEFDPQKWIASLGISSQQSCERLTETWAYCLRTTQGHPDAELLLWRGVEMVEILSMLNMDIETLQAALLFPLADADVVTEDVLRESVGQSVVALIHGVRDMAAIRQLKAAQTDSVSSEQVDNVRRMLLAMVDDFRCVVIKLAERVAHLREVKDAPEDERVLAAKECTNIYAPLANRLGIGQLKWELEDYCFRYLHPAEYKRIAKLLHERRIDREHYIEEFVSGLRQSMKEENVRAEVYGRPKHIYSIWRKMQKKHLAFDELFDVRAVRIVAERLQDCYAALGIVHTHFRHLPDEFDDYVANPKPNGYQSIHTVVLGPGGKTVEIQIRTKQMHEDAELGVAAHWKYKEGTSGGGRSGHEDRIAWLRKLIAWQEEMADSGEMLDEVRSQVFDDRVYVFTPKGDVVDLPAGSTPLDFAYHIHSDVGHRCIGAKIGGRIVPFTYQLQMGDQIEIITQKQPNPSRDWLNPNLGYVTTSRGRSKIHAWFRKQDRDKNILAGRQILDDELEHIGISLKEAEKFLLPRYNFNELDELLAAIGGGDIRLNQMVNFLQAQFNKPSAAEQDAAALKQLQQKTYAPQQRSKDNGRVVVEGVGNLMHHIARCCQPIPGDDIVGFITQGRGISIHRSDCDQLAELQSHAPERIVEAVWGESYSAGYSLVVRVTANDRSGLLRDITTILANEKVNVLGVASRSDTREQLATIDMTIEIYNLQVLGRVLGKLNQVPDVIDARRLHGG

SEQ ID NO: 8112 - protein, 456 aa, Enterobacter cloacae
NGNAYLWYALFVWSFSLTCTEENLMSKIVKVIGREIIDSRGNPTVEAEVHLEGGFVGMAAAPSGASTGSREALELRDGDKSRFMGKGVLKAVGAVNGPIAQAIVGKDAKDQAGIDKIMIDLDGTENKSNFGANAILAVSLANAKAAAAAKGMPLFEHIAELNGTPGKYSMPVPMMNIINGGEHADNNVDIQEFMIQPVGAKTLKEAVRMGSEVFHNLAKVLKAKGMNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWDGFAYQTKVLGDKIQLVGDDLFVTNTKILKEGIEKGIVNSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 8113 - protein, 311 aa, Enterobacter cloacae
HLSQITMSKRLPPLNALRVFDAAARHLSFTRAADELFVTQAAVSHQIKSLEDFLGLKLFRRRNRSLLLTEEGQSYFQDIKEIFSQLTEATRKLQARSAKGALTVSLLPSFAIQWLVPRLSSFNSTYPGIDVRIQAVDRQEDKLADDVDVAIFYGRGNWPGLRVEKLYAEYLLPVCSPLLLTGDKALKTPADLAQHTLLHDASRRDWQTYTRQLGLNHINVQQGPIFSHSAMVLQAAIHGQGVALANNVMAQSEIEAGRLVCPFNDVLVSKNAFYLVCHDSQAELGKIAAFRQWILAKAASEQEKFRFRYEQ

SEQ ID NO: 8114 - protein, 144 aa, Enterobacter cloacae
RLCAGHASIQDLNMTSRFMLIFAAVSGFIFVALGAFGAHVLSKSLGVVEMGWIQTGLEYQAFHTLAIFGLAVAMQPAISIWFYWSSVYLAVGTVLFSGILYCLALSHLRLWAFVTPVGGVSFLAGWVLMFIGAIRLKRKGVVHE

SEQ ID NO: 8115 - protein, 201 aa, Enterobacter cloacae
PLYRYTYGLSLSCLTRREKSVDIETANALTSFTTRYCDAWHEKRGTWPQSTDLCGVPSPCIIASQDDYVIWQPKPFMGEQNVNAVERAMDLVIQPALHAFYTTQFAGDMTACFAGQPLTLLQTWSEDDLQRVQENLIGHLVTQKRLKLSPTLFIATLDSELDVISVCNLSGEVIKETLGTRNRDVLAPSLADFLTRIEPLL

SEQ ID NO: 8116 - protein, 263 aa, Enterobacter cloacae
RCMTLEILYQDEWLVAVNKPSGWLVHRSWLDRDEKVVVMQTVRDQIGQHVFTAHRLDRPTSGVLLMGLSSEAGRLLAQQFEQHQIQKRYHAIVRGWLMDSATLDYPLVEELDKIADKFAREDKGPQPAVTDYRGMATTELPVATSKFPTTRYSLVELLPKTGRKHQLRRHLAHLRHPIIGDSKHGDLRQNRSAAEHFGCNRLMLHASELRLTHPFTGEPLTIRAGLDKVWMQALSQFGWLGQLPENERVEFAAGNVQDEQQAQ

SEQ ID NO: 8117 - protein, 154 aa, Enterobacter cloacae
LREQSMAEVGIFVGTMYGNSLLVAEEAEAILVNQGHKATVYEDPELADWEKYKDKYILVVTSTTGQGDLPDSIVPLFQGIKDQLGYQPDVHYGIIALGDSSYANFCGGGKQFDALLQEQSAQRVGEMLLIDAGEHPEPESESNPWVEHWATLLN

SEQ ID NO: 8118 - protein, 384 aa, Enterobacter cloacae
GWLMKIVIAPDSYKESLSALEVATAIEVGFREIFPSAHYVKLPVADGGEGTVEAMVAATHGRLVHVPVTGPLGERVEGFFGLSGDGKSAFIEMAAASGLELVAPAKRNPLITTSWGTGELIRHALDAGVKHIIIGIGGSATNDGGAGMVQALGVKLLDAKAQPVGPGGGELASLAHIDLSGLDKRLADCRIEVACDVTNPLIGETGASAVFGPQKGATPEMVRTLDNALAHYAKIIARDLDIDVLNLAGGGAAGGMGAALYAFCGAQLRQGIEIVTDALHLDEQVADADLVITGEGRIDSQTIHGKVPVGVARVAKRYNKPVIGIAGSLTADVGVVHEHGLDAVFSVIYTICSLEDALENAQQNVQMAARNIAAVIKMGQGMSR

SEQ ID NO: 8119 - protein, 277 aa, Enterobacter cloacae
GNAATRLRHLMESVMTQIDRLLGIMKRLRDPENGCPWDKEQTFATIAPYTLEETYEVLDAISREDFDDLRGELGDLLFQVVFYAQMAQEEGRFNFDDICAAISDKLERRHPHIFGDASAGNSAEVLARWEQIKSAERAEKSQHSALDDIPLNLPALMRAHKIQKRCSAVGFDWTSLGPVLEKVHEEIDEVMHEAQQAVVDEAKLEEEMGDLLFATVNLSRHLGVKAETALQKANIKFERRFREVERIVASRGLEMSGIDLDAMEEVWQEVKRQEHDL

SEQ ID NO: 8120 - protein, 457 aa, Enterobacter cloacae
GAHLITHISPLGSMDMLSQLEVDMLKRTASSDLYQLFRNCSLAVLNSGSLTDNSKELLSRFESFDINVLRRERGVKLEVINPPEDAFVDGRIIRSLQANLFAVLRDILFVNGQISNAGRFQHLDLESSVHITNLVFSILRNARALHVGEAPNMVVCWGGHSINETEYLYARRVGTQLGLRELNICTGCGPGAMEAPMKGAAVGHAQQRYKEGRFIGMTEPSIIAAEPPNPLVNELIIMPDIEKRLEAFVRIAHGIIIFPGGVGTAEELLYLLGILMNPANKDQVLPLILTGPKESADYFRVLDEFIVHTLGEDARRHYRIIIDDAAEVARQMKKAMPLVKENRRDTGDAYSFNWSIRIAPDLQIPFEPSHENMANLKLYPDQPVEVLAADLRRAFSGIVAGNVKEVGIRAIEEFGPYKIHGDPEMMRRMDDMLQGFVAQHRMKLPGSAYIPCYEIIK

SEQ ID NO: 8121 - protein, 456 aa, Enterobacter cloacae
TNFILPSGTFSSDLTKNLTICFLQEIQMETTQTSTVASIESRSGWRKTDTMWMLGLYGTAIGAGVLFLPINAGVGGMIPLIIMALIAFPMTFFAHRGLTRFVLSGKNPGEDITEVVEEHFGVGAGKLITLLYFFAIYPILLVYSVAITNTVESFMMHQLQMTPPPRAILSLILIVGMMTIVRFGEQMIVKAMSVLVFPFVAALMVLALYLIPQWNGAALETLSLSSASTTGNGLLLTLWLAIPVMVFSFNHSPIISSFAVAKREEYGNGAEKKCSSILARAHIMMVLTVMFFVFSCVLSLSPADLAAAKEQNISILSYLANHFNAPLIAWMAPIIAIIAITKSFLGHYLGAREGFNGMVIKSLRGKGKTIEINRLNKITALFMLVTTWAVATLNPSILGMIETLGGPIIAMILFLMPMYAIQKVPAMRKYSGHISNVFVVVMGLIAISAIFYSLFS

SEQ ID NO: 8122 - protein, 257 aa, Enterobacter cloacae
TEGRLSVAVHLLIVDALNLIRRIHAVQGTPCKDTCLHALEQLIRHSEPTHAVAVFDDEARNTGWRHQRLPDYKAGRAPMPDDLHAEMPAIRAAFEQRGVPCWGAHGNEADDLAATLAVKVASAGHQATIVSTDKGYCQLLSPTIRIRDYFQKRWLDAPFIASEFGVSPEQLPDYWGLAGISSSKVPGVAGIGPKSAAQLLTEFQSLEGMYARLNEVPDKWRKKLEAHKEMAFICREVATLQTDLQLDGNLQQLRLER

SEQ ID NO: 8123 - protein, 277 aa, Enterobacter cloacae
GSSMSDHENLLLKLRQEASGYSPTQQKLGEFVLNDPARVLYLTITELARESGTSEASVTRLCRTLGCKGYNEFKMALALDIQQGLPERQAGDAIDNVVDESVQALQDTAKLLDRAQLEQATLALHQAQSVQIYGVAASAILGEYLHYKLLRLGKPAQLFSDMHRAAMNATTLSKETLVVAISSSGSTRDLLHVVKLARKRGVKVLALSNTPRSPLASLSDLQLVAAKPEGPLSAGALNAKVGVMLLVELLTTSLIAVDSHYGDVSQQTASATLPLLL

SEQ ID NO: 8124 - protein, 281 aa, Enterobacter cloacae
NMSYENHQALTGLTLGKSTDYRDTYDASLLQGVPRSLNRDPLGLHADALPFVGGDIWTLYELSWLNARGLPQVAVGHVELDYASVNLVESKSFKLYLNSFNQTKFNSWDEVQQTLERDLSACAQGNVTVSLYRLHELEGQPIAHFHGTCIDDQDIEVESYEFSSDYLENAAGGKVVNETLVSHLLKSNCLITHQPDWGSVQIQYRGPQIDREKLLRYLVSFRHHNEFHEQCVERIFNDIQRFCQPEKLSVYARYTRRGGLDINPWRTNTDFVPATGRLVRQ

SEQ ID NO: 8125 - protein, 432 aa, Enterobacter cloacae
TAITVTLASKRQAPRCRFCYRKQKTRRSGFFRKNEGSGLCLAFDLFTTVVRCFFAQRFFDTNQLVVFSNTVRTAHRTGFDLASSGTNSQVSDGSVFSFARTVRDNRGVASVFRHFDRSQRFGQRTDLVEFDQDGVNDAFLDAFFQDLGVGYEQIVTNQLDFVAQYFGLVCETIPVRLVQTVFDRNDWVLFGQVFQEVGELFRGERFVAFASQNVFTVFVEFRCCAVHRQGDVFAQLVACCFNRFSDNSQCFCVRTQVWRVAAFVTNSRVHTFSFQNFSQVVEHFRTHTYRFFQGFRANWLNHEFLNINVVVCVLTTVDDVHHWYRHRVFAWGAVQFSDVLEQWHAFSCCCRFGVRQGNGQDCVRTEVRFVFSTVQIDHDLVDASLIFSIFANDSLSNRTVNSANRFQYAFAHETGFVAITQFQRFAGTCRST

SEQ ID NO: 8126 - protein, 465 aa, Enterobacter cloacae
QFVELVEVVARQQELLRLFQAYPDMFQLVVQDLTTGKDVLVTILLAEPGVDFRAPTAGGNVTEVRIQPVAAWVWLLLGDDFNLIAHLELVGKRYDTSADLRPDATVPHIAVDVVGEIERRGACRQINHVPFRGKDVDAIVEDLTAHFVEHFAGVGHLFLPRNQLTQPGDTVLVTGATATGGTLFVFPVRRHAQLGVFVHLFGTDLNFHRFAARAEHHGMDRLIAIRFRVRDVVIELIRQMAEMSMHYPQRGIAVLKTLRHDTHRAHVKQLVKGEVFLLHFAPDAVDVLWTPVDLGAHILLFHRLAQPADKFLDIVLAVNAAFVQQFCNAFVFRRMQVAEAVIFQLPLQLPDTQTVRQRRIDIRTLFGGQDALVFRRILYFTQMGNPFGQLDHHAAEIIYHRQQHTTNVIHLLGRDRVSLRGFKLTNGCHITHAVDERHDGLADAFTQDVFRHHVGVRQGEQQCGL

SEQ ID NO: 8127 - protein, 922 aa, Enterobacter cloacae
RNSMTNYSLRARMMILILAPTVLIGLLLSIFFVVHRYNDLQRQLEDAGASIIEPLAVSSEYGMNLQNRESIGQLISVLHRRHSEIVRAISVYDEHNRLFVTSNFHLDPTSLKIPDGTPFPRHLTVLRRGDIMILRTPIISESYSPDESAQSDAKSSNNMLGYVALELDLKSVRLQQYKEIFISGVMMLFCIGIALIFGWRLMRDVTGPIRNMVNTVDRIRRGQLDSRVEGFMLGELDMLKNGINSMAMSLAAYHEEMQHNVDQATSDLRETLEQMEIQNVELDLAKKRAQEAARIKSEFLANMSHELRTPLNGVIGFTRLTLKSELNPTQRDHLHTIERSANNLLTIINDVLDFSKLEAGKLILESIPFPLRSTLDDVVTLLAHSSHDKGLELTLNIKNDVPDNVIGDPLRLQQVITNLVGNAIKFTESGNIDILVEKRALSNNKVQIEVQIRDTGIGIPERDQTRLFQAFRQADASISRRHGGTGLGLVITQKLVKEMGGDISFHSQPNRGSTFWFHINLDLNPNVQTDGPVTGCLKGMRLAYVEPNAAAAQCTLDVLSSTPLEVIYSPTFSALANDHYDILLLGIPVTFTGELTMQQERLAKAASMTDYLLLALPCHAQINAEELKNDGAAACLLKPLTATRLLPALTEYCRLTHQSLPLENDEHKLPMTVMAVDDNPANLKLIGVLLEDQVQHVELCTSGAEAVEQAKQMQFDLILMDIQMPGMDGIRACELIRQLPHQQQTPVIAVTAHAMAGQKEKLLGAGMNDYLAKPIDEEKLHSLLLRYKPGHIGGTYTITAESPEISVNQNATFDWQLALRQAAGKPDLARDMLQMLVDFLPEIRNKVEEQLVGENPEGLLEAIHKLHGSCGYSGVPRLKNLCQLLEQQLRAGTPESDLEPEFLELLDEMDNVTREAMKVLGS

SEQ ID NO: 8128 - protein, 460 aa, Enterobacter cloacae
SNGRIMISVFDIFKIGIGPSSSHTVGPMKAGKQFTDDLIARGILHDITRVVVDVYGSLSLTGKGHHTDIAIIMGLAGNLPDTVDIDAIPGFIQDVNTHGRLLLANGEHEVEFPVDHCMNFHADNLSLHENGMRITALAGDKAVYSQTYYSIGGGFIVDEDHFGQSTNSAVDVPYPYKNAADLQRHCQETGLSLSGLMMKNELALHSKEELEQHFANVWEVMRSGIERGITTEGVLPGKLRVPRRAAALRRMLVSADKTTTDPMAVVDWINMFALAVNEENAAGGRVVTAPTNGACGIVPAVLAYYDKFIREVNANSLARYLLVASAIGSLYKMNASISGAEVGCQGEVGVACSMAAAGLAELLGASPAQVCIAAEIGMEHNLGLTCDPVGGQVQVPCIERNAIASVKAVNAARMALRRTSEPRVCLDKVIETMYETGKDMNAKYRETSRGGLAMKIVTCD

SEQ ID NO: 8129 - protein, 166 aa, Enterobacter cloacae
RAVLRRIARRRGDASVIFDVARHVDLLVGVVPIVNLEWIQKLTRDMSERGHSREAVMDSVVRSMEDYINFLTPQFSRTHINFQRVPTVDTSNPFAAKSILSLDESFVVIHFRNLEGIDYPWLLAMLQGSFISHMNTLVVPGGKMGLAMELIMTPLVQRLMEGKQIA

SEQ ID NO: 8130 - protein, 273 aa, Enterobacter cloacae
  UNSURE (242)
  UNSURE (243)
  UNSURE (246)
  UNSURE (253)
  UNSURE (255)
  UNSURE (263)
  UNSURE (265)
TRCGRPQFQRLDIGFSGPLTFFKEAAGLKIDTTLLLPETGFLLVGEFFHYASLNSPFATSISSKTRFRREGGKTRAGYARVDERLRQHFRGENDDRLSRHILVWTDIVSLNLRDLIRHVHAFHHFAKHRVAKVALTVVQEGVISHVEEELAGGAVFVRRTRHRDGAALVQQAVVSFIFDGRVRLFLLHLLVKTATLNHKARDHAVECGVVIKTTVHVVEEVFHRNRGFLAIQLQLNIPRKSXXQDXRVSFGCXRXRGNGKKSXPXCNNRPLLI

SEQ ID NO: 8131 - protein, 73 aa, Enterobacter cloacae
MMKDTTIEARLAELESRLAFQDITIEELNQTVTAHELEMAKLRDHMRLLTEKLKATQPSNIASQSEETPPPHY

SEQ ID NO: 8132 - protein, 217 aa, Enterobacter cloacae
GVKKAGLSRFFIFRSTESVATAAAVTATTFTVAVVMTMVVAVTTAAAVMAVIVVMVVTVRTVNVAMSQLFFSRFTDRNNFYVELQVLTRQHVVAVNHNVVVFNFSDFNRNRTLVSFRQEAHANLQLVNAHEYVFRNALNQVVVILTVSVVRAYSNVEFVANFMAFQRRFQAGNQGTVTMQVVQRRTHRRLINQHTVFCTYLIGQADHQVFCYFHDIS

SEQ ID NO: 8133 - protein, 73 aa, Enterobacter cloacae
KMIIPWQDLSPDTLDNLIESFVLREGTDYGEHERSLEQKVNDVKRQLKSGDVVLVWSELHETVNIMPRNAFHG

SEQ ID NO: 8134 - protein, 176 aa, Enterobacter cloacae
SLHFSSQGVAMSARHPVIAVTGSSGAGTTTTSLAFRKIFAQLNLRAAEVEGDSFHRYTRPEMDMAIRKARDLGKHISYFGPEANDFGLLEQTFREYGQSGTGQSRKYLHTYDEAVPWNQVPGTFTPWQPLPEPTDVLFYEGLHGGVVTPQSYSTWRATWICWWGWCRLLTLSGSRS

SEQ ID NO: 8135 - protein, 212 aa, Enterobacter cloacae
QRMVLGKPQTDPTLEWFLSHCHIHKYPSKSTLIHQGEKAETLYYIVKGSVAVLIKDEEGKEMILSYLNQGDFIGELGLFEEGQERSAWVRAKTACEVAEISYKKFRQLIQVNPDILMRLSSQMARRLQVTSEKVGNLAFLDVTGRIAQTLLNLAKQPDAMTHPDGMQIKITRQEIGQIVGCSRETVGRILKMLEDQNLISAHGKTIVVYGTR

SEQ ID NO: 8136 - protein, 714 aa, Enterobacter cloacae
FRSNGVPPQGGTPFLSLLLMWRRLIYHPEVNYALRQTLVLCLPVAVGLILGHLQQGLLFSLVPACCNIAGLDTPHKRFFKRLIIGGCLFAGCSLAVQLLLARDIPLPLILTVLAMTLGVTAEISSLHARLLPASLIAAIFTLSLAGNMPVWEPLLIYALGTLWYGLFNWFWFWLWREQPLRESLSLLYVQLAEYCEAKYTLLTQHTDPEKSLPPLLARQQKVVDLISQCYQQLHMLAANKNHEYKRLLRIFQVGLDLQEHISVSLHNPEEVQKLVERSHAEAVIRWNAQTVAARLRVLADDILYHRYPTRFNMDKQLGALEKIARQHADNPVGQFAAWHFSRIARVLRTQRPLYARDLMADKQKRLPLLPALKSYLSLKSSALRNAARISVMLSIASLMGMALHLPKPYWILMTVLFVTQNGYGATRVRILHRAGGTMAGLIIAGVTLHFHVPEGYTLAGMLAITLVSYLIIRKNYGWAMVGFTVTAVYTLQLLTLNGEQFIIARLVDTLIGCLIAFGGMVWLWPQWQSGLLRQNAHDALEADQQAIRLILSDDPQPSPLAYERMKVNQAHNALFNSLNQAMQEPGFNAHYLADMKLWVTHSQFIVEHINAMTTLAREHTMLTPDLAQRYLQSCEIALQRCQQRLEYDAPGESGDSNILEAPETLTHGPMSTLEQHLQRVLGHLNTMHTISSVAWRQRPHHGIWLTRRLKRTAY

SEQ ID NO: 8137 - protein, 645 aa, Enterobacter cloacae
QINIVGTYGASMIVFSSLQIRRGVRVLLDNATATINPGQKVGLVGKNGCGKSTLLALLKNEISADGGNFTFPGNWQLAWVNQETPALSEPALDYVIDGDREYRKLEAELNAANERNDGHAIATVHGKLDAIDAWTIRSRASSLLHGLGFSNEQLERPVSDFSGGWRMRLNLAQALICRSDLLLLDEPTNHLDLDAVIWLEKWLKSYQGTLILISHDRDFLDPVVDKIIHIEQQSMFEYTGNYSSFERQRATRLAQQQAMYESQQQRVAHLQSFVDRFKAKASKAKQAQSRIKMLERMEMIAPAHVDNPFHFSFREPESLPNPLLKMEKVSAGYGDRIILDSIKLNLVPGSRIGLLGRNGAGKSTLIKLLAGELNPVSGEIGLAKGIKLGYFAQHQLEFLRADESPIQHLARLAPQEMEQKLRDYLGGFGFQGDKVTENTARFSGGEKARLVLALIVWQRPNLLLLDEPTNHLDLDMRQALTEALIEFEGALVVVSHDRHLIRSTTDDLYLVHGGKVEPFDGDLEDYQQWLTDVQKQENQPEESAKDNANSAQARKDQKRREAELRTQTQPLRKEIARLEKEMEKLNATLAAVEEKLGDSELYDQSRKAELTDCLQTQAKTKSSLEECEMAWLDAQEQLEAMLQAD

SEQ ID NO: 8138 - protein, 315 aa, Enterobacter cloacae
HAGRVMSFDTTSEITFRKLSIFMTFMEKGNIARTAETLGLSGVSVHRALHTLEENVRCPLFAHKGRNLIALPSAWTLLEYCQEVMQVMERGLEESRKIAGIGQGRLRVGTLYSLTLETVPRLIMGMKLRRPDLEMDLTMGSNETLLHMLDEGSLDAILISISESDIDRNSLEVLPLFHDDIFLAAPASATLNTSGPADLRDYKDQKFVALAEGFATYAGFQEAFHIAGFEPEIVTRVNDIFSMLSLVQAGVGFTLMPGRMKKVYENSVQLLKLAQPYQMQQLIAIVFARNREQDPSLRALAAEGRMYARSLQDSA

SEQ ID NO: 8139 - protein, 349 aa, Enterobacter cloacae
FLTRISIALMTQIIPSDFDIAAEESAEFVPMRGVANPHLQTMLPRLIRRKVQFTPHWQRLDLPDGDFLDLAWSEDPDRARHKPRLVVFHGLEGSLHSPYAHGLIEAAKARGWLGVVMHFRGCSGEPNRQKRIYHSGETEDGTWFLRWLRDNFGEAPTAAVGYSLGGNMLACLLAKESDAVPLDAAVIVSAPFMLEQCSYHMEKGFSRVYQRYLLNLLKANAARKLKAYPDTLPVTLQQLKRVKRLREFDDLITSKIHGFADAIDYYRQCSAMPLLNQITKPTLIIHAKDDPFMDHHSIPAPDHLPANVEYQLTQFGGHVGFVGGTLRRPKMWLETRIPDWLTAYLDGKK

SEQ ID NO: 8140 - protein, 105 aa, Enterobacter cloacae
LKALSCAKAPIMVNMNVRLNKRSTMLSASLKAATWCWYGPNCMRRSISCPATRFMADLYTFPVRELLCLPDIRLLPLRVRVGREPLPPASPSARSSPSLTYGRPR

SEQ ID NO: 8141 - protein, 190 aa, Enterobacter cloacae
CSNQQWPVVAEGYALFAVSPDAMAAKGDPQVLMNTFAGNIELELDSQKAPVSVKNFLDYVNSGFYNNTTFHRVIPGFMIQGGGFNEQMQQKQPNPPIKNEADNGLLNKRGTISMARTADKDSATSQFFLNVADNAFLDHGQRDFGYAVFGKVVKGMDVADKISQVQTHDVGPYQNVPTKPVVILSAKVLP

SEQ ID NO: 8142 - protein, 229 aa, Enterobacter cloacae
SFVHTGISCPCLSALPAKARFAAYTCGKRTIQGGVVKKLTDKQKSRLWEQQRSVNFQASCLLEKGKGPAEPDIETLELGPSAPGLPHLCLIHRHLFRNEMKGAGELRTAEISKGDIPFCHFEYIEKVGNELMASLESDKYLVGLQKEEFTDRISHYYCEINMLHPFMSGNGVAQRIFFEQLAIHAGYVLNWQGIDPDDWAAANQSGAMGDLTALNVIFAKVVSEARESA

SEQ ID NO: 8143 - protein, 197 aa, Enterobacter cloacae
NRAAIFSGAAMILLIDNYDSFTWNLYQYFCELGAEVVVRRNDEIALDDIDALAPQKIVISPGPCTPSESGISLAVIQHYAGKLPILGVCLGHQAIAQVFGATIVRAAKVMHGKTSPITHTGTGAFLGLNNPLTVTRYHSLIIDPPTLPACFEVTAWSETQEIMGIRHREYDLEGVQFHPESILSEQGHALLANFLNR

SEQ ID NO: 8144 - protein, 421 aa, Enterobacter cloacae
LYFHNNCDIKMDGHDMATEQPAITRATFDEVILPIYAPAEFIPVKGRGSRVWDQQGNEYVDFAGGIAVTALGHCHPALVDALKTQGETLWHTSNVFTNEPALRLGRKIIDATFAERVLFMNSGTEANETAFKLARYYATTRHSPYKTKIIAFHNAFHGRSFFTVSVGGQPKYSDGFGPKPADIIHVPFNDLHAVKAVMDDHTCAVVVEPIQGEGGVTAATPEFLQGLRELCDEHQALLVFDEVQCGMGRTGDLFAYMHYGVTPDILTSAKALGGGFPVSAVLTTQDIASAFHVGSHGSTYGGNPLACAVAGAAFDIINTPDVLNGVNAKRDLFVKHLQQIDEQFDVFSEIRGMGLLIGAELKPQYKGRARDFLHAAAHEGVMVLNAGPDVMRFAPSLVVEDKDIEDGLTRFAAAVAKIVSG

SEQ ID NO: 8145 - protein, 136 aa, Enterobacter cloacae
VNMQARVKWVEGLTFLGESASGHQVLMDGNSGDKAPSPMEMVLMAAGGCSAIDVVSILQKGRHGVTDCEVKLTSERREEAPRLFTHINLHFIVTGKELKDAAVSRAVDLSAEKYCSVALMLEKAVNITHSYEVIEA

SEQ ID NO: 8146 - protein, 294 aa, Enterobacter cloacae
PTCEIPELVMKLLPQIQVEGGAEWLARTATQCLIDEARLSPKPGLVDSRGNGAHHDLSLALMERSARSLTPTFQALAQQSWQRPADIALRQTVGRLGREGERQMMAATDGVNTHRGAIWALGLLVSAVAMLGGDARAQTVANTAAQLAKLPDDVAPKVFSKGLRVTHRYRVPGAREEAQQAFPHIMQRALPQLRLSRLNGSSETQARLDALMAIMTSLTDTCVLSRAGMEGLDAMQNGARAVLNAGGCATLAGQQALARLDRQMLALNASPGGAADLLAATLFLDRVETPYSKH

SEQ ID NO: 8147 - protein, 102 aa, Enterobacter cloacae
EDVMEKITLTVPASREVSGRALAGVVGSGDMEVLFTAEPGQTLTIDITTSVDNSRGRWEALFNRLQTVSSLPAGKLTIHDFGATPGVARIRIEQVFEGVNHA

SEQ ID NO: 8148 - protein, 275 aa, Enterobacter cloacae
SAFCPGGEMMTNSISRGELWLETLAPNAKRLEGLCPSVQAADGELNGETVRFVAVVPDVNNHFPRAAQGEVGLLEGWTLAKVVSETVAADADKAVKRPIVAVIDVPSQAYGRREEAFGIHQALAGAAAAYANARLAGHPVIGLIVGKAMSGAFLAHGYQANRLIAFNDKGVLIHAMGKESAARITLRTVEALEKLAATIPPMAYDISNYATLGLLSDLLDISNPDAPSESDLTRVKTTLQQAISDARQDTTLKNRLGADNRRSSALVRERMRASW

SEQ ID NO: 8149 - protein, 320 aa, Enterobacter cloacae
FMTYVIVHALAPIFVIMLLGFWAGKAKMVDNKNVSLLNIFVMDFALPAALFSATVQTPWTGIVAQSPLILVLTLAMWITYAVIYFLATNVFKKSPQDAAVLTLTVALPNYAALGLPILGSVLGEGSSTSLSVAVSIACGSVLMTPFCLLILEREKARAEGNNSGSTLSMLPVLMWRSIKKPIVMGPLLGVILSAIGITMPELVLAAIKPLGLSATAAALFLTGVILSARKLQINTMVITSTIAKLLIQPAIAWGIVLIFGLHGSVAITAILMIALSAGFFGVVFGNRFGVQSPDAEAVLLLSSILCILSLPLFISLTSGM

SEQ ID NO: 8150 - protein, 649 aa, Enterobacter cloacae
ADGGDVPYALDEPDYYLLGTAAGSESAGEPCQGLWRMAGVTDSGGRTLMDGSNLLLAGVLFLFAAVVAVPLAARLGIGAVLGYLLAGIAIGPWGLGFISDVDEILHFSELGVVFLMFIIGLELNPSKLWQLRQSIFGVGAAQVLLSAAILAGLLMLTQFSWQAAVIGGIGLAMSSTAMALQLMRDKGMNRNEAGQLGFSVLLFQDLAVIPALALVPLLAGSGDDHFDWMKISMKVLAFAGMLIGGRFLLRPVFRFIAASGVREVFTAATLLLVLGSALFMDALGLSMALGTFIAGVLLAESEYRHELETAIDPFKGLLLGLFFISVGMALNLGVLYTHLLWVIASVAVLVAVKTLVLYLLARIYGLRSSERMQFSSVLSQGGEFAFVLFSTASSQKLFKDDQMALLLVTVTLSMMTTPLLMKLVDKLLSRRLNPADDEDEAPWVEDDKPQVIVVGFGRFGQVIGRLLMANKMRITVLERDISAVNLMRKYGYKVYYGDATQLELLRSAGAEAAESIVITCNDPEDTMKLVELCQQHFPHLHILARARGRVEAHELLQAGVKHFSRETFSSALELGRKALVSLGMHPHQAQRAQMHFRRLDMRMLRELMPVHSDTAQISRVREARRELEEIFQREMQQERRQLDGWDEFE

SEQ ID NO: 8151 - protein, 556 aa, Enterobacter cloacae
IRRLIMLSGQTPTRQWNTRRSEKARRLASVPVQGKVLPTGDLVAMLEKLIAPGDKVVLEGNNQKQADFLSRSLAEVNPQIVHDLHMIMPSVGRSEHLDIFEKGIARKLDFSFSGTQSLRISQLLEDGQLEIGAIHTYIELYSRLYVDLSPNVALIAGFKADRKGNLYTGASTEDTPALVEAAAFHDGIVIAQVNELVDDECDLPRVDIPGSWIDFVVVADKPFFIEPLFTRDPRLIKQEHILMAMMAIKGIYAEHQVQSLNHGIGFNTAAIELLLPTYGEQLGLKGKICKHWTLNPHPTLIPAIESGWVESVHCFGGELGMEEYIRARPDVFFTGADGSMRSNRAFCQLAGQYAVDMFIGSTLQVDGYANSSTVTRGRLSGFGGAPNMGHDPHGRRHATPAWLNMITEPDPMQRGKKLVVQMVETFQAGVKPTFVEKLDAVDVAKASGMPLAPVMIYGDDVTHVLTEEGIAYLYRAKDLEERRAMVAAVAGITDIGLGVDAKRVAELRQSGKVVYPEDMGIRRTDATRSLLAAGSVADLVEWSGGLYNPPAKFRSW

SEQ ID NO: 8152 - protein, 278 aa, Enterobacter cloacae
IMRDDSSFIELKARQRAQALLDDGSYRELLDPFEGIISPWLGPQGIVPQADDGMVVAKGTINGQPAVVVAIEGTFQGGSMGEVSGAKMAAALELAAEDNRNGIPTQAVLCLETGGVRLQEANLGLAAIADIHAAIVDLRRYTPVVGIVAGTVGCFGGMSIAAALCSYLIVTREARLGLNGPQVIEQEAGIEEYDSRDRPFIWSMTGGEVRYESGLVDALVGDGVNAVKAAMNEAIAKGVPAKHRTDNYDDYLNRLTNFDTRKQADAEQIKALFAREVK

SEQ ID NO: 8153 - protein, 352 aa, Enterobacter cloacae
LAGSAQSCVVPGGYTGGYARGRIRAGGMVTRRQNAAKNAIWAAPGSGSMAQGGVMKILFTFPGQGTQHEGMLQNLPGTELEQARAVLGAEVDTLDSASSLTHTRAVQLSLLIAGVAWARELERRGVSPDIVSGLSIGAYPAAVIAGALDFTDALKLVALRGDLMEQAYPHGYGLTAIMGLTLPQVENLIQGTGTYIANLNAETQIVIAGADDGMAQVAERALAKGANKAKRLAVSVPSHCELLAEPAQKLAAAFESVTLSRPRCAYLSGSTGRVLWQPEKIADDLAMNMARTVRWQEAVISANEREARLAIEMPPGGILTCLTRQAAWEGESISLERSGVDVAVHLAGRLQR

SEQ ID NO: 8154 - protein, 263 aa, Enterobacter cloacae
RLGLEAIHKALQVRHALLLAFIHRLLLGKARRALALERAVVAGVFEHALLFDMNDFIHHRIEEVAVVGDQNQSALIALEPLLQPNNRIEIEVVGGFIEQQEVGAADQRLRQVKAHTPAAGEIAHRAFKLFVAETQAVQQAGGAGANGPGIDGVQLAVDGGDGVAVVAFVGGVELCFELAVFTVAVDNIVERGFAQRGRLLVHPGELPVAREGKVTAIRAYLVFQQCQQGGFTAAVFADQPHFLARVDGSSRVIQQDAHAATNL

SEQ ID NO: 8155 - protein, 198 aa, Enterobacter cloacae
PKTTTIHKNRTGRGMMSQTAKVLLLYAHPESQDSVANRVLLKPATQLSNVTVHDLYAHYPDFFIDIPYEQELLRQHDVIVFQHPLYTYSCPALLKEWLDRVLSRGFSSGVGGNQLAGKYWRSVITTGEPESAYRHDGLNRYPMSDILRPFELTAAMCRMHWMSPIIIYWARRQDPKALASHARAYGEWLASPIPAGGR

SEQ ID NO: 8156 - protein, 187 aa, Enterobacter cloacae
PELTGPVNHDGFTVGGDQVLIFQHLQDTAHCFTGAADDLTDFLAGNFNLHTVRVSHGVWLFRQVQQRLRDTTGYVQEGEVTYLLRGHLQTACHLGRETHQDVRVDLNQLTEFLIRNFSHFTCCFCTNPGATFLAFFKQAQFTDKIALVQIRKDHLFPFFIFDQHGHRAFNDVIQRFRFFTLVNQRAL

SEQ ID NO: 8157 - protein, 65 aa, Enterobacter cloacae
WVLMNVAMRQEPFESRVCLRFAKHHALLSSVISCHQSHKMHPDSGVAIEFLPIPGKSAVVTFRSQ

SEQ ID NO: 8158 - protein, 231 aa, Enterobacter cloacae
SRAAVELHTVYPVAAAVYLADFRNVIMTTTLRPHDLIWLTARDALEGITESWVDAAWHTGLPVVVRRDVDNEGRIPVGVRGLRRDQRAAGWVKPENVLRVVSPEDLSVAADLLRSPFITQPPVQVALQLAQQSWPWTWGITGSTGYALATGIPVIHADSDLDLLIRAPCTVSPEAFTDWQAQLSRALCRADTQVDTPEGGFALAEWLRDGKTLLKTQYGPRLVADPWHREE

SEQ ID NO: 8159 - protein, 223 aa, Enterobacter cloacae
VFLSLRVHGCRFPLQSAPAIFPRSGDIMKVAKDLVVSLAYQVRTEDGVLVDESPVSAPLDYLHGHGSLISGLETALEGHEVGDKFDVAVGANDAYGQYDDNLVQRVPKDVFMGVDELQVGMRFLAETDQGPVPVEITEVEDDHVVVDGNHMLAGQNLKFNVEVVAIREATEEELAHGHVHGAHGHDHDHDHGHDGCCGGHGHDHGHDHGHGKGGCGNGGCGCH

SEQ ID NO: 8160 - protein, 140 aa, Enterobacter cloacae
RVEGGCRYATTDAGRRLMSNAPQLYALYQQLLEQSQLMLRLARQGLWDDLIICETDYVNAVHSLARLTQESEPSTQIQEQLRPTLRVILDNEGQVKTLLQARMDELAKLVGQSSIQKTVLSTYGNQGGHVLVPQSNSDIN

SEQ ID NO: 8161 - protein, 570 aa, Enterobacter cloacae
RKPPGFKRCAMSATAASTAPQNKSLEWMNRLRANPKIPLIVAGAAAIAIVVAMVLWAKSPDYRTLYSNLSDQDGGAIVTQLTQMNIPYRFADNGGALEVPADKVHELRLRLAQQGLPKGGAVGFELLDQEKFGISQFSEQVNYQRALEGELARTIETLGPVKSARVHLAMPKPSLFVREQKSPSASVTVNLEPGRALDEGQISAVTHLVSSAVAGLPPGNVTLVDQSGHLLTQSNTAGRDLNDAQLKYAADVEGRLQRRIEAILGPVVGSSNVHAQVTAQIDFSNKEQTEEQYAPNGDASRAVLRSRQINETEQVGGQYPGGVPGALSNQPAPANAAPISTPPANPQNGQQTNQQTTSTANSTGPRNSSRNETTNYEVDRTIRHTKLNTGDIQRLSVAVVVNYKTLPDGKPLPLTAEQMKQIEDLTREAMGFSEKRGDTLNVVNSPFNPVDETGGELPFWQQQAFFDQLMSAGRWLLVLIVAWLLWRKGVRPQLQRRAEAEKAALEQKNARPDEEEAVEVRLSKDEQMQQRRANQRMGAEVMSQRIREMSDNDPRVVALVIRGWMGNEHE

SEQ ID NO: 8162 - protein, 404 aa, Enterobacter cloacae
MITLQQLLMTDSDPSGGTLAGKGAEGAQDFLSLLAGALTETTGKGKDAPLTLADLKAAGSKLSTAAQEKNGDTTLQAKIAELLSRQETLTGEDTAVSLQSLVSGLKPAANTDALKALTQPEAKTNSETTTEEEELAGLSALMAMLPHQQTTTPVATQPASTGEIAPRAALPSALAQTDNGQHQPLSHALTGQEKMPVQDSDTSLPATAAVTPAVAAVAEKQDVASAASPAASPTATLAPIVSHLAPSQPAATVATAPVLSQPLGTHEWQQNLSQHITLFTRQGQQTAELRLHPEDLGQVQISLKLDDNQAQLQMVSPHSHVRAALEAALPILRTQLAENGIQLSQSSVSSEGFAGQQQSSSGQQQHASRSGQHGGFNDESEELLPAPAALQSAARGSRAVDIFA

SEQ ID NO: 8163 - protein, 146 aa, Enterobacter cloacae
IRRTYHRHHYPFRTYASSEPLSMKTQATLSAPSAVPGSPLLQVSGALFGIIAFILIAAWLAKRFGLAGKTAGTRGLKVSASTPLGPRERVVIVEVEDARLVLGVTASSINVLHTLPPAPATVEANAQAPADFQSVMKSLLKRPGRS

SEQ ID NO: 8164 - protein, 128 aa, Enterobacter cloacae
WFRPRPLPCPLRSCCSCWSTAGSCWSARWRRVSTVEERAMTPESVMMMGTEAMKVAIAVAAPLLLVALVTGLIISILQAATQINEMTLSFIPKIIAVFVAIIVAGPWMLNLLLDYMRNLFTNLPYIIG

SEQ ID NO: 8165 - protein, 263 aa, Enterobacter cloacae
RTMLHFTSDQFVQWLGIYFWPMLRIMALISTAPILSEKSVPKRVKIGLGMVITIIVAPSLPAVDIPIFSPNAIWIALQQVMIGVAVGFTMQLAFAAVRTAGELIGLQMGLSFATFVDPGSHLNMPVLARIIDLLAMLLFLSFNGHLWLISMLVDTFHTLPIGDNPVNSNAFLALVRAAGLIFLNGLMLALPIITLLLTVNLALGLLNRMAPQLSVFVIGFPVTLTVGLLLMSLLMPLIAPFCEHLFSEIFNLLADIVSELPRK

SEQ ID NO: 8166 - protein, 210 aa, Enterobacter cloacae
GYAMSTIIMDLCRYTRLGLTGYLASRGVRKRDINDAHTVEELAAACDAHKPGVVFINEDCFIHDPANSQHIKQIINQHPKTLFIVFMAIANIHFDEYLLVRKNLLISSKSIKPESLDDILGDYLNKEVKNVGAINLPTLSLSRTESSMLRMWMAGQGTIQISDQMNIKAKTVSSHKGNIKRKIKTHNKQVIYHVVRLTDNVTNGIFVNMR

SEQ ID NO: 8167 - protein, 308 aa, Enterobacter cloacae
ILVMSINLRRVWVCRDRFHLNGASMPIFFKIFLRKNHHPGDIMPSLEETLLVFTDLDGTLLDFHTLDWQPAAPWLEKLMDEQIPVILCSSKTASEMDDIQQELGLGGLPYIAENGAVIQPDVRWENAARFISEKKHDEIRQCIARVRQEMHLKFTTFDDVDEHVVAEWTGLSRPRSVLARKHEASVTLIWRDSDEQMKYFAAELARQRLKIVQGARFWHILDTCCGKDVAVHWLVDQYRLHEGYEPTTLGLGDGPNDAPLLDSVGFAVVVKGFNREGISLINNDPARVYHTQHTGPTGWCEGLDYFLR

SEQ ID NO: 8168 - protein, 473 aa, Enterobacter cloacae
GINMASISTLGVGSGLQLGDILDSLTAAQKAQLTPISKQQTSYTAKLSAYGTLKSALESFQTANTALSKADLFTATTTASSSTAFSATTSGSAIAGKYTINVSQLAQAQTLTTAKTQSDNKTAIATADSTITIQQGGDKKPVTINISAENSSLSGIRDAINKADAGVSASIINVGNGEYRLSITSKDTGKDNAMTISVSGDTALQSFMGYNGNSADTANGMMESVTAQNALLKVNNVDIENSSNTISDALEDITLNLNDVTTGNQTLTITTDNTKATKAINDWVTAYNSLQDTFSSLTKYTAVDAGSDAQNTSNGALLGDSTLRTIQTQLRSVLNNPHTSSNIKTLAQAGITTDPSTGKLEVDDDKLSAAMKNSAAGIKDLLIGDGKTSGITTTVGTNLTGWLSSTGIIQAAKDGVSKTLNNLTKQYNAASERIDTMVARYKEQFTQLDVMMNSLNSTSSYLTQQFENTSSNK

SEQ ID NO: 8169 - protein, 145 aa, Enterobacter cloacae
TLIRPEGDNMYGAKGTQAYAKIEVESAVMSASQQQLVIMLFDGALSALVRARLFLADGNIPAKGLALSKAINIIENGLKVGLVENNGDELTQNLIALYAYMVRRLLHANVNNDASAIEEVENLLRNIADGWKEVAGTPQLMQDAV

SEQ ID NO: 8170 - protein, 358 aa, Enterobacter cloacae
ASAFAKCQITIRASSRWSSAVGWVTNMSNTLTGTDKSVILLMTIGEDRAAEVFKHLSQREVQILSAAMANVRQISNKQLTEVLAEFEQEAEQFAALNVNANEYLRSVLVKALGEERAASLLEDILETRDTASGIETLNFMEPQSAADLIRDEHPQIIATILVHLKRGQAADILALFDERLRHDVMLRIATFGGVQPAALAELTEVLNNLLDGQNLKRSKMGGVRTAAEIINLMKTQQEEAVITAVREFDGELAQKIIDEMFLFENLVEVDDRSIQRLLQEVDSESLLIALKGAEQPLREKFLRNMSQRAADILRDDLANRGPVRLSQVENEQKAILLIVRRLAETGEMVIGSGDDTYV

SEQ ID NO: 8171 - protein, 480 aa, Enterobacter cloacae
GRSGCQRRDPLAGTVPPGGTGSRLMTARLTRWLNTLDNFETKMAQLPSVRRYGRLTRATGLVLEATGLQLPLGATCVIERQDGGETREVESEVVGFNGQRLFLMPLEEVEGILPGARVYAKNISGDGLQSGKQLPLGPALLGRVLDGSGKPLDGLPSPDTTETGALITQPFNPLQRTPIEHVLDTGVRPINALLTVGRGQRMGLFAGSGVGKSVLLGMMARYTQADVIVVGLIGERGREVKDFIENILGTEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALITEQHYARVRNFKQLLSSFQRNRDLVSVGAYAKGSDPMLDKAIALWPQLEAFLQQGIFERADWEDSLQALELIFPQV

SEQ ID NO: 8172 - protein, 154 aa, Enterobacter cloacae
HRWRAKVMAQNSALSTLKDLAEKEVDDAALQLGAMRRGCQQAEEQLKMLIDYQHEYRTNLNTDMTQGIGSQRWINYQQFIQTLEKAIEQHRQQLNQWTQKVDTALNFWREKKQRLQAWQTLQDRQIAASTLAENRLDQKKMDEFAQRASMRKPE

SEQ ID NO: 8173 - protein, 175 aa, Enterobacter cloacae
AGHGIITVLSCTETGSSYQMTDSAITKKSKRSIWIPLLVLITLAACATAGYSYWRMQQEPSSAAAKAEAPPPPAPVFYPLDTFTVNLGDADRVLYVGITLRLKDEATRARLNDYLPEVRSRLLLLFSRQDASALATDVGKQKLVDAIKQTLATPLVNGQPKQEVTDVLYTAFILR

SEQ ID NO: 8174 - protein, 141 aa, Enterobacter cloacae
GTAQMSDMNNPSDENSGALDDLWADALNEQKTTPTKSAADAVFQQLGGGDVSGTLQDIDLIMDIPVKLTVELGRTRMTIKELLRLTQGSVVALDGLAGEPLDILINGYLIAQGEVVVVADKYGVRITDIITPSERMRRLSR

SEQ ID NO: 8175 - protein, 519 aa, Enterobacter cloacae
PFRSPGISAKPAPYLSFATSWRWCMRNPTLLQCFHWYYPTGGELWREVTALAPNLNEIGINMVWLPPAYKGASGGYSVGYDSYDLFDLGEFDQKGSVATKYGDKAQLLEAINALKSNQIAVLLDVVVNHKMGADEKEPVRVQRVDAQDRTQISDEIIECEAWTRYTFPVRAGQYSQFIWDYKCFSGIDHIENPNEDGIFKIVNDYTGEGWNDQVDDEMGNFDYLMGENIDFRNHAVTEEIKYWARWVMEQTHCDGFRLDAVKHIPAWFYKEWIEHVQEVAPQPLFIVAEYWSHEVDKLQHYINQVDGKTMLFDAPLQMKFHEASRQGRDYDMSQIFTGTLVEADPFHAVTLVANHDTQPLQALEAPVEAWFKPLAYALILLRENGVPSVFYPDLFGASYDDTGGDGETYHIDMPVIEQLHELILARQRFAHGVQTLFFDHPNCIAFSRSGTEEHPGCVVVLSNGDDGEKTICLGENYGNKTWRDFLGNREETVTTAADGEGTFFCNGGSVSVWVIEDAL

SEQ ID NO: 8176 - protein, 242 aa, Enterobacter cloacae
LAAETTPMSDELSWKRWTPDDLSPPSAEFTPAVVSSDEGDAGAGEPELSEEEQRAQLLAQMQMQAHEQGFNAGMNEGRQTGHAQGYQEGLAKGLEQGIEQARQQQAPLHARMQQLVSEFQHTLDALDSVIASRLMQMALEAARQVIGQTPIVDNAALIKQIQGLLQQEPLFSGKPQLRVHPDDLQRVEESLGATLSLHGWRLRGDPSLHHGGCKVSADEGDLDASVATRWQELCRLAAPGVV

SEQ ID NO: 8177 - protein, 355 aa, Enterobacter cloacae
TANLSRKSLTFCIQPSFCGNDMGDSILSQAEIDALLNGDSDKSDEPKPGLTGDDNIRPYDPNTQRRVVRERLQALEIINERFARQFRMGLFNLLRRSPDITVGAIRIQPYHEFARNLPVPTNLNLIHLKPLRGTGLVVFSPSLVFIAVDNLFGGDGRFPTKVEGREFTHTEQRVINRMLKLALESYSDAWKAINPLEVEYVRSEMQVKFTNITTSPNDIVVNTPFHVEIGNLTGEFNICLPFSMIEPLRELLVNPPLENSRHEDQNWRENLVRQVQHSQLELVANFADISMRLSQILKLQPGDVLPIDKPDRIIAHVDGVPVLTSQYGTINGQYALRVEHLINPILNSLNEEQPK

SEQ ID NO: 8178 - protein, 267 aa, Enterobacter cloacae
RPGPCGFPVRYEEFAQASREILMRRLLFLTLAGLGLFAPSVYAQLPGLVSTPLANGGQSWSLSVQTLVFITSLTFIPAILLMMTSFTRIIIVFGLLRNALGTPSAPPNQVLLGLALFLTFFIMSPVIDKIYTEAYQPFSEDKISMQVALEKGAQPLREFMLRQTREADLALFARLANTGELQGPEAVPMRILLPAYVTSELKTAFQIGFTIFIPFLIIDLVIASVLMALGMMMVPPATIALPFKIMLFVLVDGWQLLVSSLAQSFYS

SEQ ID NO: 8179 - protein, 85 aa, Enterobacter cloacae
LLRRLNEEPAMKTDKEYSDTIKREVEVDVDALLAAINEISESEVHRAEDNSDRVVVNGRDYHTYRELAEAFELDIHDFSVSETNR

SEQ ID NO: 8180 - protein, 115 aa, Enterobacter cloacae
WCRCTLCQSSWRAPHLTVSTAKYRPHTKTPFAPGGDARQCNLFYTGSKPQEECMKVNDRVTVKTDGGPRRPGVVLAIEEFNEGTMYLVSLEDYPLGIWFFNELGHPDGIFVETAE

SEQ ID NO: 8181 - protein, 102 aa, Enterobacter cloacae
RAIMPSRTDLPTPEPANSPIRWPRPTVSRALIGRTPVSSTCSIGVRCSGLKGWVISAPVSVVSGEGRPSSGLPLPSRTRPSSAGPSGSCLPLCRPSPLMFFA

SEQ ID NO: 8182 - protein, 111 aa, Enterobacter cloacae
KTIQGRVMAIQGIEGVLSQLQATAMTARNQSVADQPPGVSFAGQLHAALDRISDKQNAARTQAERFTLGEPGVALNDVMADLQKASVSLQMGLQVRNKLVSAYQEVMGMQV

SEQ ID NO: 8183 - protein, 162 aa, Enterobacter cloacae
SIPILRWQPDGFNATIFFSSHAGKMMKKVAIVAAMLTLAGCVQVENYQEVVKHPAPSQLAGYWQSKGPQSAMVSPEAIATLVVTPEGDTLDCRQWQRVIAVPGKIMLRSDDYYNVTRKLDVYPLERDGAALEYDGMELYKVDRPTVECADYLSKNPLESKLP

SEQ ID NO: 8184 - protein, 269 aa, Enterobacter cloacae
PLISPTIHPIKTPPESDNHADNSTNAGLFIVNSLYTAEGVMDKHSLWQRYVPLVRHEALRLQVRLPASVELDDLLQAGGIGLLNAVDRYDALQGTAFTTYAVQRIRGAMLDELRSRDWVPRSVRRNAREVAHAMGQLEQELGRNATETEVAERLGIPVEEYRQMLLDTNNSQLFSYDEWREEHGDSIELVTDEHQQENPLHHLLEGNLRQRVMEAIEALPEREQLVLTLYYQEELNLKEIGAVLEVGESRVSQLHSQAIKRLRTKLGKL

SEQ ID NO: 8185 - protein, 188 aa, Enterobacter cloacae
QPGVIMTVQQSKRRPLSRYLKDFKHSQTHCAHCKKLLDRITLVRRGEIVNKIAISRLDTLMDEAAWLEEQKEWVALCRFCGDLHCKEQSDFFDIIGFKQFLFEQTEMSHGTVREYVVRLRRLGQHLTMQNISRDLLTTGYLDENLEPWLPATSTNNYRIALRKYAQYKVQMPGVIKQKVRAGTTSDIY

SEQ ID NO: 8186 - protein, 352 aa, Enterobacter cloacae
KRLFYFSRVCVHNEITIVCVTGGTMSLQNLTRFPRLEFIGAPTPLEFLPRFSDYLGRDIFIKRDDVTPMAMGGNKLRKLEFLAADALREGADTLITAGAIQSNHVRQTAAVAAKLGLHCVALLENPIGTQAENYLTNGNRLLLDLFNVQVEMVDALTDPAAQLDELATRLEAQGFRPYVIPVGGSNALGALGYVESALEIAQQCEGAVSLSSVVVASGSAGTHAGLAVGLEQLMPEVELIGVTVSRSVADQKPKVVTLQQAVAEQLALQAKAEILLWDDYFAPGYGTPNDEGMEAVKLLARLEGILLDPVYTGKAMAGLIDGIARKRFKDEGPILFVHTGGAPALFAYHPHV

SEQ ID NO: 8187 - protein, 229 aa, Enterobacter cloacae
KSGRKIIMQESIQLVIDSLPFLLKGAVFTLQLSIGGMFFGLVLGFVLALMRMSNIWPVRWLARFYISVFRGTPLIAQLFMIYYGLPQFGIELDPIPAAMIGLSLNTAAYTSETLRAAISSIDKGQWEAAASIGMTPWQTLRRAILPQAARVALPPLSNSFISLVKDTSLAATIQVPELFRQAQLITSRTLEVFTMYLAASLIYWVMATVLSALQNYFENQLNRQERDPK

SEQ ID NO: 8188 - protein, 169 aa, Enterobacter cloacae
ITLSADPASCVVKTLFDQAKILAKQCEQQSLPFSVIQIDLDCFKSINDRFGHQAGDKVLSHAAGLIASTLRDKDIAGRVGGEEFCVVLPGMTLEEAAEVAEQIRERIDSKEILIKKSTTLRVSASFGVSGAQEKGNYHFENLQSTADARLYEAKQRGRNRVIWQDHLKK

SEQ ID NO: 8189 - protein, 575 aa, Enterobacter cloacae
TTGNEIMAQVINTNSLSLITQNNINKNQSSMSTAIERLSSGLRINSAKDDAAGQAIANRFTSNIKGLTQAARNANDGISVAQTTEGALSEINNNLQRIRELTVQSSTGTNSQSDLDSIQDEIKSRLDEIDRVSGQTQFNGVNVLAKDGSMKIQVGANDGQTITIDLKKIDSDTLGLNGFNVNGKGTIANKAATVSDLTSAGAKLNATTGNYDLTTTNKDLTTDVAFSKLKTGDTVTTNGATYTYDAKAGNFTTTKSTAGADEAAKTANRDALSATLKADPGQTVSGTYTTKDGTVNFDTDSAGNITIGGKAAYVDASGNLTTNNAGGAADATMKALLKTASENTDGATLNFKGTEYTVAPGVDATDTGVVSYKATVSSDVVLAETKANATNISMNSGVLTKNLAFDATGASTDNTFVDDAGNITSVEDYTVSYAVNKDNGNVTVAAYSSATDTNKTYSPTIGAAVNVTSTGKITTEATSVGTATTDPLASLDDAISSIDKFRSSLGAVQNRLSSAVTNLNNTTTNLSEAQSRIQDADYATEVSNMSKAQIIQQAGNSVLAKANQVPQQVLSLLQG

SEQ ID NO: 8190 - protein, 284 aa, Enterobacter cloacae
RCRRFLYTTQKFHCIGVLMKLALLGRQALMGMMAVALVAGMSVKTFAAENLLNKVKERGTLLVGLEGTYPPFSFQGDDGKLTGFEVEFAQELAKHLGVKASLKPTKWDGMLASLDSKRIDVVINQVTISDERKKKYDFSTPYTVSGIQALVKKGNEGSIKSAADLKGKKVGVGLGTNYEEWLRQNVQGVDIRTYDDDPTKYQDLRVGRIDAILVDRLAALDLVKKTNNSLAVAGDAFSRQESGVAVRKGNEDLLKAIDGAIAEMQKDGSLKALSEKWFGADVTK

SEQ ID NO: 8191 - protein, 252 aa, Enterobacter cloacae
SKMSAIDVKNLVKKFHGQTVLHGIDLEVEQGEVVAIIGPSGSGKTTLLRSINLLEQPEGGTIRVGDITIDTGKPISQQKGLIRRLRQHVGFVFQSFNLFPHRTVLENIIEGPVIVKGEPKEDATVRARELLAKVGLAGKETSYPRRLSGGQQQRVAIARALAMRPDVILFDEPTSALDPELVGEVLNTIRQLAQEKRTMVIVTHEMSFARDVADRAIFMDQGRIVEQGPAKALFANPQQPRTRQFLEKFLMQ

SEQ ID NO: 8192 - protein, 147 aa, Enterobacter cloacae
RNTLSRCGKLTIGPKLVLSSNRSPARMRPTRSTIFCSNAALNFAGTNTRVPLVHTWPELKKLAIMAISAARSRSASSNTISGDLPPSSIVTSFRDEAAELAITFLPLATPPVKETLAMPGCSVRYWPVSAPTPGRTLNTPSGRPASV

SEQ ID NO: 8193 - protein, 310 aa, Enterobacter cloacae
SPQETSAMHPRQGLKRLLLGALLMTATTTGALAAEKFQVITTFTVIADMAKNVAGDAAEVTSITKPGAEIHEYQPTPGDIKRAQKAQLILANGMNLELWFQRFYQHLNGVPEVIVTKGITPMGISEGPYNGKPNPHAWMSPDNALIYVDNIRDALVKYDPANAQTYQRNADAYKQKITATLEPLRKQVAEIPEDKRWMVTSEGAFSYLARDLGLKELYLWPINADQQGTPQQVRKVIDLVKKHHIPAVFSESTVSDKPARQVARETGAHYGGVLYVDSLSAENGPVPTYIDLLNVTTRTLVQGIRDGMKE

SEQ ID NO: 8194 - protein, 388 aa, Enterobacter cloacae
TPENSLLHAAGGLYRGGAANRRRVSGDLSGGHAWRDRVAADRSLPAPADDCRRHWQHHQLPRRVGQLLPGRRHRRHYRGRPDAAVPAGVRLCAEARTACQPSSGAGGTPMMTLLLEPFQFAFMNNALLISLLVAVPCALLSVFLVLKGWALMGDAMSHAVFPGVVLAWMMGLPLALGAFVAGLFCAVATGYLKDNSRIKQDTVMGIVFSGMFGAGLILYIAVKPEVHLDHILFGDMLGINGMDILQSGLVAGMIALVIGLKWRDFLLFCFDYQQAQASGLRTRWLHHGLLCMVSLTIVATLKAVGIILSISLLIAPGAVAVLITRRFHMALLVAVAVSALVSVSGVYASFYLDSAPAPTIVVLFAMVFIVTFVVTSVKARRQERVTAE

SEQ ID NO: 8195 - protein, 459 aa, Enterobacter cloacae
PARPESESSYSLYVPLLWLFNERASHSAGITVLQMQIVINNIINKICSETKKTVKHGVIRVTVLTTGSEAWWQAKNGPERERHQENYRVTFWWRDPAGTQKSSTVKRVWLYVTGVTDHHQNARPQSLERVPDTDVWQWQGEFSPEWRGSYCFIPSDNENDFADAVFEGEQPDRMALREGWRKLLPHAVSDPLNPQSWRGGRGHAVSALEMPEAPVQPGWNHPDTPYNKPVCIDWHSARLKNRRRVWIFTTGDESPERPLAVLLDGQFWAESMPVWPALASLTHEGKLPPAVYVLIDVIDTAHRSRELPCNPDFWLAVQEELLPQVKSMAPFSDRADHTVVAGQSFGGLSSLYAGLNWPQRFGCILSQSGSYWWPHRGAQQDGLLIEQLKAGEKTARGLRIVLEAGRNEPLILRANQAILAELHTQQPVFWRQVDGGHDALCWRGGLTQGLMTLWQPLIQ

SEQ ID NO: 8196 - protein, 1294 aa, Enterobacter cloacae
AVLFCGGARMNRLPLVAAQPGIWMAEQLSSLPNAWSVAHYTELKGAIDAPLLAKAIAEGMMQADTLRMRFAEDHGELWQWIDEAMLLPEPSIVRVDSHDAAVALMEADLNQNLRVDSGQPLAFHQLIQVGESHWYWYQRYHHLVVDGFSFPAITRQIAAIYAAWHKGEPAPASPFTPFAEVVEEYQRYRDSEAYQRDGAFWAVQRQQLPSPVSLSSAPLPGHAATTDILRLKMAMDGRAFSQLAQMAGQAQRTDLALALVVLWLGRLTGRLDYAAGFIFMRRMGSAALTATGPVLNVLPLAVNIRPHESLPELALRLANQLKKMRRHQRYDAEQIVRDSGRAAGDEALFGPVLNVKVFDYQLDIDGVEAITHTLATGPVNDLELALFPDEQGGLSIEILANGQRYDEATLKGHAVRLNAMLTQFAANPDLRCGDVETLSEQEYARLARINDTGLALPSTTLADLVAEQASKTPDAPALADAHTELNYRQMREQVVALANLLRARGVKPGDSVAVALPRSVFLTLALHGIVEAGAAWLPLDTGYPDDRLRMMLEDAKPSLLITTDEQLPRFSDLPIATFSYNTLLPTSGAEPLRLAKPEQTAYIIFTSGSTGRPKGVMVGHTAIVNRLKWMQDHYPLTAHDVVAQKTPCSFDVSVWEFWWPFIAGAKLVMAEPDAHRDPQAMQSFFAEYGVTTTHFVPSMLAAFVASLTPENAHCCRTLKLVFCSGEALPTALCREWEQLTHAPLHNLYGPTEAAVDVSWYPAYGPELAAVEGNSVPIGFPVWNTGLRILDAMMRPVPFGVAGDLYLTGIQLAQGYLGRPDLTASRFIADPFAPGERMYRTGDVARWLDNGAVEYLGRSDDQLKIRGQRIELGEIDRAMLALPDVAQAVAHACVFNQAAATGGDARQLVGYVVSESGLPLDRDALLASLKAQLPPHMVPVVLLQISALPLSANGKLDRKALPLPELTSRTSGRAPETQTEVAVAQAFSSLLGCAVNDIEADFFALGGHSLLAMRLAAQLSRAFSRKVTPGQIMVASTVSKLSALLDSQMRDEQAQRLGYETLLPLRESNGPTLFCFHPASGFAWQFSVLARYLSPRWSIVGIQSPRPNGPMQQCADLDGVIEHHLNTLRKQQPQGPYYLFGYSLGGTLAQGIAARLREQGEAVAFLGLLDTWPPETQNWAEKEANGLDPAVLAEIERERQAFIAAQQGQGSSELFNAIEGNYADAVRLLTTAHSARFDGKATLFVAERTRTQDPQAAWAPWVGELEVYSQDCAHVDIISPQAFEKIGPVLKEILG

SEQ ID NO: 8197 - protein, 317 aa, Enterobacter cloacae
ARLQRRAAPRGAQRLGRSHYYRRRTPLRGAPTGGQMNALLEPFGYEYMLNAMWVSAMVGGLCAFLSCYLMLKGWSLIGDALSHSIVPGVAGAYMLGLPFSLGAFLSGGLAAGSMLFLNQRSRLKEDAIIGLIFSSFFGLGLFMVSLNPTSVNIQTIVLGNILAIAPEDIVQLAIIGVVSIVILLFKWKDLMVTFFDENHARAIGLRPERLKILFFTLLAVSTVAALQTVGAFLVICLVVTPGATAWLLTDRFPRLLMIAVAIGSITSFLGAWASYYLDGATGGIIVVAQTLLFLLAFVFAPKHGLLASRRRAREAHP

SEQ ID NO: 8198 - protein, 82 aa, Enterobacter cloacae
PSGSRLFNNGVCMEFSNPFDNPQGQFAILQNDQGQYSLWPQQCELPAGWRVVCEPQSKEACQQWLAEQWQTLEPFYFAGERA

SEQ ID NO: 8199 - protein, 506 aa, Enterobacter cloacae
TSRLKYGLEFTHLNLDGLHLGVTLKRHDAVLTANAGVFVAAHRHLRGGFAPGVDPADARFELMNSAVGAVQIGGDNARRQTVVGVIGAANGFFVSVIGKNGHHRAEDLFAHDGHFVGAVGEHGRGHPRAVVKAVTLQHVTAAQHARAFLFAFGDVAQHAVPVREANHRAKVGAFIEQIARADAAHALNDFLLKRGFELRGHEHAGAIGAHLAGAEEIGHHGDICREIQIRIVKHYQRGFTAQLHRHLFQGRGRRVGHHFFAAGDAAGKGDFGDARMLGQVLASLRAYARQDVKHAVRQARFGVDFSKLQGGKRCHFARLEDHCVARRQRRRGFPQGDLDRVVPRADARHHAQRLAAGVDERGVAQRDLAALQRRDQPRVVLQHVRAGDDVDGRGFGIRFTGVEGFQRCQLVVTLAQDIDGATQDARALHGGHRRPDFLPALCAFDGAVHVFAPGGLHGRQNFTVRRVDGLEGATAGGGCITTIDIKLLFCHSGHKFSSVSRSVNAG

SEQ ID NO: 8200 - protein, 680 aa, Enterobacter cloacae
GYWMTDLSQDREKDKINPVVFYTSAGLILLFSLTTIFFRDFSAEWIGRTLDWVSKTFGWYYLLAATLYIVFVVCIACSRFGSVKLGPEQSKPEFSLLSWAAMLFAAGIGIDLMFFSVAEPVTQYMQPPEGAGQTMEAARQAMVWTLFHYGLTGWSMYALMGMALGYFSYRYNLPLTIRSALYPIFGKKINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPTEWMNNWTLFFWAWWVAWSPFVGLFLARISRGRTIRQFVMGTLIIPFTFTLLWLSIFGNSALHEIIHGNATFAQEAMAHPERGFYSLLAQYPAFTFSASVATITGLLFYVTSADSGALVLGNFTSKLKDINSDAPNWLRIFWSVAIGLLTLGMLMTNGISALQNTTVIMGLPFSFVIFFVMAGLYKSLKVEDYRRVSASRDTAPRPLGAQDRLSWKKRLSRLMNYPGTRYTKQMMETVCFPAMEEVAQELKLRGAYVELKNLPPEEGENLGHLDLLVHMGDEQNFVYQIWPQQYSVPGFTYRARSGKSTYYRLETFLLEGSQGNDLMDYSKEQVITDILDQYERHLNFIHLHREAPGNSVMFPDA

SEQ ID NO: 8201 - protein, 115 aa, Enterobacter cloacae
CLLYLLLEVYYVRLYVVPRYKMSIFDELKTSLEEAVEIHSGRKAASRVTRYEVADVRAIREQLNITQSEMAKALGTSVDTIKSWESKRRNPTGLAAKVLNVIRENPAFYKALAGQ

SEQ ID NO: 8202 - protein, 315 aa, Enterobacter cloacae
NRRPLWRRAVRRLSERGKRPGANLYRSAERHHPHAGAGHPRRDEGVIMQKGIVVTDVTVTYRNGHTALRDASFSVPGGSIAALVGVNGSGKSTLFKAVMGFVRAASGTISILGLPPHRALRQNLVAYVPQSEEVDWSFPVLVEDVVMMGRYGHMGFLRRPKECDKQIVTDALKRVDMLELRHRQIGELSGGQKKRVFLARAIAQQGEVILLDEPFTGVDVKTEARIISLLRELRDEGKTMLVSTHNLGSVTEFCDYTVMVKGTVLASGPTDITFTAENLERAFSGVLRHVVLSGSEDRIITDDERPFVAHRQEAK

SEQ ID NO: 8203 - protein, 117 aa, Enterobacter cloacae
RRGVADCAVPRVGTAHPCAAAQPLWPDRSGGGRQLVSGVRPRAGGGGREQRADRLPGVEYGAAHSGRDDAPGAVRRGGGSVSHRHPAGAGVSGTPRPYRQPLYRRPVRAGRADVPHR

SEQ ID NO: 8204 - protein, 420 aa, Enterobacter cloacae
TQGFVMNQKSWLLNLSLLKTHPAYRAVFIARFISILSLGLLGVAVPVQIQTITHSSWLVGLSVTLTGGAMFIGLMVGGVLADRYERKKLILLARGTCGVGFVGLCLNAMLPEPSLVAIYVLGLWDGFFASLGVTALLAATPALVGRENLMQAGAITMLTVRLGSVISPMVGGLLLATGNVAWNYGLAAAGTFITTLTLLRLPLLPPPPQPREHPLKSLMAAIRFLFSNPLIGGIALLGGLLTMASAVRVLYPALAGEWQMSASEIGVLYAAIPLGAACGALTSGNLAQSARPGLIMLVATLASFIAIGFFSLMPVWALGVMCLVIFGWLSAVSSLLQYTLIQTQTPEGMLGRINGLWTAQNVTGDAIGAAILGGMGAIMTPVASASSSGFVLAMIGAILLVTLVELRRFRQEVALNDGAA

SEQ ID NO: 8205 - protein, 331 aa, Enterobacter cloacae
EALSSIKSGCRSVKIAAVCRNALLLTGLFVLGLTSAAADDWPRQVSDSRGVHTLESKPTRIVSTSVTLTGSLLAIDAPVIASGATTPNNRVADAQGFLRQWGDIAKQRKVARLYIGEPSAEAVAAQMPDLILISATGGDSALALYDQLSAIAPTLIINYDDKSWQELLTQLGTITGQETQAAERIAAFDKQLAQVKQQMKLPPQPVNAIVYTAAAHTANLWTTDSAQGKLLHQLGFTLADLPAGLQTSTSQGKRHDIIQLGGENLATGLNGEGLFVFAGDQKDVNAIYANPLLAHLPSVKNKRVWALGTETFRLDYYSAMLVLDRLNALFK

SEQ ID NO: 8206 - protein, 439 aa, Enterobacter cloacae
HRDRPRQPRGAYAADGPACHHRAVRQRDRRGRPDCLYRPDDAAHGALAGGGGSPLVPPGNAAGDPCPAAVCRRAGPPAGAGRTACLGGQRLYRRAGADLPGTTQTRGWRMMAPSRRLLTSVALLVVACLLLAVWSLQSGAVTLDFAQVFHALTGSAPRNITMVVTEWRLPRVAMAILVGAALGVSGAIFQSLMRNPLGSPDVMGLNTGAWSGVLVAMVLFGQHLTAITFTAMAGGILTSLLIWALAWRNGIDTFRLIIIGIGIRAMLMAFNTWLLLQASLETALSAGLWYAGSLNGLTWVKTWPAAPLIILMFIGALLLVRRMRLLEMGDDSACALGVSVERSRLMLMLVAVLLTAASTAIAGPISFIALVAPHIARRLSGTARWGLTQAALCGAVLLLAADLCAQRLFTPYQLPVGVVTVSLGGIYLIVLLVQESRKK

SEQ ID NO: 8207 - protein, 220 aa, Enterobacter cloacae
DTFYIERPIKNRFNRLPTLMNGVAKMPKVGMQPIRRRQLIDATLEAINEVGMHDATIAQIARRAGVSTGIISHYFKDKNGLLEATMRDITGQLRDAVLSRLRALPDGSAEQRLQAIVGGNFDETQVSGAAMKAWLAFWASSMHQPMLYRLQQVSSRRLLSNLVYEFRRELPREQAEEAGYGLAALIDGLWLRAALSGKPLDKTLAQSLTSHFISQHLPTD

SEQ ID NO: 8208 - protein, 352 aa, Enterobacter cloacae
PNKIDNDNHYHYQIMDVAMSFSSSAVRALAVPVLLLLLILAIALSLLVGAKPLPASVIVDALSGTCQSADCTIVLDARLPRTLAGLLAGGALGLAGALMQTLTRNPLADPGILGVNSGASFAIVLGAALFGFTSPSEQLVMAFCGALAASLVVAFTGSQGGGQLSPVRLTLAGVALAAVLEGLSNGIALLNPDVYDQLRFWQAGSLDIRTLETLKVVVIPASVAAAVALCLSRALNSLSLGSDTATALGNRVARTQLTGLLAITVLCGSATAVVGPIAFIGLMMPHMARWLVGADHRWSLPVTLLATPALLLFADVLGRLLVPGELRVSVVSAFIGAPVLIFLVRRRRGGGA

SEQ ID NO: 8209 - protein, 530 aa, Enterobacter cloacae
LTGCGCALRSAANRWIKPWPSRLPATLSASIYRPTNRGEFMSRMAEQQLYINGGYTSATSGRTFETINPANGEVLATVQAAGREDVDRAVESAKRGQKIWAAMTAMERSRILRRAVDILRERNDELATLETLDTGKAYSETSTVDIVTGADVLEYYAGLIPALEGSQIPLRDTSFVYTRREPLGVVAGIGAWNYPIQIALWKSAPALAAGNAMIFKPSEVTPLTALKLAEIYTEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKFKAAFEQKIVERVGRIRAGDLFDESTNFGPMVSFPHRDSVLRYITKGKEEGARVLCGGDVLKGDGFDNGAWVAPTVFTDCTDEMTIVREEIFGPVMSILTYDTDEEAIRRANDTDYGLAAGIVTANLNRAHGAIHQLEAGICWINTWGESAAEMPVGGYKHSGIGRENGVMTLQSYTQVKSIQVEMGKFQSIF

SEQ ID NO: 8210 - protein, 239 aa, Enterobacter cloacae
GHQAAPSFNATSCLNRRNSTSVTSKIAPIIANTNPLLLADATGVIIAPIPPRIAAPIASPVTFCAVHRPLMRPSIPSGVWVWIRVYCKSELTALSQPKITRHITPSAHTGIRLKKPIAINEASVATSMISPGLALCARLPLVSAPHAAPSGMAAYSTPISEALICHSPASAGYSTRTALAIVSRPPSSAMPPINGLLNRKRIAAIRDFSGCSRGCGGGGRSGRRSSVRVVIKVPAAARP

SEQ ID NO: 8211 - protein, 325 aa, Enterobacter cloacae
RHRALGINPGGAVRCSITAGRRSLRPAAVYALSTAGGRGDRQPRRDLPHRLARSGVTQEMTDLTTRLRGENLTLGYGKKIIARDLSVAIPDGHFTAIIGPNGCGKSTLLRTLSRLMSPVEGSVFLDGEQIQRFASKEVARRIGLLAQNATTPGDITVQELVSRGRYPHQPLFTRWRKEDDEAVKRAMQATGITELAQQSVDTLSGGQRQRAWIAMVLAQETSIMLLDEPTTWLDISHQIDLLELLSELNRTQGYTLAAVLHDLNQACRYATHLIALRDGEIVAQGAPKEIVTPELIARIYGMRCMIIDDPVAGTPLVVPLGKRAV

SEQ ID NO: 8212 - protein, 108 aa, Enterobacter cloacae
TPDARARSLPAPPGRGRWPLSPPSSGFPAARYPAGRGTPPLHPARAGGPQCPAPACRRGNSRTGNTAPAAAAYATCSDDVRSPHRDPRTAASGRLAAATECRRWTSAG

SEQ ID NO: 8213 - protein, 754 aa, Enterobacter cloacae
ITIKAGRTMNKKIHSLALLVNLGIYGVALPAMADDNTASAQHEDTMVITAAEQNLQAPGVSTITADEIRKNPPARDVAEIIRTMPGVNLTGNSTSGQRGNNRQIDIRGMGPENTLILIDGKPVTSRNSIRLGWRGERDTRGDTGWVPPEMIERIEVIRGPAAARYGNGAAGGVVNIITKKFDDQWHGSWNTYLNAPEHKDEGSTKRTNFSLSGPLGGDFSFRMYGNLDKTQADAWDINQGHQSDRTGAYANTLPAGREGVENKDINGVVRWDFAPMQSLEFEAGYSRQNNLYAGDTQNTNNDNALVKKNYGKETNRIYRQNFAVTWNGGWDNGITTSNWAQYEHTRNSRLGEGLAGGLEGLFNSNKFTDTDLADVMLHSEINLPIDFIVNQNLTLGTEWNQQRMKDSTSFTQTQQGGTIPGMSEDRSPYTSAEIFSLFAENNMELTDSTMLTPALRFDHHTIVGNNWSPSLNLSQGLGDDFTLKMGIARAYKAPSLYQTNPNYLLYSKGQGCYASSDGVGCYMMGNDDLKAETSINKEIGLEWKRDGWLAGVTWFRNDYRNKIEAGYAPIGQTSTGKVTTDIYQWENVPKAVVEGLEGSLNVPVSDTINWTNNITYMLQSKNKETGDRLSIIPEYTLNSTLSWQVRQDVSLQSTFTWYGKQQPKKYNYKGQPVTGSEKDEVSPYSIVGLSATWDVTKNVSLTGGVDNVFDKRQWRAGNAQTTGNTTTGAYMYGAGAYTYNEPGRTWYMSVNTRF

SEQ ID NO: 8214 - protein, 253 aa, Enterobacter cloacae
CLLPLPLGEGWGEGIRPHNTEGKTMHTTHSTFSLAGHTLHRITFDPTTFTDADLLWLPHHAQLANAGRKRKADHLAGRIAAAHALPDYTMPAIGPSGEPLWPQGISGSITHSGTQAIAVVTQYPALIGIDCETILSENEAREIKDGIIDTQEEPVLSRLGYPFALALTLVFSAKESLFKALFPQVQAWMGFDCARVTMLDDKTLTLALTCQLADFQEGTAFPLHWQQHGEQVITLLSHAPGDEPSRWSPQTSR

SEQ ID NO: 8215 - protein, 573 aa, Enterobacter cloacae
SPSRLRWVNSSPYFNREVYLQFDYIIIGAGSAGNVLATRLTEDPNTTVLLLEAGGPDYRFDFRTQMPAALAFPLQGKRYNWAYETEPEPFMNNRRMECGRGKGLGGSSLINGMCYVRGNAMDLDNWAKEPGLEHWSYLNCLPYYRKAETRDVGPNDYHGGDGPVSVTTSKPGVNPLFEAMVEAGVQAGYPRTDDLNGYQQEGFGPMDRTVTPQGRRASTARGYLDQAKPRPNLTIRTHAMTDHIIFDGKRAVGVEWLEGESTIPSKATAKKEVLLCAGAIASPQILQRSGVGNAELLKQFDIPLVHDLPGVGENLQDHLEMYLQYECKEPVSLYPALQWWNQPKIGAEWLFGGTGVGASNHFEAGGFIRSREEFEWPNIQYHFLPVAINYNGSNAVKEHGFQCHVGSMRSPSRGHVRIKSRDPHQHPAILFNYMSHEQDWQEFRDAIRITREIMHQPALDKYRGREISPGVECQTDEQLDEFVRNHAETAFHPCGTCKMGYDEMAVVDGEGRVHGLEGLRVVDASIMPQIITGNLNATTIMIGEKIADAIRGREPLAKSTAAYYVANGAPVRR

SEQ ID NO: 8216 - protein, 145 aa, Enterobacter cloacae
STFEVVMKKIACLSALAAVLAVSAGTAVAATSTVTGGYAQSDMQGVMNKTNGFNLKYRYEQDNNPLGVIGSFTYTEKDRTENGSYNKGQYYGITAGPAYRLNDWASIYGVVGVGYGKFQQTENQGLNRTASNSDYGFSYGAGMQF

SEQ ID NO: 8217 - protein, 176 aa, Enterobacter cloacae
ADPILNLMESTMLNQLESLTERVGGSNTLVDRWLHVRKHLLVAYYNLVGLKPGKESFMRLNEKALDDFCQSLVDYLSDGHFNLYERIIREMEGTTPYLAASKLCPLLEANTQRIMDYYDSALENAIDHDNYLEFQQALSDLGEALEERFTLEDKLIALVLDNNLNISTSDNVARPA

SEQ ID NO: 8218 - protein, 632 aa, Enterobacter cloacae
AMSTAKLTRREQREHAQRFIDTLEGTAFPNSKRIYISGSQADIRVPMREIQLSPTLIGGSKDNPQFEDNEAVPVYDTSGPYGDPDVAINVQQGLAKLRQPWIEARNDCEELSVRSSAYTKERLADDGLDALRFTGLLTPKRAKAGKCVTQLHYARQGIVTPEMEFIAIRENMGRERIRSEVLRHQHPGEGFGARLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAENLTWEAFRDTLLEQAEQGVDYFTIHAGVLLRYVPMTAKRLTGIVSRGGSIMAKWCLSHHQENFLYEHFREICEICAAYDVSLSLGDGLRPGSIRDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSETFRAKGGEIYLKKEEA

SEQ ID NO: 8219 - protein, 314 aa, Enterobacter cloacae
RSWRPTLSALPITPPLPSAGSALNARPPCWKPASAVSPSSALSPRPQTGRPPPHGFYNWQEQAMKDRDFMRYSRQILLEDIAIDGQQKLLASRVLIVGLGGLGAPAALYLAGAGVGTLVLADDDEVHLSNLQRQILFTTEDVNQPKAHVTRQRLNQLNPDIELVALQTRLSGEDLQREVALADVVLDCTDNMATRQAINAVCVAQNTPLITASAVGFGGQIMVLTPPWAQGCYRCLWPDEAEPERNCRTAGILGPVVGVMGTLQALEAIKLLSGMETERNTLRLFDARSSGWRHLVLNRASHCPVCGGRNAHSV

SEQ ID NO: 8220 - protein, 118 aa, Enterobacter cloacae
CRTGKSAQTSGVIMEDLETTIMELLVNAGAARSAALTALQMARKGDFDEAEKAMEESREYVKHAHTIQTQLIGLDEGTGKLPVNLITVHSQDHLMNAMVIQDLAGDMIELYRRIPLVN

SEQ ID NO: 8221 - protein, 78 aa, Enterobacter cloacae
TAPATARYAEAAMRILFNDEPMTCDDDLTVAALLDTLRQLKPGTALALNQQILPRERWEHQQVNEGDQILLFQVIAGG

SEQ ID NO: 8222 - protein, 599 aa, Enterobacter cloacae
ERQPAGDTGDEARGFASAQRCHTCAVTGGRRDALTEYLRCENGRGSNFRCATGAGSARHPLAEAGNSSGRPLAVARSDRNPESGREAGAAGIYRPALLRCRPRAVQASGRGRLRGRNAVRGTHWLQPGTGDPRDAGDHHRAGDRARGGGCGHRRTQSRRAGAGDGGRCGAGQYRDCGGRRPGDDGACVPPCGGVRSAGTPVRPRLALRSGAGHQPADRFSGGALMATFTDRWRQLNWDDIALRINSKTSADVERALTAKHLTREDLMALLSPAAGAYLEPMAQRAQRLTRQRFGNTVSFYVPLYLSNLCANDCTYCGFSMSNRIKRKTLDEHEIARECAAIREMGFEHLLLVTGEHQGKVGMDYFRQHLPAIRREFASLQMEVQPLSQEEYAELKTLGLDGVMVYQETYHEATYARHHLKGKKQDFIFRLETPDRLGRAGIDKIGLGALIGLSDSWRVDCYMVAEHLLWLQQRYWQSRYSISFPRLRPCTGGVEPASLMDERQLVQTLCAFRLFAPEVELSLSTRESPAFRDRAIPLAINNVSAFSKTQPGGYADDHPELEQFAPHDGRRPEAVAEALTAQGLQPVWKDWDSWLGRASH

SEQ ID NO: 8223 - protein, 551 aa, Enterobacter cloacae
IISSVIAFCIIYYQQPDSDYAEGIDRRNASTIWIDVQLMALHSKKLSFTRPIMVSFAGILLSFALIAILVILSQRKDFLEDYHKINGNFTHNLAVNYTESILRENDYILGRAAMYFARNDRVNQTINIDPTHGLQMLMHLQNLMPTVSSISLADTVGRHLRAPEVLPTEKGKSFDARTRPWFIGQAEASNFPHYTRPYLDYFTQHPTVTLYKPVISPEGRLKGTLAFHLDLTSMGYTLRQMVAPVQGEFFVVERDGAVVLHPDTGALFKQYVSEALMDKMTSGEGHLFDPKSKTWYYYYSFTNPDWFVIYRVSDATLTVITRHETTVVGWGFALAAIIIILFGLYLRHASRSVLMNIINAIKTGDVNQAPRLEAMLSHTIRTNKERELAYVRQATHDALTGCKNRRAFDNDVDELLTAHQPFVLALVDIDNFKSINDTWGHLSGDIVLRNVAREGIQIMQPHHVSVYRYGGEEFGVIFPAELMNSAHALLEAWRTAVEKRTWREENLRVTFSAGTGEWHFEPLEQFIGSVDEALYTAKQQGKNRIVSTASR

SEQ ID NO: 8224 - protein, 113 aa, Enterobacter cloacae
LSINTCRSRLTMKNIVLCCAAGMSTSMLVQRMKDAAQKKGVEVTIKAVPVAEFKDNIATADIVLLGPQVKYEQAKLQAQADPLGKKVAVIDMMDYGMMKGDAVLEKALKLLES

SEQ ID NO: 8225 - protein, 577 aa, Enterobacter cloacae
TLISTPGENVFVKMLALYKDASSGVLDEFFTGKIHLTLSVIVKSRGFTMQQRRPVRRALLSVSDKAGIVEFAQALSARGVELLSTGGTARLLAEKGLPVTEVSDYTGFPEMMDGRVKTLHPKVHGGILGRRGQDDAIMEQHDIAPIDMVVVNLYPFAQTVAREGCSLEDAVENIDIGGPTMVRSAAKNHKDVAIVVKSSDYNAIINEMDANERSLTLETRFDLAIKAFEHTAAYDSMIANYFGSLVPAYHGESKDPSGRFPRTLNLNFIKKQDMRYGENSHQQAAFYIEEEVKEASVATAQQVQGKALSYNNIADTDAALECVKEFSEPACVIVKHANPCGVAVSTSILDAYDRAYKTDPTSAFGGIIAFNRELDAETAQAIISRQFVEVIIAPSASEEALKITAAKQNVRVLVCGQWAERVPGLDFKRVNGGLLVQDRDLGMVTEADLRVVTKRQPTEQELRDALFCWKVAKFVKSNAIVYAKENMTIGIGAGQMSRVYSAKIAGIKAGDEGLEVKGSAMASDAFFPFRDGIDAAAAVGITCVIQPGGSIRDDEVIAAADEHGIAMIFTDMRHFRH

SEQ ID NO: 8226 - protein, 435 aa, Enterobacter cloacae
FPEQKMKVLVIGNGGREHALAWKAAQSPQVETVFVAPGNAGTALEPALQNVAIGVTDIPALLSFAQTENIDLTIVGPEAPLVIGVVDAFRAAGLKIFGPTEGAAQLEGSKAFTKDFLARHNIPTAEYQNFTEVEPALAWLREKGAPIVIKADGLAAGKGVIVAMTLEEAEAAVQDMLAGNAFGDAGHRIVIEEFLDGEEASFIVMVDGEHVLPMATSQDHKRVGNGDTGPNTGGMGAYSPAPVVTDEVHQRTMDRIIWPTVKGMAAEGNTYTGFLYAGLMIDKQGNPKVIEFNCRFGDPETQPIMLRMKSDLVDLCLAACEGKLDEKTSEWDERASLGVVIAAGGYPGSYNTGDEIHGLPLEEIDGAKVFHAGTKLADDDRVLTNGGRVLCATALGQTVAEAQKRAYALMADIHWNGSFSRQDIGYRAIAREQGE

SEQ ID NO: 8227 - protein, 238 aa, Enterobacter cloacae
SRHGGHVGNLPRERRRNLPQKRGGIMYQPDFPPVPFRLGLYPVVDSVAWIARLLEAGVRTIQLRIKDKRDEEVEADVIAAIALGRRYHARLFINDYWRLAVKHQAYGVHLGQEDLETTDLNAIRDVGLRLGVSTHDDMEIDVALAARPSYIALGHVFPTQTKQMPSAPQGLTQLAAHVKRLADYPTVAIGGISLERAPAVLETGVGSIAVVSAITQAADWQAATARLLQLAGAGDERS

SEQ ID NO: 8228 - protein, 294 aa, Enterobacter cloacae
SRERRWRSINRSCRASGGNISRSMKATRSCCFRLSQGAEMLRIADKVFDSHLFTGTGKFASPQLMVDAIRESGSQLVTLAMKRVDLRQHNDAILAPLREAGVTLLPNTSGAKTAEEAIFAAQLAREALGTRWLKLEIHPDARWLLPDPIETLKAAEKLVQQGFTVLPYCGADPVLCKRLEEVGCAAVMPLGAPIGSNQGLETRAMLEIIIEQATVPVVVDAGIGVPSHAAQALEMGADAVLVNTAIAVADDPVMMARAFRLAVESGLLARQSGPGSRCVQAQATSPLTDFLEAL

SEQ ID NO: 8229 - protein, 1388 aa, Enterobacter cloacae
IAMKWFKRDSNRYCGKYSIFRSTKWCCTNCPFVGQMGRLVSELRNPMVYSYTEKKRIRKDFGKRPQVLDIPYLLSIQLDSFQKFIEQDPEGQYGLEAAFRSVFPIQSYSGNSELQYVSYRLGEPVFDVQECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPATIILRALNYTTEQILDLFFEKVIFEIRDNKLQMELVPERLRGETASFDIEADGKVYVEKGRRITARHIRQLEKDDIKHIEVPVEYIAGKVAAKDYVDESTGELICPANMELSLDLLAKLSQAGHKRIETLFTNDLDHGPYISETVRVDPTNDRLSALVEIYRMMRPGEPPTREAAESLFENLFFSEDRYDLSAVGRMKFNRSLLRDEIEGSGILSKDDIIEVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYAQTNEYGFLETPYRKVTDGVVTDEIHYLSAIEEGNYVIAQANSNLDDEGHFVEDLVTCRSKGESSLFSRDQVDYMDVSTQQVVSVGASLIPFLEHDDANRALMGANMQRQAVPTLRADKPLVGTGMERAVAVDSGVTAVAKRGGTVQYVDASRIVIKVNEDEMYPGEAGIDIYNLTKYTRSNQNTCINQMPCVSLGEPVERGDVLADGPSTDLGELALGQNMRVAFMPWNGYNFEDSILVSERVVQEDRFTTIHIQELACVSRDTKLGPEEITADIPNVGEAALSKLDESGIVYIGAEVTGGDILVGKVTPKGETQLTPEEKLLRAIFGEKASDVKDSSLRVPNGVSGTVIDVQVFTRDGVEKDKRALEIEEMQLKQAKKDLSEELQILEAGLFSRIYAVLVAGGVEAEKLDKLPRDRWLELGLTDEEKQNQLEQLAEQYDELKHEFEKKLEAKRRKITQGDDLAPGVLKIVKVYLAVKRQIQPGDKMAGRHGNKGVISKINPIEDMPHDANGTPVDIVLNPLGVPSRMNIGQILETHLGMAAKGIGDKINAMLKQQQEVAKLREFIQRAYDLGTDVRQKVDLNTFSDEEVLRLAENLRKGMPIATPVFDGAKEAEIKELLQLGGLPTSGQITLFDGRTGEQFERPVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 8230 - protein, 203 aa, Enterobacter cloacae
FSIRDIIMLQNPIHLRLEKLESWQHVTFMACLCERMYPNYAAFCKQTAFGEGQIYRRILDLIWETLTVKDAKVNFDSQLEKLEEAIPAADDFDLYGVYPAIDACVALSELIHSRLSGETLEHAIEVSKASITTVAMLEMTQEGREMTDEELRANPAVEQEWDIQWEIFRLLAECEERDIELIKGLRADLREAGESNIGIIFNQ

SEQ ID NO: 8231 - protein, 91 aa, Enterobacter cloacae
LMNKTQLIDVIADKADLSKVQAKAALESTLAAITESLKEGDAVQLVGFGTFKVNHRAERTGRNPQTGKEIKIAAANVPAFVSGKALKDAVK

SEQ ID NO: 8232 - protein, 1421 aa, Enterobacter cloacae
RPTAECANSDGSKSVKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRERMGHIELASPTAHIWFLKSLPSRIGLLLDMPLRDIERVLYFESYVVIEGGMTNLERNQILTEEQYLDALEEFGDEFDAKMGAEAIQALLKSMDLEQECETLREELNETNSETKRKKLTKRIKLLEAFVQSGNKPEWMILTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPANGEPIIVPSQDVVLGLYYMTRDCVNAKGEGMVLTGPKEAERIYRAGLASLHARVKVRITEYEKDENGEFVAHTSLKDTTVGRAILWMIVPKGLPFSIVNQALGKKAISKMLNTCYRILGLKPTVIFADQTMYTGFAYAARSGASVGIDDMVIPEKKHEIISEAEAEVAEIQEQFQSGLVTAGERYNKVIDIWAAANDRVSKAMMDNLQTETVINRDGVEEQQVSFNSIYMMADSGARGSAAQIRQLAGMRGLMAKPDGSIIETPITANFREGLNVLQYFISTHGARKGLADTALKTANSGYLTRRLVDVAQDLVVTEDDCGTLEGITMTPVIEGGDVKEPLRDRVLGRVTAEDILKPGTADILVPRNTLLHEQWCDLLEANSVDSVKVRSVVSCDTDFGVCAHCYGRDLARGHIINKGEAIGVIAAQSIGEPGTQLTMRTFHIGGAASRAAAESSIQVKNKGSIKLSNAKSVVNSSGKLVITSRNTELKLIDEFGRTKESYKVPYGAVMAKGDGEQVAGGETVANWDPHTMPVITEVSGFIRFTDMIDGQTITRQTDELTGLSSLVVLDSAERTTGGKDLRPALKIVDAQGNDVLIPGTDMPAQYFLPGKAIVQLEDGVQISSGDTLARIPQESGGTKDITGGLPRVADLFEARRPKEPAILAEISGIISFGKETKGKRRLVITPVDGSEPYEEMIPKWRQLNVFEGERVERGDVVSDGPEAPHDILRLRGVHAVTRYIVNEVQDVYRLQGVKINDKHIEVIVRQMLRKATIENAGSSDFLEGEQVEYSRVKIANRDLEANGKIGATFSRDLLGITKASLATESFISAASFQETTRVLTEAAVAGKRDELRGLKENVIVGRLIPAGTGYAYHQDRMRRRAAGELPAAPQVTAEDASASLAELLNAGLGGSDNE

SEQ ID NO: 8233 - protein, 363 aa, Enterobacter cloacae
RTDAIRNCKMTELKNDRYLRALLRQPVDVTPVWMMRQAGRYLPEYKATRAQAGDFMSLCKNAELACEVTLQPLRRFPLDAAILFSDILTIPDAMGLGLYFETGEGPRFTSPIKSKADVDKLPIPDPEGELSYVMNAVRTIRRELKGDVPLIGFSGSPWTLATYMVEGGSSKAFTVIKKMMYAEPLALHALLDKLAKSVTLYLNAQIKAGAQSVMIFDTWGGVLTGRDYQQFSLYYMHKIVDGLLRENEGRRVPVTLFTKGGGQWLEAMAATGCDALGLDWTTDIADARRRVGDKVALQGNMDPSMLYAQPARIEEEVSTILSGFGQGEGHVFNLGHGIHQDVPPEHAGVFVEAVHRLSAQYHK

SEQ ID NO: 8234 - protein, 226 aa, Enterobacter cloacae
GVVMDLASLRAQQIELASSVIREDRLDTDPPRYIGGADVGFEQGGEVTRAAMVVLKYPSLELVEYKVARIATTMPYIPGFLSFREYPALLAAWEQLSQKPDLLFVDGHGISHPRRLGVASHFGLLVDVPTIGVAKKRLCGAFEPLSAEPGALAPLIHKGEQLAWVWRSKARCNPLFIATGHRVSMDSALAWVQRCMKGYRLPEPTRWADAVASSRPAFIRWQEIQP

SEQ ID NO: 8235 - protein, 85 aa, Enterobacter cloacae
VKTTRMEHPGAAARLFKEFAKANAKFEVKAAAFEGELIPASQIDRLATLPTYEEAIARLMATMKEAAAGKLVRTLAAVRDAKEAA

SEQ ID NO: 8236 - protein, 121 aa, Enterobacter cloacae
MSITKDQIIEAVAAMSVMDVVELVSAMEEKFGVSAAAAVAVAAGPAEAAEEKTEFDVILKAAGANKVAVIKAVRGATGLGLKEAKDLVESAPAALKEGVSKDDAEALKKSLEEAGAEVEVK

SEQ ID NO: 8237 - protein, 264 aa, Enterobacter cloacae
SEGSAIDMDRIIEKSDLGWWIVSHEQKLWLPGGEIPYGAAEIFDLVGQPALRIGEWQGDPVWLILQARRQDMGSVRQVLDRDVGLFQLAGRGVQLAEFYRSHKYCGYCGHTMHPSKTEWAMLCGHCRERYYPQIAPCIIVAIRRDDSILLAQHTRHRNGIHTVLAGFVEVGETLEQAVAREVMEESGIKVKNLRYVTSQPWPFPMSLMTAFMAEYDSGEIVIDKKELLEANWYRYDDLPLLPPPGTVARRLIEDTVAMCRAEYE

SEQ ID NO: 8238 - protein, 235 aa, Enterobacter cloacae
VRRVAVNSFNEGAATPLLSFWRGPLALAGVLLLSACSHDSSLPPFTASGYADNQGAVRIWRKDSSDEVHMLTAFSPWHNGNTSTAEYRWQGDALSLIELNIYSKTPEHVKVRFDDHGELSFMQHEVSGLKKQLSSDQVALYSYRAEQLRQTSDALRQGRVVLRQGRWHADGTVTTCEGQTVKPELESWATEHIQRRQRHSSVEVSVAWLEAPEGSQLLLVANEDFCTWQPTEKSF

SEQ ID NO: 8239 - protein, 298 aa, Enterobacter cloacae
APPGIRVRTSLAPSVRVTALSCWSAIAATLRRANGLKWNALTTCSEADMTMELSDPEMMRYNRQIVLRGFDFEGQEALKAASVLVVGLGGLGCAAAQYLAAAGVGSMTLLDFDTVSVSNLQRQTLHSDATVGQPKVESARTALARINPNVQFTLIDAMLDDDALFAQIARHDLVLDCTDNVAIRNQLNAGCFAHKTPLISGAAIRMEGQITVFTYAEGEPCYRCLSRLFGENALTCVEAGVMAPLVGVIGSLQAMEAIKVLAHYGTPAAGKIVMYDAMTCQFREMKLMRNPGCEVCEG

SEQ ID NO: 8240 - protein, 304 aa, Enterobacter cloacae
SEGKKMIFNIQRYSTHDGPGIRTVVFLKGCSLGCRWCQNPESRSRSRDVLFDARLCLDGCELCQQAAPGCVERALNGLVIHREKLNDETLTALTDCCPTQALTVCGEEKQVEEIMATVLRDKPFYDRSGGGITLSGGEPFMNPDLAHALFKASHEQGIHSAVETCLHVPWHYIEPSLPYVDLFLADLKHVDGDVFKQWTDGSAKRILDNLKRLAAAGKTITIRVPLIQGFNADEASVTAITNFAADELGVDDIHFLPYHTLGMNKYTLLGQPYSAPDKPLDNPALLDFAQQYACQKGLTATLRG

SEQ ID NO: 8241 - protein, 800 aa, Enterobacter cloacae
TSREARLIVDVLHMKTLKNWTLDTQSANHLELLVDSQHRLCLYVLEENLFRVLIKRKGELALDRTWSIAPEKDVPWEGRRRDDISGFSCPAWTLTQQDDTLTVATEQLRVTVHQPLWLEWHYRNDAGEWQPLVNDRPTSAYLLNAHGDGVAHYLSRRKDERFYGLGEKAGDLQRNGKRYEMRNLDAMGYNAASTDPLYKHIPFTLTRRDDVSYGLFYDNLSSCWLDLGNEIDNYHTAYRRWQAEAGDIDYYLFTGKRVLDVTKAFVRLTGKTLFGPKWSLGYSGSTMHYTDAPDAQNQLMNFIRLCEEHAIPCDSFQLSSGYTSINGKRYVFNWNYDKVPQPKVMSQAFHDAGLRLAANIKPCLLQDHPRYGEVAERGLFIRDSETDAPERSSFWDDEGSHLDFTNPQTVQWWQNGVTTQLLEMGIDSTWNDNNEYEVWDGEARCYGFGKEIAIKHIRPVMPLLMMRASLEAQQRFAPEKRPYLISRSGCAGMQRYVQTWSGDNRTNWDTLRYNIRMGLGMSLSGLFNVGHDVGGFSGDKPDAELFVRWVQNGVMHPRFTIHSWNDDHTVNEPWMYPGVTPAIRGAIELRYRLLPYLYTLLWQAHADDEPMLRPTFLDHEHDAQTFKECDDFLLGRDLLVASVVEAGQRERRVWLPDNETGWYDFYTHAWYAGGQAIVLDAPLEKLPLLVRAGAGLPLSERIRHVSADKDDTRELKLFPVKGVGTTSGLLFEDDGESWGYLNGNALWVEWEMVCDGATINLKVNARGDYRPAWKALKVSLPAGEKRTLRVNGVEGGEWVV

SEQ ID NO: 8242 - protein, 442 aa, Enterobacter cloacae
PMSNVTHPPKIGFVSLGCPKNLVDSERILTELRTEGYDVVPSYDNADMVIVNTCGFIDSAVQESLEAIGEALTENGKVIVTGCLGAKEDQIREVHPKVLEITGPHSYEQVLEHVHHYVPKPKHNPFLSLVPEQGVKLTPRHYAYLKISEGCNHRCTFCIIPSMRGDLVSRPIGEVLAEAKRLADAGVKELLVISQDTSAYGVDVKHRSGFHNGEPVKTSMVGLCEQLAKLGIWTRLHYVYPYPHVDDVIPLMAEGKILPYLDIPLQHASPRILKLMKRPGSVDRQLARIKQWREICPDLTLRSTFIVGFPGETEEDFQMLLDFLKEARLDRVGCFKYSPVEGATANELADQVPEEVKEERWNRFMQLQQQISAERLQEKVGREILVIIDEVDEEGAIGRSMADAPEIDGAVYLNGETNVKPGDIIRVKVENADEYDLWGSRV

SEQ ID NO: 8243 - protein, 184 aa, Enterobacter cloacae
PQKRQAGRRDNRHAYAHGEIDHDRRDRSRQNMAEQDGGIAGSHAARRLDKGLLLQHQRVATYQTRESGNREYRHGDDDVRHAAAHHRHHGNRQQNTGKGKQHITDTHDDAVPPAFVVPGRQPQHGANCCAHQHRKDPGRQRDLRPYQHAAENIAPERVHAKPVHHRRSIVQPVVIEVVFRIKRG

SEQ ID NO: 8244 - protein, 390 aa, Enterobacter cloacae
PRPYEDKLMTTLNLNTLSERIKAHKTALVHIVKPPVCTERAQHYTEMYQQHMDKPIPVRRALALAHHLAKRTIWIKHDELIIGNQASEVRAAPIFPEYTVSWIEKEIDDLADRPGAGFAVSEENKRVLHEICPWWRGQTVQDRCYGMFTDEQKGLLETGIIKAEGNMTSGDAHLAVNFPLVLEKGLDGLRAKVAERRSRINLTVLEDLHGDQFLKAIDIVLEAVSLHIKRFADLAREMASSETRESRRDELLAMAENCDVIAHEPPKTFWQALQLCYYIQLILQIESNGHSVSFARMDQYLYPYYRRDVELGQSLDREHAIELLHSCWLKLLEVNKIRSGSHSKASGGQPAVSERHHRRPEAGQRRANGRGQPALLRDSGILRSPAFHPA

SEQ ID NO: 8245 - protein, 292 aa, Enterobacter cloacae
ICAPRHLVIRMFQNAVTQEHSMTVKVIVTDMDGTFLDDAKQYDRDRFQAQFKQLKARNIEFVVASGNQYYQLISFFPELKDQISFVAENGALVFDHGEQIFHGELTRHESQIVIGELLKDKGLNFVACGLESAYVSDKAPDAFVALMSKHYHRLKRISDYRDIDDVLFKFSLNLPDSDIPNLVDKLHVSLDGIMKPVTSGFGFVDLIIPGLHKANGISRLLKRWKISPQECVAIGDSGNDAEMLKLVKYSFAMDNAAESIKEISRYSTDDNNHQGALNVIQAVLDNHSPFDV

SEQ ID NO: 8246 - protein, 448 aa, Enterobacter cloacae
HLNLRPLTVRLVESKMSQDINNTIATSKTRRVIKNLRWYVLVLFLLGVTVNYITRNSLGILAPELKESLGITTEQYSWIVGAFQIAYTIFQPLCGWLIDVIGLKIGFMVCAGIWALMCIFHAGAGSWLHLAILRFFMGASEAAATPANAKTIGEWFPKSERPVAAGWAGVGFSIGAMLAPPIIYFAHASFGWQGAFMFTGVLALLWVILWWAFYHNPEQHPNLSKDELAFIKQDNEPAPVKLPFLTALKTVSKNKRFYGIAIPAFMAEPAWAVLSFWVPLYLAKEHGMDLKQIAMFAWLPFLAADLGSVASGYLTRLYTRLFGCSRVNSVVASSVTGAFLMISLAIVAITRDPYITIVLISIGGFGHQIISCMLSALVVESFDKGQMATVNGMRGSAAWIASFLFSLLIGVTADKIGFNPLFIAMGFFDLIGALFLVAFIAERRAKRA

SEQ ID NO: 8247 - protein, 411 aa, Enterobacter cloacae
MELKGASGWCSAACSPHPNPLPQGEGIKCRPGKAKPPPGYFLTLDTFTAQVIFVVTGEVHHALWRNFDHAGRQRADELTVVRDEDQGALIHLQRHVQGFDRFHIQVVSRFVHHQNIRFFHHQLAEQHTALFTTGEHFGGLFDVVLAEQQTPQNAAYRLLIVAFLLPLAHPVEDSQIVFEFIFMVLRVVTNLRVFRPFHGSVVRLQFTHQGFQHSGFTHAVGAEDGNLLAHFQQQVEVFEQRAFIEAFGESFHFQRVTEQLLVLLEADERVLTAGGFNLFQLDFVDLTRTRGRLTRLRGVGAEAADEGLQVRNLRFLLGVVGQQTFTCLGCRRHVLIVVARINAQLAVVQIRHVGTHHVQEMTVVRNDDHGAVAIVQRLLQPADGVDVQVVGRFVEQQDVRVREQRLRQQHT

SEQ ID NO: 8248 - protein, 229 aa, Enterobacter cloacae
LLGLSHHGEKLTRIHISSGVNMITLWGRNNSTNVKKVLWTLEELDLPFNQIMAGMAFGVNKDADYLAMNPNGLVPLLRDDETDATLWESNTIVRYLAAQYGQGRLWVENPAQRAQGEKWMDWANQTLSPTHRVILMGLIRTPEADRDYPAIHAAQDACESLFAMMDDELAKHTWFSGDTFGVGDIAVAPFVWNLTNMGLSWTPRPHLERWIQQLSERPAYRNVVMIPVT

SEQ ID NO: 8249 - protein, 428 aa, Enterobacter cloacae
PHFSAIMSAFVVTPQEPTMDFTAGLMPLETALSQMLDRITPLHDVETLPLVRCFGRIAARDIVSPLNVPGFDNAAMDGYAVRLADLQTGQPLPVAGKAFAGQPFNGEWPADTCVRIMTGAPVPTGCEAVVMQEETEQTDDGVRFTASVKAGQNIRHIGEDITLGATVFAAGQKLTVAELPVLASLGIAEIDVVRKVRVAVFSTGDELQLPGQPLNEGQIYDTNRLAVHLMLEQLGCEVINLGIIPDDPQKLRAAFIDADASADVVISSGGVSVGEADYTKNLLEELGEIAFWKLAIKPGKPFAFGKLPHSWFCGLPGNPVSAALTFYQLVIPLLAKLSGNNASPLPERVRVRAATRLKKSPGRLDFQRGILARNADGELEVSTTGHQGSHIFSSFSQGNCFIVLERDRGHVEAGEWVEVERFNHLFGG

SEQ ID NO: 8250 - protein, 484 aa, Enterobacter cloacae
TKSAPARTPKPLAGSPLYQNVTIGGQKLVNGEPMDAVNPLSYAILESCGRLRSTQPNLSVRYHAGMSNDFLDACVQVIRCGFGMPAFNNDEIVIPEFIKLGVERDDAYDYAAIGCIETAVGGKWGYRCTGMSFINFARVMLAALEGGRDATSGKVFLPQEKALSAGNFDNFEEVMAAWDTQIRYYTRKSIEIEYVVDTMLEENVHDILCSALVDDCIERAKSIKQGGAKYDWVSGLQVGIANLGNSLAAVKKLVFDQGVIGQQQLAAALADDFEGLTHEQLRQRLINGAPKYGNDDDSVDLLLTRAYETYIEELKQYHNPRYGRGPIGGNYYAGTSSISANVPFGAATMATPDGRKAHTPLAEGASPASGTDHLGPTAVIGSVGKLPTEAILGGVLLNQKLNPSTLENDSDRQKLMVLLRTFFEVHKGWHIQYNIVSRETLLEAKKHPDQYRDLVVRVAGYSAFFTALSPDAQDDIIARTEHTL

SEQ ID NO: 8251 - protein, 430 aa, Enterobacter cloacae
TFLLSNERCEAVMTFTSETLPADHKAAIRQLKRELRAQIGDVQAVFDKLSDSIATRVAEINALKNKGESVWPVIPFNDVKNGTITDAQREAVKRRGCAVIKGHFPREQALAWDQSMLDYLDLNKFDEVYKGPGDNFFGTLTASRPEIYPIYWSQAQMQARQSEEMAQVQSFLNRLWTFESNGKQWFDPDVSVIYPDRIRRRPPGTTSKGLGAHTDSGALERWLLPAYQQVFARVFDGNVEKYDPWNAAHRTEVEEYTVDNTTKCSVFRTFQGWTALSDMIPGQGLLHVVPIPEAMAYILLRPLLDDVPEDELCGVAPGRVLPVSEKWHPLLIEALTSIPALEAGDSVWWHCDVIHSVAPVDNQQGWGNVMYIPAAPMCEKNLAYAKKVKEALETGASPGDFPREDYEKTWQDRFTVNDLNIHGKRALGMV

SEQ ID NO: 8252 - protein, 628 aa, Enterobacter cloacae
IRGHCVPHREELDNCEVLAVHQLNIAFQEERQFIPAVQNLSFSLRRGETLAIVGESGSGKSVTALALMRLLEQTGGQVTSERMLLRRRNRQVIDLNELSASRMQGVRGADIAMIFQEPMTSLNPVFPVGEQIAESIRLHQGLSGDEALNEAKRMLELVRIPEAHAILSRYPHQLSGGMRQRVMIAMALSCRPAVLIADEPTTALDVTIQAQILQLIKVLQQEMEMGVIFITHDMGVVADIADRVLVMHQGNAVETGTVEQVFHAPVHSYTKALLAAVPRLGAMNGSDFPRRFPLISQTEQGKQEDETEQDTVVPGRPILEVRDLVTRFPLRSGILNRVKREVHAVENVSFDLWPGETLALVGESGCGKSTTGRALLRLVASQEGSITFNGERIDTLPNSKLQAVRRDIQFIFQDPYASLDPRHTVGYSIMEPLRVHNLLDGEDAQRRVAWLLERVGLKPEHAWRYPHEFSGGQRQRICIARALALNPKVVIADESVSALDVSIRAQIINLLLDLQRDLGIAFLFISHDMAVVERISHRVAVMYMGQIVEIGPRRAVFENPQHPYTRKLMAAVPVADPEHRHAQRVLLQDEMPSNIRKRGETLERVALREVGPGHFVAPPRQGNAFSRL

SEQ ID NO: 8253 - protein, 137 aa, Enterobacter cloacae
GNMADRGGNSMSVDRLKRDLLNKLINARIDLAAYLQLRKAKGYMSVSESENLRDNFFELCNFMREKAPILKAHYAESELVALRRAAEVLSIAGVCLMNGRHDCPNFIAVNADKLENCLTTLALCIMCLNKPETLARH

SEQ ID NO: 8254 - protein, 229 aa, Enterobacter cloacae
VQAKFEGDIMELYLDTSDVAAVKKLARIFPLAGVTTNPSIVAAGKTPLEELLPALHDALGGKGRLFAQVMAKTAEGMVEDARKLRAIINDLVVKVPVTAEGLAAIKMLKAEGIPTLGTAVYGAAQGMLSALAGAEYVAPYVNRVDAQGGDGIQTVVEMQQLLTLHAPQSKVLAASFKTPRQALDCLLAGCESITLPLDVAQQFITSPAVDAAIVKFEQDWQGAFGRTSI

SEQ ID NO: 8255 - protein, 314 aa, Enterobacter cloacae
CEMSKAVIAIHGGAGAITRAQLSPEQEKRYIDALNAIVETGQRMLEAGDSALDVVTEAVRLLEECPLFNAGIGSVFTRDETHELDACVMDGVTLKAGAVAGVSRLRNPVLAARLVMEQSPHVLLAGAGAEKFAVEHGMDTVSPELFSTEERYRQLLEARTAGMTQLDHAAPLDERSKMGTVGAVALDKAGNLAAATSTGGMTNKLPGRVGDSPLPGAGCYANNATAAVSCTGTGEVFIRALAAYDITALMDYGGLSLSEACERVVMEKLPALGGIGGLIAVDREGNVALPFNSEGMYRAWGYAGDAPSTGIYRE

SEQ ID NO: 8256 - protein, 313 aa, Enterobacter cloacae
RGFKIKLMLNYVCKRLLGLIPTLLIVAVLVFLFVHMLPGDPARLIAGPEADATVIELVRKQLGLDQPLYRQFLRYIGNVLQGDFGISMVSRRPVSEEIASRFMPTFWLTIASMSWAVVFGLGAGIVAAVWRNRWPDKLGMALAVTGISFPAFALGMLLMQIFSVELGWLPTVGADTWKHYILPSMTLGAAVAAVMARFTRASFVDVLSEDYIRTARAKGVSEKWVILKHGFRNAMIPVVTMMGLQFGFLLGGSIVVEKVFNWPGLGRLLVDSVDMRDYPVIQAEVLLFSLEFILINLVVDVLYAAINPAIRYK

SEQ ID NO: 8257 - protein, 383 aa, Enterobacter cloacae
SLSHMSIKECVMPRSSLIFLPVLLFPLSLLAAPETVKVDVLQTKLDHPWSLAFLPDNKGLLITLKDGQLKHWQAGKGLSDPIVGVPKVWASGQGGLLDVALAPDFAQSRRVWLSFAEAGNDGKAGTAVGYGRLSDDLSRIEGFQVVFRQMPKLSTGNHFGGRLVFDGKGHLFIGLGENNQRPTAQDLDKLQGKVVRLTEDGKVPPDNPFVNTAGARPEIWSYGIRNPQGMAMNPWSDTLWLNEHGPRGGDEINIPEKGKNYGWPLATHGINYSGLKIPEAKGEHVEGTEKPLFVWKVSPAVSGMAFYNSDVFPQWKNKLFIGALKEKDVIVLSVKGNSVTEDGRILGDKDQRIRDVRVGPDGYLYVLTDETDGQLWKVSPSGS

SEQ ID NO: 8258 - protein, 115 aa, Enterobacter cloacae
CAITHRFLRHGDCDVIFRMDTRVAFMTQKTSSLRSLAAGSALLFLFAPTLHAAEQTAPEAPPVDARAWILMDYASGKVLAEGNADEKLDPASLTKIMTSYVVGVFTHVGRSIRDH

SEQ ID NO: 8259 - protein, 543 aa, Enterobacter cloacae
CRVYHTFRRNLSVLVTSNVTMQFGSKPLFENISVKFGGGNRYGLIGANGSGKSTFMKILGGDLEPTLGNVSLDPNERIGKLRQDQFAFEEFTVLDTVIMGHAELWEVKQERDRIYGLAEMSEEDGYKVADLETQYGEMDGYSAEARAGELLLGVGIPVEQHYGPMSEVAPGWKLRVLLAQALFSNPDILLLDEPTNNLDIDTIRWLEQTLNDRDSTMIIISHDRHFLNMVCTHMADLDYGELRVYPGNYDEYMTAATQARERLLADNAKKKAQIADLQSFVSRFSANASKSRQATSRARQIDKIKLEEVKASSRQNPFIRFEQDKKLFRNALEVEALTKGFDEGPLFKNFNLLLEVGEKIAILGANGVGKSTMLKTLVGELQPDNGTVKWSENAQIGYYAQDHEYEFENDLTVFDWMSQWKQEGDDEQAVRSILGRLLFSQDDIKKPAKVLSGGEKGRMLFGKLMMEKPNILVMDEPTNHLDMESIESLNMALEMYQGTLIFVSHDREFVSSLATRVIEITPERVVDFTGNYEDYLRSKGIES

SEQ ID NO: 8260 - protein, 374 aa, Enterobacter cloacae
HTRYENFFISQMEPDHKMDKRLKITEIAARTQLSISTVSRVLAGKANTSEKARAKVLACARELGVMDGMAAGRLLLNSLVVFAPQRAFDERSDIFYYRVIQSVSKALASHEVRLRYCALEENDSDAQLFLARMNEPDTQAAILLGIDDPHIHDLAVDVGKPCMLINCRDRHMRLPAVAPDHRAIGERAAEYLFEMGHREVMNVLCLRRYTMELRLSGIRDAWQSHNLAFNDKRDLLVVPSFSARETEQLVSDWLNQQQGKDLPTAFLVGGDFMAAGTISALKNHGLRVPQDVSVMSIDGFNLAAIQDVPLTAVHVPRDELGTEAVHMLQQRLMRPDAPVGTLLLNGTLTVRESVRRIRQGKRRTAVEREGLYDS

SEQ ID NO: 8261 - protein, 540 aa, Enterobacter cloacae
GGSRSFCRTTASGQCILAVITYNRQENTMVPFVARQWLLAASVTAALAAAPAFAAKDVVVAVGSNFTTLDPYDANDTLSQAVAKSFYQGLFGLDREMKLKNVLAEGYTVSDDGLVYTVKLRTGVKFQDGTDFNAEAVKINLDRASNPENGLKRYNLYKNIASTEAVDPATVKIVLKEPFSAFINILAHPATAMISPAALKKYGKEIGFHPVGTGPYELLTWNQTDFVKVKKFAGYWQQGLPKLDTITWRPVVDNNTRAAMLQTGEAQFAFPIPYEQAALLAKNSKLELVASPSIMQRYISMNVTQKPFDNPKVREAINYAINRQALVKVAFAGYATPATGVMPPAIEYAQSYQPWPYDPAKARELLKEAGYPNGFSTTLWSSHNHSTAQKVLQFTQQQLAQVGIKARVTAMDAGQRAAEVEGKGQKESGVRMFYTGWTASTGEADWSLSPLFASQNWPPTLFNTAFYSNPQVDKDLADALKTTKPEEKARLYKEAQDIIWKESPWVPLVVEKLVSAHNKALTGFYIMPDTGFSFDDADLK

SEQ ID NO: 8262 - protein, 320 aa, Enterobacter cloacae
WWMCCTPPLTRPSGISKMRLLNWRRQAILNAMPGIRPDHIRTPWIEFWRRFRRQPVAMVAGLFVLLLILVAIIAPWLAPFDAENYFDYDRLNDGPSMMHWFGVDSLGRDIFSRVLVGAQISLAAGVFAVLMGAAIGTVLGLAAGYYEGWWDRIIMRICDVLFAFPGILLAIAVVAVMGSGMANVIIAVAVFSIPAFARLVRGNTLVLKQQTFIESARSMGASDATILFSHILPGTVSSIVVYFTMRIGVSIISAASLSFLGLGAQPPTPEWGAMLNEARADMVIAPHVAIFPSLAIFLTVLAFNLLGDGLRDALDPRIKG

SEQ ID NO: 8263 - protein, 275 aa, Enterobacter cloacae
FTGTNCPASGKWTLMIELLLPGWLAGIMLACAAGPLGSFVVWRRMSYFGDTLAHASLLGVAFGLLLDVNPFYAVIVVTLLLAAGLVWLEKRPHLAIDTLLGIMAHSALSLGLVVVSLMSNIRVDLMAYLFGDLLAVTPEDLISIAIGVAVVLGILLWQWRSLLAMTVSPDLAFVDGVKLQRVKLLLMLVTALTIGVAMKFVGALIITSLLIIPAATARRFARTPEQMAGIAVIIGMIAVTGGLTFSAFYDTPAGPSVVLCAAVLFIFSMMKKTAQ

SEQ ID NO: 8264 - protein, 99 aa, Enterobacter cloacae
HCTNNQYKFSLKIQSFPEVFMFVELVYDKRNVDGLVGAREIILAELTKRVHQIFPDAEVRVKPMQANGLNSDASKSDREKLNRMLEEMFEDANMWLVND

SEQ ID NO: 8265 - protein, 253 aa, Enterobacter cloacae
IDMTTLVSLENVSVSFGQRRVLSDVSLNLKPGKILTLLGPNGAGKSTLVRVVLGLVAPDAGVIVREDKLRIGYVPQKLHLDATLPLTVSRFLRLRPGTRKADILPALKRVQAGHLVEAPLQKLSGGETQRVLLARALLSSPQLLVLDEPTQGVDVNGQVALYDLIDQLRRELNCAVLMVSHDLHLVMAKTDEVLCLNHHICCSGTPEVVSMHPEFISMFGHRGAEQLGIYRHNHNHRHDLQGRIVLRRGNGHS

SEQ ID NO: 8266 - protein, 197 aa, Enterobacter cloacae
KSNHLTGATMFTLDATKTALVVIDLQEGILPFAGGPHTADDVVSRAARLAEKCRASGSPVVMVRVGWSADFAEALKQPVDAQAPAQALPDNWWTYPVSLGKRDSDIEVTKRQWGAFYGTDLELQLRRRGIDTIILCGISTNIGVESTARNAWELGFNLVIAEDACSAASADQHQCSMTHIFPRIGRVRSTDEILSAL

SEQ ID NO: 8267 - protein, 273 aa, Enterobacter cloacae
IKVGLGDEVTANFASLEIGAKKPSSASFVDFHFLGTNDYDGRILCSSGISGTAGAGAMTYYGGSHRFVGSVSFDHSATFNSSVDAKGIVAGVTSLNVRASSDTQYSHVWFYGASGPSRGVIYAVKDGSIRLRPDNNDNGGANGYSFSFGADGKFTCVTMNQTSDERVKFDKEPVSKALEKICSLTGYTFGIQLTESESVRSAGIIAQDLEKVLPVAVSSGGTGTTPAGEEINDLKTVDYSAMSALYVEAIKELTERLKIIEKELADLRGATVV

SEQ ID NO: 8268 - protein, 71 aa, Enterobacter cloacae
PVKGITGAVLRLIVLLADSVDLDAAFLSADQGCSGAYGLLLLNNASATGEQYRYRQAKNHIFHSGYIPGRS

SEQ ID NO: 8269 - protein, 131 aa, Enterobacter cloacae
RTGQHAGFASVAINQGSLTMAVETFSWCPKVASQVDTSFRTRKAQFGDGYAQVAGDGINPVTPQWSVSFTGDEAYIQAIKNFLNRHAGWKSFIWKPPLEPSGLWRAESFQISTHGNKKYTLSSTFIQAYHP

SEQ ID NO: 8270 - protein, 198 aa, Enterobacter cloacae
GFDVMERKTVIKLSGSMAQRFGRTHRRALTSASEVFRALSNTIDGFDAYLREARAKGLDFVIFRDRRNIGHEEFELLGPGDELRIIPVIRGSKRAGVFQALLGTALVAAAIWMPGVSIAASNLMFSVGAAMAVGGVVQMLSPQVSGLRMRQEPDNKPSYAFGGPVNTTASGNPVPLLYGQREIGGAIISAGVYAEDQQ

SEQ ID NO: 8271 - protein, 154 aa, Enterobacter cloacae
RRKRKTDMAYKRPVSVLVVIYAEDTKRVLMLQRRDDPDFWQSVTGSLEEGETAPQAAAREVKEEVAIDVAYEQLTLKDCQRTVEFEIFSHLRHRYAPGIERNTESWFCLALPHEREIVFTEHLTYRWVDAADAAALTKSWSNRQAIEEFVINAA

SEQ ID NO: 8272 - protein, 255 aa, Enterobacter cloacae
EGAIFGELFMAGHSKWANTKHRKAAQDAKRGKIFTKIIRELVTAARLGGGDPASNPRLRAAVDKALSNNMTRDTLNRAIARGVGGDEDANMETIIYEGYGPGGTAVMVECLSDNRNRTVAEVRHAFTKTGGNLGTDGSVAYLFSKKGVISFEKGDEDAIMEAALEAGAEDVVTYDDGAIDVYTAWEEMGAVRDALEAAGLKADNAEVSMIPSTKADMDAETAPKLLRLIDMLEDCDDVQEVYHNGEISDEVAATL

SEQ ID NO: 8273 - protein, 289 aa, Enterobacter cloacae
RGEKPGAAHGAYPAEAPCEPAGRRRGCAGHCDYPLSRQPECDANERVAAQSGARQVTIMTNQAGCLSSLFLLCRQIISSRTQERHVIGRLRGIIIEKQPPLVLLEVGGVGYEVHMPMTCFYELPEAGKEAVVFTQFVVREDAQLLYGFNNKQERTLFRELIKTNGVGPKLALAILSGMSAPQFVNAVEREDPAALIKLPGIGKKTAERLIVEMKDRFKGLHGDLFTPAADLVLTSPGAPASDDDAEQEAVAALVALGYKPQEASRMVSKIAKPDASSETLIREALRAAL

SEQ ID NO: 8274 - protein, 1163 aa, Enterobacter cloacae
MATLRELIIKISANSQSFQTEISRASRMGQDYYRTMQNGGRQAAAAARESERALSDLTAGFASAGRAAAAATAAFATGKLVQIADEWNSVNARLKQASSSADDFAASQRQLMEISQRTGTAFSDNANLFSRAAASMREFGYSSDEVLKITEAVSTGLKLSGANTQEASSVITQFSQALAQGVLRGEEFNAVNEAGDRVIRALAAGMGVARKDLKSMADQGQLTIDKVVPALMSQLGSLQGEFASMPQTVSGSLQKVTNSFMAWVGGVNQATGATDALSGGLDGVAQTLDSFTSSAVSGALSDVADNMSTITTVAGALVGVGLARYLSGVVTSATSATGALISAAKSEVALAVAQDKAAQSAVAASRAEVYRAQQAVQRSRSADVQAAQQEKIAAAEAKVTAAQARLTTALASGSATEKVRARTALERAQAGLVAAKNADAQAIAERRLASAEAARDRNLANRVTTQSNLNSVTSVGTRLLSSALGLIGGVPGLVMLGAGAWYAVYQNQEQARRSAQEYASTIDEVSKKTRAMTLPEASDNAEKTRAALNEQNRLIDEQKSKVESLKEQIAGYQSVISNPGPTTSGGFMINHLTYLDTVTRGLATATEQLSVEQERLAQMQQESASIQQVLEGLEHRRVALIREEAANQNRAYQSLLLMNGQHDEFNRLLGLGNQLLMARQGLANVPLRLPQADLDKKQTDALEKSRRDLELSRLKGEAKERLRLSYAADDLGLTSDPQFQTGRQELINNGLAEWRNNEANKPKAKGGKTEGEKTEDVYKRLIKQQKEQIALQGQNTELAKVKYQVSQGELASLTEAQKKTVLQNAALIDQVKLREQLRNYEANLADSNASARAANEAQLLGYGQGARFRERLQEQFNLRKEFEQKNTDLLRQRQAGEIDETFYQQGLALNKRYLEERLRDQEGYYAASDAQRDDWMTGLSEGYANWVDEATDYSSMAADGMKQAMGGAVTTITDMLNGNVDSWKDWGVSVLKIIQNVLVNMAVANGVSSIGSLFSFGASSAATASSGTAIQNAGANFTFNAKGNVYDSPSLSAYSNGVFQTPQLFAFAKGAGVFAEAGPEAIMPLTRAADGSLGVRAVGAPQVSGGVPSVNFGDINIQGGSPQAASQGTAGAAGRQLKDAITGVINEQASMPGSPLWRLIKGV

SEQ ID NO: 8275 - protein, 253 aa, Enterobacter cloacae
TAGLWGLPRRFTSERITMREKTVSAILAHAASSCPDECCGVVIQKGRVEKYIPCRNQAESPTEQFELSPEDYAAAEEQGTVVAIVHSHPGDGATTQPSELDMLMCDATELPWVIASWPEGDIRTVMPRGDRPLTGRQFVLGHADCWSLIMDYFRTEHGITLPNYSVDRHWWEQGENLYMDNWYECGFREFDGPSQPGDMVIMQVQSTVPNHAGILLEGNVLLHHMYGQLSQRIPYGGYYRDRTIKILRYKDLM

SEQ ID NO: 8276 - protein, 1290 aa, Enterobacter cloacae
RWLFYGRDMTTTIIKGRGKGGSNQTRTPIEAPDSIQSIARAKVLIALGEGEFAGGLDGKNIFLGDSSSYTPLQNADGSYNFNNVKYEFRSGTQDQDYIQGFPGIENELQVSYELKQAVPYVRAVSNTQLSALRIRLGWPTLLLQKNNGDKVGTRVEYAIDLSVDGGPYETVVNGAVDDKTTSLYERSHRVNLPKASTGWQLRVRRITPDSTSVNIVDTMRVVAVTEIIDAKLRYVNTALLYVEFDATQFPNGIPQVVCNPKGRIIRVPDTYDPETRTYSGTWEGVFKWAWTDNPAWIYYDIILNERFGLGQRIDATQIDKWELYRIAQYCDQLVPDGKGGSGTEPRFRCNVYIQDRNDAWTVLRDLAGIFRGMTYWGDNKMYVLADMPRDVWHIYNHASVVEGKFTFADPSETTRNTAALVNWSDPANHYKDTPEPVYDNDLAMRFDYRQLEMTAIGCTRQSEANRRGRWALLTNGIGEVVTFSTGMDVPPVGEVIGVAANELAGRTIGGRVSGVNGRNITLDRAADVKAGNRLFLNLPSGTAQARTVQAVNGNTVTVTTPYSETPEAECNWGVDSDDLFIALFRVTGTRDNNDGTFEVTGTTYNPDIYSAVDTGARLDERPVSVIPPGVQAPPGNIVVDSYSTVNQNIAITTMRVAWDSVQGAVAYEAEWRRDSGNWISVPRTSSLGFEVQGIYSGRYLVRVRAVNASDVSSVWVTSSEVNLTGKVGNPPKPVGFIASDNVVFGIELSWGFPANTDDTLKTEIQYSLTGTEDDAMLLADVPYPQRKYQQMGLKAGQTFWYRAQLVDRSGNESGYTDFVRGQASIDVSDITDAILEEIKDSEVFKDLIESAVDSNEKLAELSDAIKENADGLAAAVGSNKQTAEAIIGNALAIADVIVRQTAQQGANSATFEQLREVIATETEARVTDVTRLEAKTAQNEAGVTEVRQALSDEAQARATAVDQLTASTQVISDKADSASSKADAASGKADAAEQASSQNTADITTLRQVVTDTTSSMASRLEELGARTDTASGGIQNNAIALITSTLAQVDQRVRLSAQYGDSKASIDRLDNVMASDREATARSLLSLQTDVNGNKASINSLNQTFSDYQQATATQINGITATINGHTSAITTNAQAIANVNGDLKAMYSIKVGLSSNGQYYAAGMGIGVENTPSGMQSQVIFLADRFAVTHQAGATVTLPFVIQNGQVIIRDTVIGDATITRAKLAETISSVNYVQNQAGLSINFRTGTLENYGSTAGEGAMKQTNQTISVKDANNVLRVQIGRITGTW

SEQ ID NO: 8277 - protein, 201 aa, Enterobacter cloacae
FFCRKYWVKNMQIGYVRVSTNDQNTDLQRQALERAGCEQVFEEKMSGTVANRPALKKLLRTLNEGDTLVVWKLDRLGRSMRNLVLLVDELRQRGIHFKSLTDSIDTSSPMGRFIFHIMSALAEMERELIVERTRAGLAAAREKGRIGGRRPKLTPEQWAQAGRLIANGVDRKQVAIIYDVAVCTLYKKFPVNKDVTRTSTH

SEQ ID NO: 8278 - protein, 180 aa, Enterobacter cloacae
IRYRRRVMSIILGIDPGSRVTGYGVIRQVGRQLTYLGSGCIRTKVDDLPSRLKLIYAGVSEIITQFQPDYFAIEQVFMAKNADSALKLGQARGVAIVAAVNQDLPVFEYAARQVKQTVVGIGSAEKSQVQHMVRTLLKLPANPQADAADALAIAITHCHVSQNAMQMSESRLNLARGRLR

SEQ ID NO: 8279 - protein, 159 aa, Enterobacter cloacae
VFCRASDSATRQKGRGAGRMRPKHFQEKLKSSCQFKLAEVIECYNITFHAFITMISRIMLQKNTLLFAALSAALWGTTAQDVNAAVVASLKPLGFIASAIADGITETQVLLPDGASEHDYSLRPSDVKRLQNADLVVWIGPEMEGSIRSPSVDGGSAIV

SEQ ID NO: 8280 - protein, 284 aa, Enterobacter cloacae
ALRLMARGILPDIYPRQQEIYPQQYIHTGIPSMSISSDVQKLEPGKRVRLIEVDGSAFGAGILRFHNETIPHTEAEIIAAGGDESKLEPKSVWWQGEEYGAWPYELTGISVSSDGQSSRPSLTVANISGTIGSLCRRFQGMAKAKVIIHDTFAHYLDARNFPDGNPTANPNEERKQVYYIDRKSGSDDETVEFELSSPADLRGQLIPTRQIQPMCTWCMRGWYKTGNGCTYAGQNGWFDKDGNRVDDPSQDVCSGLLSTGCKPRFGENEQLDYGGFPGASLLRG

SEQ ID NO: 8281 - protein, 606 aa, Enterobacter cloacae
PARQATISLRLIKGYLMRTEYCGQLRQSHVGQQVTLCGWVNRRRDLGSLIFIDMRDREGIVQVFFDPDRADALKLASELRNEFCIQVTGTVRARDEKNVNADMATGAIEVLASDLTIINRAEALPLDSNHVNTEEARLKYRYLDLRRPEMAQRLKTRAKITSLVRRFMDDHGFLDIETPMLTKATPEGARDYLVPSRVHKGKFYALPQSPQLFKQLLMMSGFDRYYQIVKCFRDEDLRADRQPEFTQIDVETSFMTAEQVREVMEALVRSLWNDVKGVELGDFPIMTFAEAERRYGSDKPDLRNPMELVDVADLVKAVEFAVFAGPANDPKGRVAALRVPGGAALSRKQIDDYGNFIKIYGAKGLAYIKVTERAKGLEGITSPVAKFLNADIVEAILERTGAQDGDMIFFGADNKKVVADAMGALRLKLGKDLNLTDESKWAPLWVIDFPMFEDDGEGGLTAMHHPFTSPKDMTPAELKAAPEDAVANAYDMVINGYEVGGGSVRIHSGEMQQTVFGILGINEQEQREKFGFLLDALKYGTPPHAGLAFGLDRLTMLLTGTDNIRDVIAFPKTTAAACLMTEAPSFANPAALAELGIEVVKKEEKN

SEQ ID NO: 8282 - protein, 337 aa, Enterobacter cloacae
RMIEADRLVSAGTIQPDDVVDRAIRPKLLDEYIGQPQVRSQMEIFIQAAKLRGDALDHLLIFGPPGLGKTTLANIVANEMGVNLRTTSGPVLEKAGDLAAMLTNLEPHDVLFIDEIHRLSPVVEEVLYPAMEDYQLDIMIGEGPAARSIKIDLPPFTLIGATTRAGSLTSPLRDRFGIVQRLEFYQVPDLQHIVGRSARYMGLDMSEEGAFEVAKRSRGTPRIANRLLRRVRDFAEVKHDGTISAEIAAQALDMLNVDAEGFDYMDRKLLLAVLDKFFGGPVGLDNLAAAIGEERETIEDVLEPYLIQQGFLQRTPRGRMATVRAWNHFGITPPAMP

SEQ ID NO: 8283 - protein, 196 aa, Enterobacter cloacae
RRQRTTDRRAGSGPGSGRTDPDGRTGDSQPDDGAGTGRPVVPLPDDGRRVEARGADLQQGCEAAFLLRRVRTRRCAMSAYTVSQLAHNAGVSVHIVRDYLVRGLLRPVACTTGGYGVFDDAALQRLCFVRAAFEAGIGLDALARLCRALDAADGAQAAAQLAVLRQLVERRRAALAHLDAQLASMPAERAHEEALP

SEQ ID NO: 8284 - protein, 440 aa, Enterobacter cloacae
SAPISTMLNTRVHQSEVSMAADTPRIPEQGVATLPDEAWERARRRAEIISPLAQSETVGHEAADMAAQALGLSRRQVYVLIRRARQGSGLVTDLVPGQSGGGKGKGRLPEPVERVIHELLQKRFLTKQKRSLAAFHREVTQVCKAQKLRVPARNTVALRIASLDPRKVIRRREGQDAARDLQGVGGEPPAVTAPLEQVQIDHTVIDLIVVDDRDRQPIGRPYLTLAIDVFTRCVLGMVVTLEAPSAVSVGLCLVHVACDKRPWLEGLNVEMDWQMSGKPLLLYLDNAAEFKSEALRRGCEQHGIRLDYRPLGQPHYGGIVERIIGTAMQMIHDELPGTTFSNPDQRGDYDSENKAALTLRELERWLTLAVGTYHGSVHNGLLQPPAARWAEAVARVGVPAVVTRATSFLVDFLPILRRTLTRTGFVIDHIHYYADGHCCK

SEQ ID NO: 8285 - protein, 164 aa, Enterobacter cloacae
NVRPLNKTKGCLIANFATVPADALKPWIARRERWPSFLIRRDPRDISRIWVLEPEGQHYLEIPYRTLSHPAVTLWEQRQALAKLRQQGREQVDESALFRMIGQMREIVTSAQKATRKARRDADRRQHLKTSARPDKPVPPDTDIADPQADNLPPAKPFDQIEEW

SEQ ID NO: 8286 - protein, 520 aa, Enterobacter cloacae
HCFPSGYGGRNQGVINVAILSAIRRWHFRDGASIREIARRSGLSRNTVRKYLQSKVVEPQYPARDSVGKLSPFEPKLRQWLSTEHKKTKKLRRNLRSMYRDLVALGFTGSYDRVCAFARQWKDSEQFKAQTSGKGCFIPLRFACGEAFQFDWSEDFARIAGKQVKLQIAQFKLAHSRAFVLRAYYQQKHEMLFDAHWHAFQIFGGIPKRGIYDNMKTAVDSVGRGKERRVNQRFTAMVSHYLFDAQFCNPASGWEKGQIEKNVQDSRQRLWQGAPDFQSLADLNVWLEHRCKALWSELRHPELDQTVQEAFADEQGELMALPNAFDAFVEQTKRVTSTCLVHHEGNRYSVPASYANRAISLRIYADKLVMAAEGQHIAEHPRLFGSGHARRGHTQYDWHHYLSVLQKKPGALRNGAPFAELPPAFKKLQSILLQRPGGDRDMVEILALVLHHDEGAVLSAVELALECGKPSKEHVLNLLGRLTEEPPPKPIPIPKGLRLTLEPQANVNRYDSLRRAHDAA

SEQ ID NO: 8287 - protein, 339 aa, Enterobacter cloacae
QAMKTATAPLPPLRSVKVLDQLRERIRYLHYSLPTEQAYVHWVRAFIRFHGVRHPATLGSSEVEAFLSWLANERKVSVSTHRQALAALLFFYGKVLCTDLPWLQEIGRPRPSRRLPVVLTPDEVVRILGFLEGEHRLFAQLLYGTGMRISEGLQLRVKDLDFDHGTIIVREGKGSKDRALMLPESLAPSLREQLSRARAWWLKDQAEGRSGVALPDALERKYPRAGHSWPWFWVFAQHTHSTDPRSGVVRRHHMYDQTFQRAFKRAVEQAGITKPATPHTLRHSFATALLRSGYDIRTVQDLLGHSDVSTTMIYTHVLKVGGAGVRSPLDALPPLTSER

SEQ ID NO: 8288 - protein, 169 aa, Enterobacter cloacae
TSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 8289 - protein, 308 aa, Enterobacter cloacae
QTAARDAPTRFRLPVGCAGRVDLPLPSADSRRRAGRDDRRCLPWRALGCCRARADRLVRSGRNAAAARLPGRIMTSSQPAGWTAAELAQAAARGQLDLHYQPLVDLRDHRIAGAEALMRWRHPRLGLLPPGQFLPLAESFGLMPEIGAWVLGEACRQMHKWQGPAWQPFRLAINVSASQVGPTFDDEVKRVLADMALPAELLEIELTESVAFGNPALFASFDALRAIGVRFAADDFGTGYSCLQHLKCCPITTLKIDQSFVARLPDDARDQTIVRAVIQLAHGLGMDVIFRRRLHQLIGRNGCCAASS

SEQ ID NO: 8290 - protein, 245 aa, Enterobacter cloacae; identical to SEQ ID NO: 6695

SEQ ID NO: 8291 - protein, 91 aa, Enterobacter cloacae
PVGKSLRADDAAGMGGQRRLLLTAGQLRRFAPAAPAFPNCHAGHGSLPAHTQRGHHRGTGALADGGGHRRRGERRGSDQPSHTQHGLLSCI

SEQ ID NO: 8292 - protein, 67 aa, Enterobacter cloacae
RPLWIRWGVAKSAGSISGSLPWSATTCLMRSSVIQHRVGRKARLRRTCRIPANACGKGHQTFKALLI

SEQ ID NO: 8293 - protein, 264 aa, Enterobacter cloacae
GEPMMQHEGHVRILKSLKLFGMAHAIEELGNQNSPAFNQALPMLDSLIKAEVAEREVRSVNYQLRVAKFPVYRDLVGFDFSQSLVNEATVKQLHRCDFMEQAQNVVLIGGPGTGKTHLATAIGTQAVMHLNRRVRFFSTVDLVNALEQEKSSGRQGQIANRLLYADLVILDELGYLPFSQTGGALLFHLLSKLYEKTSVILTTNLSFSEWSRVFGDEKMTTALLDRLTHHCHILETGNESYRFKHSSTQNKQEEKQTRKLKIET

SEQ ID NO: 8294 - protein, 115 aa, Enterobacter cloacae
KPPLRRYHRCVRSRFWTSCVSAYATCITAYQPNRLMSTGFVPSSVSTVCVTRQPWAAAKSRHFCPGWRTSARFRSPRIVRHWRPCCSSTARCCARICPGFRRSEDLARRGACRWC

SEQ ID NO: 8295 - protein, 1007 aa, Enterobacter cloacae
LRHQPRNLVPVPAGRLTMPRRSILSATERESLLALPDAKDELIRHYTFNETDLSVIRQRRGAANRLGFAVQLCYLRFPGTFLGVDEPPFPPLLRMVAAQLKMPVESWSEYGQREQTRREHLVELQTVFGFKPFTMSHYRQAVHTLTELALQTDKGIVLASALVENLRRQSIILPAMNAIERASAEAITRANRRIYAALTDSLLSPHRQRLDELLKRKDGSKVTWLAWLRQSPAKPNSRHMLEHIERLKSWQALDLPAGIERQVHQNRLLKIAREGGQMTPADLAKFEVQRRYATLVALAIEGMATVTDEIIDLHDRIIGKLFNAAKNKHQQQFQASGKAINDKVRMYGRIGQALIEAKQSGSDPFAAIEAVMPWDTFAASVTEAQTLARPADFDFLHHIGESYATLRRYAPQFLGVLKLRAAPAAKGVLDAIDMLRGMNSDSARKVPADAPTAFIKPRWAKLVLTDDGIDRRYYELCALSELKNALRSGDVWVQGSRQFKDFDEYLVPVEKFATLKLASELPLAVATDCDQYLHDRLELLEAQLATVNRMAAANDLPDAIITTASGLKITPLDAAVPDAAQAMIDQTAMLLPHLKITELLMEVDEWTGFTRHFTHLKTSDTAKDKTLLLTTILADAINLGLTKMAESCPGTTYAKLSWLQAWHIRDETYSTALAELVNAQFRQPFAGNWGDGTTSSSDGQNFRTGSKAESTGHINPKYGSSPGRTFYTHISDQYAPFSAKVVNVGIRDSTYVLDGLLYHESDLRIEEHYTDTAGFTDHVFGLMHLLGFRFAPRIRDLGETKLFIPKGDAAYDALKPMISSDRLNIKQIRAHWDEILRLATSIKQGTVTASLMLRKLGSYPRQNGLAVALRELGRIERTLFILDWLQSVELRRRVHAGLNKGEARNALARAVFFYRLGEIRDRSFEQQRYRASGLNLVTAAIVLWNTVYLERATSALRGNGTALDDTLLQYLSPLGWEHINLTGDYLWRSSAKVGAGKFRPLRPLPPA

SEQ ID NO: 8296 - protein, 343 aa, Enterobacter cloacae
GQAFIRRTIMENIALIGIDLGKNSFHIHCQDHRGKAVYRKKFTRPKLIEFLATCPATTIAMEACGGSHFMARKLEELGHFPKLISPQFVRPFVKSNKNDFVDAEAICEAASRPSMRFVQPRTESQQAMRALHRVRESLVQDKVKTTNQMHAFLLEFGISVPRGAAVISRLSTLLEDSSLPLYLSQLLLKLQQHYHYLVEQIKDLESQLKRKLDEDEVGQRLLSIPCVGTLTASTISTEIGDGKQYASSRDFAAATGLVPRQYSTGGRTTLLGISKRGNKKIRTLLVQCARVFIQKLEHQSGKLADWVRELLCRKSNFVVTCALANKLARIAWALTARQQTYEA

SEQ ID NO: 8297 - protein, 186 aa, Enterobacter cloacae
RWGERTYRARLPGARLVTAGGLHHGRLRRVRRCGLATAVLRARGLRGGYRPGCPGAAVPCARRSGRRTSRSAACRAAPVGRAAARGVGPSGRATGLHASRAGARGGIAVNAPDKLPPETRQPVSGYLWGALAVLTCPCHLPILAAVLAGTTAGAFLGEHWGVAALALTGLFVLAVTRLLRAFRGGS

SEQ ID NO: 8298 - protein, 290 aa, Enterobacter cloacae
GVVAVDEYPIIDLSHLLPAAQGLARLPADERIQRLRADRWIGYPRAVEALNRLEALYAWPNKQRMPNLLLVGPTNNGKSMIVEKFRRTHPASSDADQEHIPVLVVQMPSEPSVIRFYVALLAAMGAPLRPRPRLPEMEQLALALLRKVGVRMLVIDELHNVLAGNSVNRREFLNLLRFLGNELRIPLVGVGTRDAYLAIRSDDQLENRFEPMMLPVWEANDDCCSLLASFAASLPLRRPSPIATLDMARYLLTRSEGTIGELAHLLMAAAIVAVESGEEAINHRTLSMAC

SEQ ID NO: 8299 - protein, 205 aa, Enterobacter cloacae
LTYSVKGNRFHPDTFAFGGILQGQRIGYVRVSSFDQNPERQLEGVQVARVFTDKASGKDTQRPELERLLAFVREGDTVVVHSMDRLARNLDDLRRIVQGLTQRGVRMEFVKEGLKFTGEDSPMANLMLSVMGAFAEFERALIRERQREGIVLAKQRGAYRGRKKSLNSEQIAELKRRVAAGDQKTLVARDFGISRETLYQYLRED

SEQ ID NO: 8300 - protein, 144 aa, Enterobacter cloacae
AHSGTANFQHMRVNHRRRDVGMAEQILHGSNVVTAAEQGRRERVAEGVRCGGLRDACLFYGTFEGALKGLVIHVMATHDTAPWIGRMRVLRKNPEPRPGMPGARILPLKGVGKRNAAAALGLVLQPPCPCTRQLLAQAGCQALG

SEQ ID NO: 8301 - protein, 148 aa, Enterobacter cloacae
HQGPILGALALPHDDRAVIEIQILDPQLQTLTDPHARSIQKLGEQTMLAFQKTEDANHFIRGQHHRQAPRRARSSDLLKPGQIRAQHLAVEEQQGRQCLTMRGDRNLALVRQPGQKCLDFAAAQGCRVTHTVETDEGTNPVDISLFGW

SEQ ID NO: 8302 - protein, 309 aa, Enterobacter cloacae
CVGLCRYGAHNCCLFARPIPIVEVAAEADAMVTVFGILNLTEDSFFDESRRLDPAGAVTAAIEMLRVGSDVVDVGPAASHPDARPVSPADEIRRIAPLLDALSDQMHRVSIDSFQPETQRYALKRGVGYLNDIQGFPDPALYPDIAEADCRLVVMHSAQRDGIATRTGHLRPEDALDEIVRFFEARVSALRRSGVAADRLILDPGMGFFLSPAPETSLHVLSNLQKLKSALGLPLLVSVSRKSFLGATVGLPVKDLGPASLAAELHAIGNGADYVRTHAPGDLRSAITFSETLAKFRSRDARDRGLDHA

SEQ ID NO: 8303 - protein, 250 aa, Enterobacter cloacae
RMRSRNWSRTLTERSGGNGAVAVFMACYDCFFVQSMPRASKQQARYAVGRCLMLWSSNDVTQQGSRPKTKLGRMDTTQVTLIHKILAAADERNLPLWIGGGWAIDARLGRVTRKHDDIDLTFPGERRGELEAIVEMLGGRVMEELDYGFLAEIGDELLDCEPAWWADEAYEIAEAPQGSCPEAAEGVIAGRPVRCNSWEAIIWDYFYYADEVPPVDWPTKHIESYRLACTSLGAEKVEVLRAAFRSRYAA

SEQ ID NO: 8304 - protein, 128 aa, Enterobacter cloacae
ACIISPTQIGRYIMKGWLFLVIAIVGEVIATSALKSSEGFTKLAPSAVVIIGYGIAFYFLSLVLKSIPVGVAYAVWSGLGVVIITAIAWLLHGQKLDAWGFVGMGLIIAAFLLARSPSWKSLRRPTPW

SEQ ID NO: 8305 - protein, 200 aa, Enterobacter cloacae
RTLVRFREGGRRHAGLVRIKLHYEAAVHTAPGERMDSEEPPNVRVACSGDIDEVVRLMHDAAAWMSAKGTPAWDVARIDRTFAETFVLRSELLVASCSDGIVGCCTLSAEDPEFWPDALKGEAAYLHKLAVRRTHAGRGVSSALIEACRHAARTQGCAKLRLDCHPNLRGLYERLGFTHVDTFNPGWDPTFIAERLELEI

SEQ ID NO: 8306 - protein, 136 aa, Enterobacter cloacae
SSKGLPLICQSISTFSPSSQGRLSQATCTRHRPTETADGASSVTTMPSTQRVNTSMARVRYGRPIGCRSRSSTTIRSMTVWSICTCSSGAVTAGGSPPTPCRSRAASWPSRRRMTLRGSRLAIRKATVLRAGTRSF

SEQ ID NO: 8307 - protein, 67 aa, Enterobacter cloacae
KAARLRFCLVRNRFCSSSWMTRSTGSGKRPLPLPPPDWPGTRSVTRPLPCRARRIRTYTWRRDKPSA

SEQ ID NO: 8308 - protein, 69 aa, Enterobacter cloacae
AAISAASCPTVSDCANGLMISARRRARSQASSGRVATPCSGIRGVSAAMLTSLWCTRVLSIVEIGADHF

SEQ ID NO: 8309 - protein, 158 aa, Enterobacter cloacae
SAPEGAQQPRYGQNEQAGQRERGNTPMLAKEGTGGRPGQHGGENRQMAGAGQHGQRTPQVAGNGLARLGRQFVRGVHGNASSCARSAGMEASCASRWANAARRRSTNWRSTASCAAACAPSAASSARHSRARASRPIPASKAARTKHSRCKAASSNTP

SEQ ID NO: 8310 - protein, 136 aa, Enterobacter cloacae
GRMSEALKSLNNIRTLRAQGRELPLEVLEEILEKLNVIVDERRQEESSKAAELQARQEKLDALRKLMEEDGINPEELLGSFQAKSTATKKSREPRPAKYSFTDENGETKTWTGQGRTPKALAEQIAAGKSLDDFLI

SEQ ID NO: 8311 - protein, 515 aa, Enterobacter cloacae
FMYSYEDRLRAVRLYLKLGRRMSATLRQLGYPTKNSLKAWLAEFERNQDLRRGYQRIKRQYTDEQKQRAVDHYIEQGYCLSHTIRSLGYPSREALRAWIRDLRPEFARTVVGSSAPTVARSRLEKQQAVIALNLRVGSAKDVADTVGVSRPTLYNWQHRLLGKVPLKPMTKKKGDTSLEQRHEALLRELAELESQNQRLRMENAILEKASELIKKDMGINPLELTSREKTKVVDALRVTFPLANLLCGLKLARSTYFYQRLRQTRPDKYTQVREVIRTIFEDNYRCYGYRRIDSALRLGGMRVSEKVVRRLMAQERLVVRTPRRRRFSAYAGDPTPAVPNLLNRDFHASAPNTKWLTDLTEIHIPAGKVYVSPIVDCFDGLVVAWNIGTSPDANLVNTMLDHAVRTLRPGEHPVIHSDRGSHYRWPAWIRRTENAQLTRSMSKKGCSPDNAACEGFFGRLKTELIYPRNWQHVTLKDLMTRIDAYIHWYNERRIKVSLGGRSPIEYRHAVGLMSV

SEQ ID NO: 8312 - protein, 237 aa, Enterobacter cloacae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAHRRSSGCGR

SEQ ID NO: 8313 - protein, 410 aa, Enterobacter cloacae
PSIIKEIIMGFRFRKSINIIPGVRLNLSNGAPSLSVGPRGASVSFGSRGTYANLGLPGTGLSYRTRLDRAARSGGGNRTATDPGLRQALEQEAAELMSAVTAIRNIHELTPDPKTGISWAELEAVYLHNRTSPFQVPAPVRPEKPDYLALPEKPAESEGISFLGKWFESESAKAERHAENLRRWQQELIDVERENTLRQHRYQQQRTAWAEQYANWKFEAEEHEKRLATAQADARQQFRTDAAFFESYLAGVLAETEWPRETIVAFEVKPELSAVLLDVDLAEIEDFPDKIYGVNARGTELTEKAMTQKAVRENYARHVHGCLFRLVGIVLHTLPFDNVIVSGFTQRVSKRTGYLEDEYILSCKCTRSQMSSVNFAGIEHIDPVEALGDHPVIRKMSSTFIFQPIEPLTL

SEQ ID NO: 8314 - protein, 216 aa, Enterobacter cloacae
GDIMSVSLSKGQGVSLKKNEYDLSSVTIGLGWDINEEKKGFLGGIFGKKEEEYDLDVIAFLCNSAGKVTDLGNVENGKPTLVNGDIIFFNSLRHKSGNIWLTGDNRTGAGDGDDEQIIVRLNSLDAQYEKIVFIVQIYNGEKLQQHFGKVQNAFIRAVDARNIEMARFDLSGGPAFASQRSMVFAELIREATGWKLRAIGEPSESDSFVSHLRNYM

SEQ ID NO: 8315 - protein, 383 aa, Enterobacter cloacae
GVFMSDILEDMIYRRTLSCGTIQVTRDQGEVSLDDLFDIAERRNPKRAFLFVSKVLGRHIPVPPSVMRQAYRQLASQFPSTLTGPVLFIGMAETAVGLGAGVFDEVRHQHPESVYLTSTRHPVDGTLLCEFKEEHSHATDHLIYLPDDEEKRRRVTNARTLVLIDDEATTGNTFINLLSALRNTGKLQHIEQVIAVTLTDWSGKALSERSTLPVTSVSLVSGKWGWTPLPDAPVPDMPKVNVTSRGEWDIQGKQSWGRLGMLAPAADLGHEVSVHKGERILVLGTGEFVWEPFLLAERLEAAGAQAFYGSTTRSPIAVGYAIESAISFTDNYGLGIPNFVYNVAHQQFDRILVCTETPAESIDTQLLKALAEVAAVVEIVTYE

SEQ ID NO: 8316 - protein, 61 aa, Enterobacter cloacae
RLHFMLQHPILINRPIVVTPLGTRLCRPSEVVLDILPDAQKHAFTKEDGEKVVDDAGKRLK

SEQ ID NO: 8317 - protein, 92 aa, Enterobacter cloacae
SASWRGAICLSRCRLPRSATARGAGRGGCGLADRRASRQGKNLEAASAQEQNGHQHRIHENQHPCQGGAPVSHHQAAVRLRESQIQGAAEKR

SEQ ID NO: 8318 - protein, 396 aa, Enterobacter cloacae
LHEENGTSRENSPGADWGCSHLRPISAMRSPSTRGNVFWFSGPGNSSGSRSCLLNGSKLPEHRHFMDRPPAPLSPLVMPLSPPFPLRITTGWASPILSITSPTSSLTAFLCVLRHPQKVLTRSFLKRWLRLRPSWRLLPMNKPVVLSDLDDTLFQTRRKMVDELALEPFRTGAVDRTLNPRSFMTEEQSMLVDWLLEQAELIPVTARGTEEISRVRIPFHSWAITTHGAVILTPEGKPDEEWKAHMLGQLAPYQEKLTSMQRLITEMMDAKGINAWARLNFEYGETAVYMVMKHRDSTRLDELNAIADEIETVFPTEGFYIHRNSNNVAWLPTAVEKGLAVRWLLEKLRAERGVFPVIGLGDSLSDHRFMKLCSWFGIPRQSQFADAISQRIFGEN

SEQ ID NO: 8319 - protein, 344 aa, Enterobacter cloacae
KGNSCYRNGGNPRPVSGCNHYQEGTLMKNRLSPWNLGATLYMPATREDIADAVLHGKIPGLRSLVICLEDAVSEADIPIALKNLEHLLHELSNSMRSLGKNDWPLVFIRPRHAEMGRWLKAHYDLSAVDGFVLPKFTLSSLAEWWDIMGGTHLCMMPTLETEDVFDVVQMRELATRLVEHPCHDRIIALRIGGNDLMNVVSLRRPRDLTLYDSPMGYVIKMLVSVFGPRDFALTAPVCEHIDDHAVMARELALDMAHGLVGKTAIHPGQIEVIQNALMVTQGEYSDALRILNSTQAVFKSQGAMCEPATHRRWAAGILDRARFYGLQNEQSADGIRLLTVTQHH

SEQ ID NO: 8320 - protein, 166 aa, Enterobacter cloacae
TTNPLSRLNLTMQLNTRQARIFKLANLLGTGKPVSAADIITSLECSEPTLTRALKELRESYSAEIKYSKAGHSYHLVNPGQLDKKTLRRMNEALAQNAELKTGESTGKVVLDKDKKTAVSLSLRMRILRKIDRLAALSGSTRSEAVEKLALHSVDELIKEYSAKKS

SEQ ID NO: 8321 - protein, 248 aa, Enterobacter cloacae
VFNLHPTDVVPFYQINKPWPLPETTLLFRSLKKELHLRRLPVYLLLDTSGSMHGEPIEAVKNGVQTLLTTLKQDPYALETAHVSVITFDSSARQAVPLTDLLSFQMPALTASGTTSLGEALSLTASSIAKEVQKTTADTKGDWRPLVFLMTDGSPNDDWRKGLNDFKAARTGVVVACAAGHDADTSVLKEITEIVVQLDTADSSTIKAFFKWVSASISVGSQKVESSKKEVIGLEDLPPPPPEVNVVL

SEQ ID NO: 8322 - protein, 228 aa, Enterobacter cloacae
AFRIRFVCLAPEELHVMRRLPVYLVIDTSGSMRGESIHSVNVGIQAMLSALRQDPYALESVHISIITYDNEAREFIPLTPLEDFQFSDIVVPSAGGTFTGAALECLMQCVERDVRRSDGDTKGDWRPLVFLMTDGTPSDALAYGEAVKAIRGRGFGSIIACAVGPKAGHEHLKQLTDKVVSLETLDSTAFAGFFKWVSASVSSGSTSAGINNGTDTLPPPPPEIQLVL

SEQ ID NO: 8323 - protein, 374 aa, Enterobacter cloacae
QTERCCFRAAPFCTATFSAGRTSRTRKIMRRLPVFFVLDCSESMIGENLKKMTDGLQMIVGDLRKDPHALETAWVSVIAFAGVARTIVPLHEIASFYPPRLPVGGGTSLGAALRELTVQIDTQVRKTTHEAKGDWKPVVYLLTDGRPTDDTTAEVKRWKDHYASKVNLIAVGLGPSADLNILRQLTENVMLFTESQEGDFTRFIKWITASVTAHSRSVGDDKQPELSQTEYIVRLAKDEPVKAYDENCVTLTGRCSKTRRPYLMKYERPPARVSGLDFSLNLNSFNIAGCYPIDEDYFAWSDATATGLQVNTSELHGVPGCPHCGNASAFALCSCGKLLCIDGPDDVICPWCETGLSFSNDGGNTNFDVNRGRG

SEQ ID NO: 8324 - protein, 529 aa, Enterobacter cloacae
ATGLTFSPQGTMMTALLRCCGKGYAFSVINMANIVTCKTKDGETVQYVDEVIGSGSMKDVYFSPDKSYVVAFYHKPQNEQARDRIDMITGRYRQNIFGQSGGEYWKDLFCWPTHVVEHGHKIGIVVPTYKSYFFFKYGSKNDDFLGIKGREKEGKWFASASNQNKFLDPRERGNTLTYLKVCLLLTRAVRRMHAAGLCHSDLSYKNVLIDPEMGHACIIDVDGLVVPGKYPPDVVGTPDFIAPEVVKTSHLSKEDPNRVLPSITTDRHALSVLIYMYLFFRHPLRGGKIHDMSDEVRDETLSMGEKALFIEHPTDKSNAVKVSQLSSFSLPWADPEKIPYTIMGPYLTPLFERAFIDGLHDATKRPTADEWESALVKTVDLIQPCQNKACEQKWYVFSGKTKPVCPYCGTPYKGKLPVLNLYSSRKEGSYRPDDHRLMVWSGQSIYAWHVNRLIAPNERTTDAQRKRVGYFVFHNDQWWLVNEGINRLMSLPDKRQIAIGEKIELTNNAQFVLSKEEGGRLVVVQLVEN

SEQ ID NO: 8325 - protein, 341 aa, Enterobacter cloacae
YEIIIFIRSASQRDIMSHQLTFADSEFSTKRRQTRKEIFLSRMEQILPWQNMTAVIEPFYPKAGNGRRPYPLETMLRIHCMQHWYNLSDGAMEDALYEIASMRLFARLSLDSALPDRTTIMNFRHLLEQHQLARQLFKTINRWLAEAGVIMTQGTLVDATIIEAPSSTKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVKTLKQHPRKNKTAINIEYMKTSIRAKVEHPFRIIKRQFGFVKARYKGLLKNDNQLAMLFTLANLFRVDQMIRQWERSQ

SEQ ID NO: 8326 - protein, 411 aa, Enterobacter cloacae
RLVGILPPIRCLCNSSARRPVDDTAGLCKSLPGYSFLFFVRYTMSKLFTPYNLSGLALKNRVVMAPMTRTRTMNDVPDEVVALYYAQRASAGLLITEGMPVSEEGRGYLYTPGIYNDEHVQGWRKVTQAVHAKGGCIFAQLWHVGRMSHVSLQPGHIAPVSAGTVQAVNTTVFALTESGEPGPVVPSQPRALETHEVKRITADFVHSARLAMEAGFDGVEIMAANGFIFDQFLSSELNTRTDEYGGSVENRQRFLLETIDAVAEAVGNSHVAVRLSPFGRIYDLAPYEGEEQTWSAITDALGQRELAYVHLYYQPVYTKAPLPEGFRRRFRNTFKGTIIAAGGFTRDIAEQALEDDELDLVAFGVPYIANPDLVERMQNGWPLAESDRATYYGVSGSPEKGYTDYPVWQAQ

SEQ ID NO: 8327 - protein, 139 aa, Enterobacter cloacae; identical to SEQ ID NO: 5889

SEQ ID NO: 8328 - protein, 261 aa, Enterobacter cloacae
WSQKMNTFFKGKKLLVVGGTSGMGLAVARMVLEAGGSVVLTGNKKDKAEAVQKELSPLGPVAVIAANLMTEEGMETIRQEINAHHRDISLMVNAAGIFMPKGFTEHSFADYDMYLSLNRATFFITQDVVKNMLAAKLEGSIVNVGSIGAQAALGDSPASAYSMAKAGLHALTRNLAIELASAGIRVNAVSPGIVHTPIYEGFMDKADIADAMKSLSDFHPLGRVGTAEDVANTILFLLSDKTSWVTGAIWDVDAGIMAVRR

SEQ ID NO: 8329 - protein, 99 aa, Enterobacter cloacae
AVGQATLGIDTNVGLHAKVPLIAFLGLMHLRIALLLFVLGRAGCLNDGGIHQSALGHNDACFGQPAIDGLEQLTGQLMLLEQVAEIHDGGAIRQGAIQG

SEQ ID NO: 8330 - protein, 127 aa, Enterobacter cloacae
SGKQAHGGDFVQGIFHGTVAQVVPMLHAVNTQHGLQRIGPSAIARLGIKRLDDSGHILPWQNLLHAGEENLFSGLTALSAEFTIGEGELMAHDVPLGCAPDEYDDLISGTCSHLPLYRHHSFLHMTH

SEQ ID NO: 8331 - protein, 236 aa, Enterobacter cloacae
GIIMQTLKPTLTIDIWSDLVCPWCWIAKKRFEQGLNRFEFRDQVVIRHHSYRLAGGTPAMPFKDAIVKKLGSQHSAELMMNQVGTAGKSECLIYNFDGMMFGDTEDAHTLLVAARKAGIADAVEERFYHGSITEGRSLFDRQQLVAMAVEAGMPKADAEAALENDDFRATVSDDEAHAQSIGLSGVPVFVMNEKYAISGAQAADNFLNALRQVWDEQQTEFSATAGQTCGTDGCSI

SEQ ID NO: 8332 - protein, 160 aa, Enterobacter cloacae
TRRSSLPRGHDMRGDCRRCQPASVRGFITCTSENADPRADREEPMIPLPSGTRIWLVAGVTDMRKSFNGLGELVQHVLDDNPFSGHLFIFRGRKGDTVRILWADADGLCLFTKRLEEGQFVWPAVRDGKIAITRSQLAMLLDKLDWRQPKTARLNSLTML

SEQ ID NO: 8333 - protein, 540 aa, Enterobacter cloacae
KAHDRIINGVMSQDYLARIAALEDALRQKDSQLSLVAETESFLRSALARAEEKIENEEREIEYLRAQIEKLRRMLFGTRSEKLRRQVEEAEALLKQQEQQSDRYNGRDNDQQVPRQLRQSRHRRPLPEHLPREINRLEPAETSCPGCGSDMAYLSEVSAEQLELVSSALKVIRTVRVKKACTRCDCVVEAPAPSRPIDRGIAGPGLLARVLTAKYCEHLPLYRQCEIFARQGVDLSRALLSNWVDACCRLMAPLDEALYHYVMDCRKLHTDDTPVPVLAPGRKKTKTGRIWTYVRDNRSAGSSDPPAAWFAFSPDRQGKHPQQHLRHYHGVLQADAFAGYDRLFSAEREGGPLTEAACWAHARRKIHDVYISTRTATAEEALKRISELYAIEEEIRGLPASQRLAARRSRSKPLLISLHDWLVEKRATLSKKSRLGEAFAYALNQWDALCYYCDDGLAEPDNNAAERALRAVCLGKKNYIFFGSDHGGERGALLYGLIGTCRLNGIDPEGYLRHILSVLPEWPINKVAELLPWNVDLTNK

SEQ ID NO: 8334 - protein, 275 aa, Enterobacter cloacae
TMQQLQNVIESAFERRADITPANVDTVTREAVNQVISLLDSGALRVAEKIDGQWVTHQWLKKAVLLSFRINDNQVIDGAESRYFDKVPMKFADYDEARFQKEGFRVVPPAAVRQGAFIARNTVLMPSYVNIGAYVDEGTMVDTWATVGSCAQIGKNVHLSGGVGIGGVLEPLQANPTIIEDNCFIGARSEVVEGVIVEEGSVISMGVYIGQSTRIYDRETGEIHYGRVPAGSVVVSGNLPSKDGKYSLYCAVIVKKVDAKTRGKVGINELLRTID

SEQ ID NO: 8335 - protein, 140 aa, Enterobacter cloacae
LFIGYVEIKGTAMYDNLKSLGITNPDEIDRYSLRQEANNDILKIYFHKDKGEFFAKSVKFKYPRQRKTVVADGIGQGYKEVQEISPNLRYVIDELDQICQRDRSEVDLKRKILDDLRHLESVVTNKISEIEADLEKLTRK

SEQ ID NO: 8336 - protein, 913 aa, Enterobacter cloacae
VIRSRRMPAFLMAIAFSYGWRTMSNLLPEQYANTALPTLPDQPDNPGVWPPHELTCAHIKAHMEVFHRWLGSAFDAGVSAEQLIEARTEFIDQLLQRLWIDYGFGQVSDVALVAVGGYGRGELHPLSDIDLLILSRKKLPDDRAQKIGELLTLLWDVKLEVGHSVRTLEECLLEGLSDLTVATNLIETRLLIGDVALFLELQKHIFSDGFWPSEKFFAAKVEEQNQRHQRYHGTSYNLEPDIKSSPGGLRDIHTLQWVARRHFGATSLDEMVGFGFLTEAERNELNECLHLLWRIRFALHLEVTRYDNRLLFDRQLSVAQRLNYQGEGNEPVEQMMKDFFRVTRRVSELNQMLLQLFDEAILALTADEKPRPIDDEFQLRGTLIDLRDETLFIREPEAILRMFYTMVRNSTITGIYSTTLRHLRHARRHLKQPLCYIPEARSLFLRMLRHPGAVSRGLLPMHRHSVLWAYMPQWSHIVGQMQFDLFHAYTVDEHTIRVMLKLESFAKEETRSRHPLCVDLWPRLAHPELILIAALFHDIAKGRGGDHSVLGAQDVLKFAELHGLNSRETQLIAWLVRHHLLMSVTAQRRDIQDPEVIKQFAEEVQTENRLRYLVCLTVADICATNETLWNSWKQSLLRELYFATEKQLRRGMQNTPDMRERVRHHQLQALALLRMDNINEEALHQIWARCRANYFVRHSPNQLAWHVRHLLKHDLTKPMILLSPQATRGGTEIFIWSPDRPYLFAAVCAELDRRNLSVHDAQIFTTRDGMAMDTFIVLEPDGSPLSSDRHEGIRFGLEQAITQRSWQPPQPRRQAAKLRHFTVDTEVNFLPTHTDRKSFLELIALDQPGLLARVGQVFADLGISLHGARITTIGERVEDLFIIATADRRALNNDLQLEVQQRLTAALNPNDKG

SEQ ID NO: 8337 - protein, 248 aa, Enterobacter cloacae
PHDRLCILTRHIASKSMKIGIIGAMEEEVTLLRDKIENRQTLSLGGCEIYTGQLNGVDVALLKSGIGKVAAALGATLLLERCKPDVIINTGSAGGLAPTLKVGDIVVSDEARYHDADVTAFGYEYGQLPGCPAGFKADDKLIAAAESCINELNLNAVRGLIVSGDAFINGSVGLAKIRHNFPQAVAVEMEATAIAHVCHNFSVPFVVVRAISDVADQQSHISFDEFLAVAAKQSTVMVETLVQKLARG

SEQ ID NO: 8338 - protein, 240 aa, Enterobacter cloacae
TRQPAYYPRRKTTLRRTGRESLKQINTPFEDLTMLVYWLDILGTAVFAISGVLLAGKLRMDPFGVLVLGVVTAVGGGTIRDMALANGPVFWVKDPTDLVVAMVTCLLTIVLVRQPRRLPKWILPVLDAVGLAVFVGIGVNKAFIAGTGPLVAICMGVLTGVGGGIIRDILAREVPMILRTEIYATACIIGGIVHATAYYTFAVPLENAAMLGMVVTLVIRLAAIRWHLKLPTFALDENSR

SEQ ID NO: 8339 - protein, 276 aa, Enterobacter cloacae
YCRKNRHRWTDYMAISIKTPEEIEKMRVAGRLAADVLEMIEPFVKPGVSTGELDRICNDYIVNEQHAISACLGYHGFPKSVCISINEVVCHGIPDDEKLLKDGDIVNIDVTVIKDDYHGDTSKMFIVGKPTILGERLCKVTQESLYLALKMVKPGIRLRTIGAAIQKFVEAEGFSVVREYCGHGIGRVFHEEPQVLHYDADDGGVVLQKGMTFTIEPMVNAGDYRIRTMKDGWTVKTKDRSLSAQYEHTIVVTDNGCEIMTLRKDDTIPAILTNIE

SEQ ID NO: 8340 - protein, 279 aa, Enterobacter cloacae
WWKPWCRNWRVGKVSFRALVALLLFAPAWLIAAPRVITLSPANTELAFAAGITPVAVSSFSDYPPQAAQIEQVATWQGMNLERIVALKPDLVLAWRGGNAERQVNQLSSLGITVKWVDAVSIEQVSQTLRDLAPFSPTPQRAGQAAQQMLNDYAALKARYGTQPKQRVFLQFGSQPLFTTGKGSIQNQVLETCGGENIFAESRVPWPQVSREQVLARQPQAIVVVGNASEIPKIEQFWHRQLKIPVIALNSDWFERASPRIILAAKQLCAELAESHSNR

SEQ ID NO: 8341 - protein, 119 aa, Enterobacter cloacae
FSSGAPGGIFAPMLALGTLLGTAFGMAAAVGFPAYHLDAGTFAVAGMGALLAASLRAPLTGIVLVLEMTDNYQLILPMIITCLGATLLAQFLGGKPLYSTILARTLAKQEAEQALKQNT

SEQ ID NO: 8342 - protein, 514 aa, Enterobacter cloacae
GETHSHAGEHMAPIDFRTKINWHRRFRSPQGDKSEHEILRIFESDRGRIINSPAIRRLQQKTQVFPLERNAAVRTRLTHSMEVQQVGRYIAKEILSRLKEQRLLETYGLDELTGPFESIVEMACLMHDIGNPPFGHFGEAAINDWFKQRLFPSDAISQPLSDDRCVVRDLSLREGEDSLNDLRRKVRQDLCHFEGNAQGIRLVHSLMRMNLTWAQVGCILKYTRPAWWTGETPATHSYLMKKPGYYLSEEAYIARLRKELSLTPNGRFPLTWIMEAADDISYCVADLEDAVEKRIFSVEELYQHLHDAWGEHEKGSLFAQVVENAWDKSRSNSLSRSTEDQFFMYLRVNTLNKLVPYAAARFIDNLPMIFSGEFNHALLEDESSFSQLLELYKNVAVRHVFSHPDVEQLELQGYRVISGLLEIYGPLLQLTVDEFCELVENERVRRLPIESRLYQKLSTRHRLAYIEAVSKIDRHSSQWPVMEYYYRCRLIQDYISGMTDLYAWDEYRKLMAVE

SEQ ID NO: 8343 - protein, 496 aa, Enterobacter cloacae
NESELHSNFALSGKSRLRNMKKTTLAMSALALSLGLALSPLATAAETASSAATAQQMPSLAPMLEKVMPSVVSINVEGSTTVNTPRMPRNFQQFFGDNSPFCQDGSPFQSSPFCQGGGAGDDGMGGGQQQKFMALGSGVIIDAAKGYVVTNNHVVDNANTIKVQMSDGRKFDAKVVGKDPRSDIALIQIQDPKNLTAIKLADSDALRVGDYTVAIGNPFGLGETVTSGIVSALGRIGLNAENYENFIQTDAAINRGNSGGALVNLNGELIGINTAILAPDGGNIGIGFAIPSNMVKNLTAQMVQYGQVKRGELGIMGTELNSELAKAMKVDAQRGAFVSQVMPNSSAAKAGIKAGDVITSLNGKPISSFAALRAEVGSMPIGSKVTLGLLREGKPVNVSLELQQSSQNQVDSSTIFSGIEGAEMSNKGADKGVVVNNVKANSPAARIGLKKGDVIMGANQQPVKNIAELRKILDSKPSVLALNIQRGDTSIYLLMQ

SEQ ID NO: 8344 - protein, 215 aa, Enterobacter cloacae
QSQERNMATNAKPVYKRILLKLSGEALQGSEGFGIDASILDRMAQEIKELVELGIQVGVVIGGGNLFRGAGLAKAGMNRVVGDHMGMLATVMNGLAMRDALHRAYVNARLMSANPLNGVCDNYSWAEAISLLRNNRVVILSAGTGNPFFTTDSAACLARYRNRSRCGAESDQSRWRVYCRPGKRSFSDHVRSAELQRSAGKRAKSDGSCRLYAGS

SEQ ID NO: 8345 - protein, 193 aa, Enterobacter cloacae
DKFSRIRNVINDIRKDAEVRMDKCVEAFKNQISKIRTGRASPSLLDGIIVEYYGTPTPLRQLASVTVEDTRTLKINVFDRSMSPAVEKAIMASDLGLNPSSAGADIRVPLPPLTEERRKDLIKVVRGEAEQGRVSVRNVRRDANDKVKALLKEKEISEDDDRRSQDDIQKMTDAAIKKIDAALAEKEAELMQF

SEQ ID NO: 8346 - protein, 475 aa, Enterobacter cloacae
QPYRGCSCICLPAFTGVWDDITEGFMLSILWNLAAFIVALGVLITVHEFGHFWVARRCGVRVERFSIGFGKSLWKRTDKHGTEFVIALIPLGGYVKMLDERVEPVAPELRHRAFNNKTVGQRAAIIAAGPVANFIFAIFAYWLVFIIGVPGVRPVVGEITTGSIAATAQITPGMELKAIDGIETPDWDAVRLQLVAKIGDEQTTVSVSPFGSDQRQEKVLDLRHWRFEPDKEDPVAALGIRPRGAQIEPVLAEVQAKSAASKAGLQAGDRIVKVDGQPLTQWMTFVTLVRDNPGKPLALEVERQGSSLSLTLTPDTKSGGGKAEGFAGVVPKVIPLPDEYKTIRQYGPFSAIVEATDKTWQLMKLTVNMLGKLITGDVKLNNLSGPISIAQGAGMSAEFGVIYYLMFLALISVNLGIINLFPLPVLDGGHLLFLAIEKLKGGPVSERVQDFSYRIGSILLVLLMGLALFNDFSRL

SEQ ID NO: 8347 - protein, 194 aa, Enterobacter cloacae
AQNRSTRLSVHPFNAKFPGLSALFINRQAVLLLLLSTFDRKSILTTYTHTLHIEEILELLPHRYPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVAMVDGKVVCEATMMCARSREA

SEQ ID NO: 8348 - protein, 263 aa, Enterobacter cloacae
YVIDKSAFIHPTAIVETGAIIGANVHIGPFCIVGPHVEIGEGTVLKSHVVVNGHTTIGCNNEIYQFASIGEVNQDLKYAGEPTRVEIGDRNRIRESVTIHRGTTQGGGLTKVGSDNLFMVNAHIAHDCTVGSRCILANNATLAGHVSVDDFAIIGGMTAVHQFCIIGAHVMVGGCSGVAQDVPPFVIAQGNHATPFGVNIEGLKRRGFSREAITAIRNAYKLLYRSGKTLEEAKPEIAELANKHPEVKTFMEFFERSTRGLIR

SEQ ID NO: 8349 - protein, 1166 aa, Enterobacter cloacae
VTRDLKMAEPRFVHLRVHSDYSMIDGLAKTGPLVKKAASLGMPALAITDFTNLCGLVKFYGTAHGAGLKPIVGADFHVQSDLLGDEMTQISVLAMNNTGYQNLTLLISKAYQRGYGALGPWIDRDWLAELNEGLLLISGGRMGDVGKCLLRGNNALVDQCVSFYEEYFPDRYYLELIRTGRADEESYLHAAVALAEARGLPVVATNDVRFLEAGDFDAHEIRVAIHDGFTLDDPKRPRNYSSQQYMRSEEEMCELFSDIPEALENSVEIAKRCNVTVRLGEYFLPQFPTGDMTTEDFLVMKSKEGLEERLEFLFPDEAVRKEKRPEYDERLDIELQVINQMGFPGYFLIVMEFIQWSKDNGVPVGPGRGSGAGSLVAYALKITDLDPLEFDLLFERFLNPERVSMPDFDVDFCMEKRDQVIEHVADMYGRDAVSQIITFGTMAAKAVIRDVGRVLGHPYGFVDRISKLVPPDPGMTLAKAFEAEPQLPEIYEADEEVKALIDMARKLEGVTRNAGKHAGGVVIAPTKITDFAPLYCDEAGQHPVTQFDKNDVEYAGLVKFDFLGLRTLTIINWALEMINARREKNGEPPLDIAAIPLDDKKSFDMLQRSETTAVFQLESRGMKDLIKRLQPDCFEDMIALVALFRPGPLQSGMVDNFIDRKHGREEISYPDVQWQHESLKPVLEPTYGIILYQEQVMQIAQVLSGYTLGGADMLRRAMGKKKPEEMAKQRSIFEDGAKKNGIDGELAMKIFDLVEKFAGYGFNKSHSAAYALVSYQTLWLKAHYPAEFMAAVMTADMDNTEKVVGLVDECWRMGLKILPPDINSGLYHFHVNDDGEIVYGIGAIKGVGEGPIEAIIEARNNGGYFRELFDLCARTDTKKLNRRVLEKLIMSGAFDRLGPHRAALMNSLGDALKAADQHAKAEAIGQADMFGVLAEEPEQIEQSYSNCQPWPEQVVLDGERETLGLYLTGHPINQYLKEIERYVGGHRLKDMHPTERGKITTAAGLVIAARVMVTKRGNRIGICTLDDRSGRLEVMLFTDALDKYQQLLEKDRILIVSGQVSFDDFSGGLKMTAREVMDIDEAREKYARGLAISLTDRQIDDQLLNRLRQSLEPHRSGTIPVHLYYQRADARARLRFGATWRVSPSDRLLNDLRGLIGSEQVELEFD

SEQ ID NO: 8350 - protein, 323 aa, Enterobacter cloacae
YRNTMSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMEMAERFNMPIITFIDTPGAYPGVGAEERGQSEAIARNLREMSRLKVPVICTVIGEGGSGGALAIGVGDKVNMLQYSTYSVISPEGCASILWKSADKAPLAAEAMGIIAPRLKELKLIDTVIPEPLGGAHRKPEVMAASLKAQLLADLADLDVLSTEDLLNRRYQRLMTYGYA

SEQ ID NO: 8351 - protein, 123 aa, Enterobacter cloacae
QSQYSWEHKMSDDVALPLEFTEAAAKKVKTLIADEDNPDLKLRVYITGGGCSGFQYGFTFDDQVNDGDMTIEKQGVALVVDPMSLQYLVGGSVDYTEGLEGSRFVVTNPNATSTCGCGSSFSI

SEQ ID NO: 8352 - protein, 258 aa, Enterobacter cloacae
YGIRGGITPTFNIEVLNMATVSMRDMLKAGVHFGHQTRYWNPKMKPFIFGARNKVHIINLEKTVPMFNEALAELNKISSRKGKILFVGTKRAASEAVKDAANSCDQFFVNHRWLGGMLTNWKTVRQSIKRLKDLETQSQDGTFDKLTKKEALMRTRELDKLENSLGGIKDMGGLPDALFVIDADHEHIAIKEANNLGIPVFAIVDTNSDPDGVDFVIPGNDDAIRAVSLYLSAVAATVREGRSQDLASQAEESFVEAE

SEQ ID NO: 8353 - protein, 311 aa, Enterobacter cloacae
IGAHYRPLFSIYTVWLPAGQFTSPEDLRMAEITASLVKELRERTGAGMMDCKKALTEANGDIELAIENMRKSGAIKAAKKAGNVAADGVIITKIDGNYGIILEVNCQTDFVAKDAGFQAFANKVLDAAVAGKITDVEVLKAQFEEERVALVAKIGENINIRRVASLEGDVLGSYQHGARIGVLVAAKGADEELVKQLAMHIAASKPEFVKPEDVSAEVVEKEYQVQLDIAMQSGKPKEIAEKMVEGRMKKFTGEVSLTGQPFVMDPSKSVAQLLKEHNADVTGFIRFEVGEGIEKVETDFAAEVAAMSKQS

SEQ ID NO: 8354 - protein, 109 aa, Enterobacter cloacae
SSPPVRVTRSLPPIPQPAWRGIEIEADVVLKATKVDGVFTADPAKDPSATMYDQLSYSEVLEKELKVMDLAAFTLARDHKLPIRVFNMNKPGALRRVVMGEKEGTLITE

SEQ ID NO: 8355 - protein, 255 aa, Enterobacter cloacae
KRVMLSANQPISENLPAHGCRHVAIIMDGNGRWAKRQGKIRAFGHKAGAKSVRRAVSFAANNGIDALTLYAFSSENWNRPAQEVTALMELFVWALDSEVKSLHRHNVRLRIIGETSRFNSRLQERIRKAEALTENNTGLTLNIAANYGGRWDIIQGVRHLAEQVQEGLLRPDQIDEEALSQQICMNELAPVDLVIRTGGEHRISNFLLWQIAYAELYFTDVLWPDFDEQDFEGALHAFANRERRFGGTEPGGDNA

SEQ ID NO: 8356 - protein, 286 aa, Enterobacter cloacae
LLLKYRLISAFVLIPVVIAALFLLPPVGFAIVTLVVCMLAAWEWGQLSGFTSRTQRVWLAVLCGFLLALMLYTLPEYHHDVHQPLVAGSLWISLAWWIAALVLVLFYPGSAAIWRNSKVLRLIFGLLTIVPFFWGMVALRAWHYDENHYSGAIWLLYVMILVWGADSGAYMFGKLFGKHKLAPKVSPGKTWQGFIGGLFTAAIISWGYGVWANLEVAPSTLLVCSIFAALASVLGDLTESMFKREAGIKDSGHLIPGHGGILDRIDSLTAAVPVFACLLLLVFGTI

SEQ ID NO: 8357 - protein, 482 aa, Enterobacter cloacae
EERIITMAMKKLLIASLLFSSATVYGADGFVVKDIHFEGLQRVAVGAALLSMPVRPGDTVNDEDISNTIRALFATGNFEDVRVLRDGDTLVVQVKERPTIASITFSGNKSVKDDMLKQNLEASGVRVGESLDRTTLADIEKGLEDFYYSVGKYSASVKAVVTPLPRNRVDLKLVFQEGVSAKIQQINIVGNHAFSTDELISNFQLRDEVPWWNVVGDRKYQKQKLAGDLETLRSYYLDRGYARFNIDSTQVSLTPDKKGIYITVNITEGDKYTLSGVEVSGNLAGHSAEIESLTKIQPGDLYSGSKVTKMEDSIKKLLGRYGYAYPRVQTQPEINDTDKTVKLHVNVDAGNRFYVRKIRFEGNDTSKDSVLRREMRQMEGAWLGSDLVDQGKERLNRLGYFETVDTDTQRVPGRPDQVDVVYKVKERNTGSFNFGIGYGTESGVSFQVGVQQDNWLGTGYSVGINGTKNDYQTYSEFSVTNP

SEQ ID NO: 8358 - protein, 333 aa, Enterobacter cloacae
FTVDGVSLGGRIFYNDFKADDADLSSYTNKSYGLDGTLGFPVNEYNTLRAGLGYVHNDLSNMQPQVAMWRYLDSIGQSASTSSDDNGFAADDFTFNYGWTYNRLDRGYFPTEGSRVNLNGKVTIPGSDNEFYKVTLDTASYFPIDEDHKWVVLGRTRWGYGDGIGSKELPFYENFYAGGSSTVRGFQSNNIGPKAVYYGGNDEDNCNKPATDGAGNKNVCSSDDAVGGNAMAVASLEFITPTPFISDKYANSVRTSFFMDAGTVWDTNWQNTTETRLAGVPDYSDPSNIRMSAGIALQWMSPLGPLVFSYAQPFKKYDGDKAEQFQFNIGKTW

SEQ ID NO: 8359 - protein, 186 aa, Enterobacter cloacae
NDRLATQRTVPLGCQWDGKELIVKKWLLAAGLGLAMATSAQAADKIAIVNMGNLFQQVAQKTGVSATLENEFKGRASELQRMEGDLQSKMQRLQRDGSTMKASERSKLEKDVMSQRQTFSQKAQAFEQDRQRRSNEERGKLVTRIQSAVKAVAADQSIDLVVDSNAVAFNSSDVKDITADVLKQVK

SEQ ID NO: 8360 - protein, 342 aa, Enterobacter cloacae
VMPSIRLADLAQQLDAELHGDGDIVITAVASMQSAKAGTITFMVSPKYREHLAQCQASAVVLTQDDLPFATSAALVVKNPYLTYARMAQILDTTPQPAQNIAASAAIDPTAQLGNNVSVGANAVIESGVVLGDNVVIGPGCFVGKNTKIGAGTRLWANVSVYHEVEVGENCLVQSSTVIGSDGFGYANDRGNWVKIPQLGRVIIGDRVEIGACTTIDRGALDDTIIGNGVIIDNQCQIAHNVVIGDNTAVAGGVIMAGSLKIGRYCMIGGASVINGHMEICDKVTVTGMGMVMRPITEPGVYSSGIPLQPNKVWRKTAALVMNIDDMSKRLKAIERKIDQQD

SEQ ID NO: 8361 - protein, 209 aa, Enterobacter cloacae
AGGRCGAGVSTMMEFIYPHTHLVAGVDEVGRGPLVGAVVTAAVILDPARPIVGLNDSKKLSEKRRLALFDEIKEKALAWSLGRAEPHEIDDLNILHATMLAMQRAVAGLKIVPEYVLFDGNRCPALPMPSMAVVKGDSRVAEISAASIIAKVTRDAEMAALDLTYPAYGFAQHKGYPTAFHLEKLAEHGATEHHRRSFGPVKRALGLVS

SEQ ID NO: 8362 - protein, 711 aa, Enterobacter cloacae
TMNIIAIMGPHGVFYKDEPIKELEQALKARGYQLIWPQNSADLLKFIEHNPRICGVIFDWDEYDMELCSDINKLNEYLPLYAFINTHSTMDVSAHDMRMALWFFEYSLGVAEDIATRIQQYTGEYLDNITPPFTRALFTYVKEGKYTFCTPGHMAGTAYQKSPVGCLFYDFFGGNTLKADVSISVTELGSLLDHTGPHLEAEEYIARTFGAEQSYMVTNGTSTSNKIVGMYAAPAGSTLLIDRNCHKSLAHLLMMSDVVPLWLSPTRNALGILGGIPRREFAHEAIENKIAAIPEASWPVHAVITNSTYDGLLYNTNWIKQTLDVPSIHFDSAWVPYTNFHPIYSGKSGMSGERVPGKVFFETQSTHKMLAAFSQASLIHIKGEYDEDTFNEAFMMHTTTSPSYPLVASIETAAAMLRGNPGKRLINRSVERALHFRKEVQRLKDEADGWFFDIWQPEEIDEAECWPVAPGESWHGFRDADADHMFLDPVKVTILTPGMDEQGVMGEEGIPAALVAKFLDERGVVVEKTGPYNLLFLFSIGIDKTRAMGLLRGLMEFKRAYDLNLRVKNMLPDLYAEDPDFYRNMRIQDLAQGIHRLIRQHDLPRLMLQAFDVLPEMKLTPHRAWQRQVKGEVETVELENLVGRVSANMILPYPPGVPLLMPGEMITEESRAVLDFLLMLCSVGRHYPGFETDIHGAKRDDNGVYWVRVLK

SEQ ID NO: 8363 - protein, 133 aa, Enterobacter cloacae
KGETMLGLKAVHHIAIIATDYAKSKAFYCDVLGFTLLSEAYREERDSWKGDLALNGQYVIELFSFPFPPARPSRPEACGLRHLAFSVDDLDSAVKHLEAHGVACEAIRVDPFTDKRFTFFNDPDGLPLELYQQ

SEQ ID NO: 8364 - protein, 399 aa, Enterobacter cloacae
LNFPMLELCSREGFMAGWHLDTKMAQDIVARTMRIIDTNINVMDARGRIIGSGDRERIGELHEGALLVLSQGRVVDIDDAVAKHLHGVRQGINLPLRLEGEIVGVIGLTGDPESLRKYGELVCMTAEMMLEQSRLMHLLAQDSRLREELVMNLIQAEEHTPALSEWAQRLGIDLNQPRVVAVIEVDSGQLGVDSAMVELQQLQNMLATPERNNLVAIVSLTEMVVLKPALNQFGRWDAEDHRRRVELLIERMKENGQLRFRVALGNYFTGPGSIARSWRTARTTMMVGKQRMPESRSYFYQDLMLPVLLDSLRGGWQANELARPLMRLKAMDNNGLLRRTLQAWFRHNVQPLATSKALFIHRNTLEYRLNRISELTGLDLGNFDDRLLLYVALQLDEQR

SEQ ID NO: 8365 - protein, 423 aa, Enterobacter cloacae
TPFRRTLSLAGGVLLLSDLTFGHLMKHLTLLGSTGSIGCSTLDVVRHNPDSYTVAALVAGKNVQRMVEQCLEFTPRFAVMDDEESARQVKALLQEKGCRTEVLSGQQAACDMAALDEVDQVMAAIVGAAGLLPTLAAIDAGKDVLLANKESLVTCGRLFMDAVKQRGARLLPVDSEHNAIFQSLPQPFQQNLGYADLEQNGVVSILLTGSGGPFRETPLSELSAMTPDQACRHPNWSMGRKISVDSATMMNKGLEYIEARWLFNASAKQMEVLIHPQSVIHSMVRYQDGSVLAQLGEPDMRTPIAHTMAWPNRVKSGVKPLDFCKLSSLTFSEPDYDRYPCLKLAMTAFDQGQAATTALNAANEVTVEAFLNQQIRFTDIAALNLSVLEMMDLREPQSVEEVLAVDEQARIVARKQVTRLASW

SEQ ID NO: 8366 - protein, 391 aa, Enterobacter cloacae
TFNPWSDSLMVDSRPLTIALVAGETSGDILGAGLIRALKARVPNARFVGVAGPLMQAEGCEAWYEMEELAVMGIVEVLGRLRRLLHIRADLTRRFTDLKPDVFVGIDAPDFNITLEGNLKKQGIKTIHYVSPSVWAWRQKRVFKIGRSTNLVLAFLPFEKAFYDRFNVPCRFIGHTMADAMPLDPDKNAARDELGIPHDVHCLALLPGSRGAEVEMLSADFLKTAQILRKTYPDLEVVVPLVNAKRREQFERIKADVAPDLHVRLLDGKGRQAMFASDAALLASGTAALECMLAKCPMVVGYRMKPFTFWLAKRLVKTDYVSLPNLLAGRELVKELLQDECQPQALADALLPLLANGKTSHQMHDTFRELHQLIRCNADEQAADAVLELAQ

SEQ ID NO: 8367 - protein, 358 aa, Enterobacter cloacae
FPMTLPAIAHAVSPYRQLLVGFSGGLDSTVLLHRLKLWRDREPDVQLRAMHIHHGLSPHADDWVAHCEAVCSGWEIPLIVERVTLEDEGLGIEAQARKARYAAFSGALQPGEALVTAQHLDDQCETFLLALKRGSGPAGLSAMPERADFAETELIRPLLGETRASLEAWAQQHHLCWIEDDSNQDDSYDRNFLRLRVLPLLSERWAHFSEAAARSAMLCAEQESLLDELLSGELNTLITADGALNVAPLKVMSPVRRAALIRRWLAYHRAVMPSRAMLNRIWEEVAQAREDAAPCIHLNGYDVRRYKGQLWWVKSVPSLADVVLDWPSPEKALTLPMNAGVVALSHSFFTHRGWQHRA

SEQ ID NO: 8368 - protein, 90 aa, Enterobacter cloacae
KRPITILGRQNSLGHPRIGLTVAKKNVKRAHERNRIKRLTRESFRVRQHELPSMDFVVVAKKGVADLDNRALSEALEKLWRRHCRLARGS

SEQ ID NO: 8369 - protein, 378 aa, Enterobacter cloacae
  UNSURE (126)
  UNSURE (168)
VCGETWATAYRTPVRNRWEISTFGQLKQSINLPSHRDTGSSNFALHTFRGAAYSTPDTKYEKYKFDTIADNENLNVSSKGGWVAMLQQYFATAWVPNNDGTNYFYTANLGNGIAAIGYKSQPVLVXPGQTGKLASTLWVGPEIQDKMAAVAPHLDLTVDYGWLWFISXPLFKLLKFIHSFLGNWGFSIIVITFIVRGIMYPLTKAQYTSMAKMRMLQPKIQAMRERLGDDKQRQSQEMMALYKAEKVNPLGGCFPLLIQMPIFLALYYMLMGSVELRHAPFALWIHDLSAQDPYYILPILMGVTMFFIQKMSPTTVTDPMQQKIMTFMPVIFTVFFLWFPSGLVLYYIVSNLVTIIQQQLIYRGLEKRGLHSREKKKS

SEQ ID NO: 8370 - protein, 458 aa, Enterobacter cloacae
TRATMSHNDTIVAQATPPGRGGVGILRISGLKAREVAEAVLGKLPKPRYADYLPFKDADGTPLDQGIALWFPGPNSFTGEDVLELQGHGGPVILDLLLKRILTLPGLRIAKPGEFSERAFLNDKLDLAQAEAIADLIDASSEQAARSALNSLQGAFSARVNHLVEALTHLRIYVEAAIDFPDEEIDFLSDGKIEAQLNQVMNDLDAVRAEARQGSLLREGMKVVIAGRPNAGKSSLLNALAGREAAIVTDIAGTTRDVLREHIHIDGMPLHIIDTAGLRDASDEVERIGIERAWQEIEQADRVLFMVDGTTTDAVDPAEIWPDFIARLPAKLPITVVRNKADVTGETLGISDVNGHSLIRLSARTGEGVEALRSHLKQSMGFDTSMEGGFLARRRHLQALEEAARHLEQGKAQLIGAWAGELLAEELRLAQQNLSEITGEFTSDDLLGRIFSSFCIGK

SEQ ID NO: 8371 - protein, 428 aa, Enterobacter cloacae
FPLIQGDFHQGNHHCPNGNSPNPLSPPILHACIYGGFMARFLFCSFALVLLYPSGIDMYLVGLPHIARDLGASEAQLHIAFSAYLAGMASSMVFAGKIADKAGRQPVAITGAVIFALASVLCSVAQESTMFLSGRFIQGIGAGGCYVVAFAILRDTLSAQRRAKVLSMLNGITCIIPVLAPVVGYLIMLKFPWQSLFWTMAAMGAIVFILSVTVLKETHPGSQQPYHTATLHPAEKLVNRFFLSRLAITTLSVAVILTYVNVSPVLLMETMGFDRGEYSTVMALTAMVSMAVSFSTPFALNIFRQRTLMLTSQTLFLAAGVILATATSHAVMLVGITLICAGFSVGFGVAMSQALGPFSLRAGVASSVLGIAQVCGSSLWIWLAAVIGLNALNMLIGVLIGCSILCITLLMVIQPAAHYEEAHQQSRS

SEQ ID NO: 8372 - protein, 258 aa, Enterobacter cloacae
PTTTIIKERKMATHFARGTLTEGHLVSARLSSACHSEALKLPEHRRTRFLASRALLAELLFMLYGTSELPDILTQPEGRPVFADPALPHFSIAYTGNIVGVALTTEGDCGLDMELQRVTRSFHGANALDEYPLSSNEKLWIRNQNDPVEARAQLITLRQSIRKLNGAASDDASLLQLLPGSGRLRATKASLVEALSDAEDVLIWSVAVSPAIERLKIWEFDSIRGWRSLPDVPERANEPAARLMRLTSLPAEKAYTHS

SEQ ID NO: 8373 - protein, 200 aa, Enterobacter cloacae
SVQGHHDETGVIMSDTLKVVTLLGSLRKGSFNGMVARTLPQLAPAGMEISALPSIGDIPLYDADVQQEEGFPQSVEAIAEQIRQADGVVIVTPEYNYSVPGGLKNAIDWLSRLPEQPLSGKPVLIQTSSMGAIGGARCQYHLRQILVFLDAMVMNKPEFMGGVIQNKVDPQTGEVVDQSTRDHLSGQLTAFGDYIKRVKA

SEQ ID NO: 8374 - protein, 201 aa, Enterobacter cloacae
YQRTLTMDSQRNLLIIALLFVSFMIWQAWEQDKNPQPQQQTTQTTTTAAGSAADQGVPASGQGKQITVKTDVLELTINTRGGDVEQALLLTYPKELKSTEPFQLLETTPEFIYQAQSGLTGRDGPDNPANGARPLYNVENDTFVLADGQNELVIPMTYTDAAGNTFTKTFTLKRGEYAVKLGLQRTERRCETAGKSLPLVS

SEQ ID NO: 8375 - protein, 101 aa, Enterobacter cloacae
PAPPATCCASISTSTECRCTSSTPLACAMRAMKSSVSVSNAPGRRSSRPTACCLWWTAPQPTPLTRLKSGQTLSPVSRLNCRSPWCATRPTLPAKRWASAM

SEQ ID NO: 8376 - protein, 342 aa, Enterobacter cloacae
LAVAYSALPYLWSSSPRRTMKKPISSLDLNLLLCLQLLLQERSVTKAAKRMNVTPSAVSKSLAKLRDWFDDPLFVKTPLGLLPTPLTVSLEQDLADWMQIGNQILDKFHHSSPGGLKFVLAAETPLMLIRFNTLLEQVNERYPQATVKLRQWDYDSLDAITRGEVDLGFTGRETHPRSRELLKLMPWFIDYEILFSDRPCVYLREDHPALQEAWDLETFLRYPHISIFWERSDTWALDEVLREMGRERNIAMSLPGFEQSMFMAAQPDHNYIATAPHYCHHYNQLHQRNLVCLPIPIDEAQAEKLTVPFTLIWHKRNSHNPKILWLRETIKALYTAPDQVFA

SEQ ID NO: 8377 - protein, 95 aa, Enterobacter cloacae
PCSLGSVGKIMAPPLSPGSRVLIALIRVYQRLISPLLGPHCRFTPTCSSYGIEALRRFGVIKGSWLTVKRVLKCHPLHPGGDDPVPPGPFDTREH

SEQ ID NO: 8378 - protein, 246 aa, Enterobacter cloacae
FCLYGNDCVPVNCRTKTLNLLKGKGMSGIEAVFFDCDGTLVDSEVICSRAYVAMFQEFGITLDLEEVFKRFKGVKLYEIIDIINEEHGVDLAKADLEPVYRAEVARLFDAELEVIAGANTLLDAMTVPICVVSNGPVSKMQHSLGKLNMLHHFPEKLFSGYDIQRWKPDPALMFHAAKAMNVNVENCILVDDSSAGAQSGIDAGMEVFYFCADPHNKPIDHPKVTTFTDLAQLPALWKARGWDITR

SEQ ID NO: 8379 - protein, 197 aa, Enterobacter cloacae
IMESFMKLNVIATSLVLSSVLFSGATLAADGTVHFRGEVIDSTCTVTTDTSNQTVNIGRVSVKTFAGIDSTASVKDFHIRLEGCPATYTQAAVRFDGTEDKDTIGKGYLSIGTPVNEDGTDGEFTGSGDAIAATGVAIKLFNLSDDTAIPLYNNSKYVAIADGKADMGFKAKFVQTLATVTPGTANADSQFTIEYLK

SEQ ID NO: 8380 - protein, 320 aa, Enterobacter cloacae
FMAATKPAFNPPGKKGDMIFSALVKLAALIVLLLLGGIIVSLIFSSWPSIQKFGFAFLWTKEWDAPNDIYGALVPIYGTLVTSFIALLIAVPVSFGIALFLTELAPGWLRRPLGIAIELLAAIPSIVYGMWGLFIFAPLFATYFQEPVGNVLSAVPFVGALFSGPAFGIGILAAGVILAIMIIPYIAAVMRDVFEQTPVMMKESAYGIGCTTWEVIWRIVLPFTKNGVIGGIMLGLGRALGETMAVTFIIGNTYQLDSASLYMPGNSITSALANEFAEAESGLHVAALMELGLILFVITFIVLAISKLMIMRLAKNEGAR

SEQ ID NO: 8381 - protein, 276 aa, Enterobacter cloacae
VQRYGCAVHPSGEETNRRLYYWPLRLICLSACGETMDNLNLNKHISGQFNAELESIRTQVMTMGGMVEQQLSDAITAMHNQDSELAKRVIEGDHNVNMMEVAIDEACVRIIAKRQPTASDLRLVMAIIKTIAELERIGDVADKICRTALEKFSQQHQPLLVSLESLGRHTVQMLHDVLDAFARMDLDEAVRIYREDKKVDQEYEGIVRQLMTYMMEDSRTIPSVLTALFCARSIERIGDRCQNICEYIFYFVKGQDFRHVGGDELDKLLAGKDPKE

SEQ ID NO: 8382 - protein, 132 aa, Enterobacter cloacae
GAMNLPFAWVKTSMERGVFILILFYSIKMKGVSGFVKELTLQPFNHWAFIPVNLILEGVSLLSKPVSLGLRLFGNMYAGELIFILIAGLLPWWSQWILNVPWAIFHILIITLQAFIFMVLTIVYLSMASEEH

SEQ ID NO: 8383 - protein, 184 aa, Enterobacter cloacae
TVRREGLMSEFVTVARPYAKAAFDFAVEHQNVDRWQNMLAFAAEVTKNEQMAELLSGALAPETLAASFIAVCGEQLDANGQNLIKVMAENGRLRVLPDVLEQFEHLRALSEATAEVEVTSATELSDEQLAKITAAMEKRLSRKVKLNCKIDKSVMAGVIIRSGDMVIDGSVRGRLERLADVLQS

SEQ ID NO: 8384 - protein, 517 aa, Enterobacter cloacae
GDWSMQLNSTEISELIKQRIAQFNVVSEAHNEGTIVSVSDGVIRIHGLADCMQGEMISLPGNRYAIALNLERDSVGAVVMGPYADLAEGMKVKCTGRILEVPVGRGLLGRVVNTLGAPIDGKGPVEHDGFSPIEVIAPGVIDRQSVDQPVQTGYKSVDAMIPIGRGQRELIIGDRQTGKTAMAIDAIINQRDSGIKCVYVAIGQKASTISNVVRKLEEHGALSNTIVVVATASESAALQYLAPYAGCAMGEYFRDRGEDALIVYDDLSKQAVAYRQVSLLLRRPPGREAFPGDVFYLHSRLLERASRVNAEYVENFTKGEVKGKTGSLTALPIIETQAGDVSAFVPTNVISITDGQIFLETNLFNSGIRPAVNPGISVSRVGGAAQTKIIKKLSGGIRTALAQYRELAAFSQFASDLDEATRKQLSHGQKVTELLKQKQYAPMSVAQQGLVLFAAERGYLEDVELAKIGSFEAALLAYVDRDHAPLMQEINQTGGYNDEIEGKLKAILDSFKATQSW

SEQ ID NO: 8385 - protein, 304 aa, Enterobacter cloacae
SSGGLSQDKPSGIEEKLMAGAKEIRSKIASVQNTQKITKAMEMVAASKMRKSQDRMAASRPYAETMRKVIGHLANGNLEYKHPYLEERDVKRVGYLVVSTDRGLCGGLNINLFKKLLADMKGWSDKGVQCDLALIGSKGVSFFNSVGGNIVAQVTGMGDNPSLSELIGPVKVMLQAYDEGRLDRLYVVSNKFINTMSQVPTLTQMLPLPASEDDELKQKAWDYLYEPDPKPLLDTLLRRYVESQVYQGVVENLASEQAARMVAMKAATDNGGSLIKELQLVYNKARQASITQELTEIVSGAAAV

SEQ ID NO: 8386 - protein, 143 aa, Enterobacter cloacae
SEGDMAMTYHLDVVSAEQQMFSGLVEKIQVTGSEGELGIFPGHAPLLTAIKPGMIRIVKQFGHEEFIYLSGGILEVQPGSVTVLADTAIRGQDLDEARALESKRKAEEHINSSHGDVDYAQASAELAKAIAKLRVIELTKKAM

SEQ ID NO: 8387 - protein, 474 aa, Enterobacter cloacae
NFKHQTFLLLTQTTVRMRMLNSAMSVVILAAGKGTRMYSDLPKVLHTLAGKPMVQHVIDAANELGASQVHLVYGHGGDLLKKTLRDDNLNWVLQAEQLGTGHAMQQAAPFFADDEDILMLYGDVPLISVETLTRLREAKPQGGIGLLTVVLDDPTGYGRITRENGNVTGIVEHKDATDEQRQIQEINTGILIANGADMKRWLSRLNNNNAQGEYYITDIIAMAYQEGREIAAVHPARISETDGVNNRLQLSRLERIYQSEQAEKLLLAGVMLRDPARFDLRGTLTHGRDVEIDTNVILEGNVTLGNRVKIGTGCVIKNSAIGDDCEISPYSVVEDAHLEAACTIGPFARLRPGAELLEGAHVGNFVEMKKARLGKGSKAGHLTYLGDAEIGDNVNIGAGTITCNYDGANKFKTIIGDDVFVGSDTQLVAPVTVGKGVTIAAGTTVTRDVAENELVLSRVPQVSKQGWKRPVKQK

SEQ ID NO: 8388 - protein, 614 aa, Enterobacter cloacae
SGNITMCGIVGAVAQRDIAEILLEGLRRLEYRGYDSAGLAVVDAEGHMTRLRRLGKVQMLAQAAEEHPLHGGTGIAHTRWATHGEPSEGNAHPHVSEHIVVVHNGIIENHEPLREELKARGYTFVSETDTEVIAHLVHWELAKGGTLRDAVLRAIPQLRGAYGTVIMDSRDPSTLLAARSGSPMVIGLGMGENFIASDQLALLPVTRRFIFLEEGDIAEVTRRSVTVFDTKGEQVKRQEIESNLQYDAGDKGAYRHYMQKEIYEQPNAIKNTLTGRISHGEVDLSELGANANELLSKVEHIQIVACGTSYNSGMVSRYWFESLAGVPCDVEIASEFRYRKSAVRRNSLMITLSQSGETADTLAALRLSKELGYLGSLAICNVPGSSLVRESDLALMTKAGTEIGVASTKAFTTQLTVLLMLVAKLARLKGQDASVEHDIVHGLQALPSRIEQMLSQDKRIEALAEDFSDKHHALFLGRGDQYPIALEGALKLKEISYIHAEAYAAGELKHGPLALIDADMPVIVVAPNNELLEKLKSNIEEVRARGGVLYVFADKDAGFASSDNMHIIEMPHVEEVIAPIFYTVPLQLLAYHVALIKGTDVDQPRNLAKSVTVE

SEQ ID NO: 8389 - protein, 261 aa, Enterobacter cloacae
GNESMSMVDTAPGKIQVRDLNFYYGKFHALKNINLDIAKNQVTAFIGPSGCGKSTLLRTFNKMYSLYPEQRAEGEILLDGDNILTNTQDIALLRAKVGMVFQKPTPFPMSIYDNIAFGVRLFEKLSRADMDERVQWALTKAALWNETKDKLHQSGYSLSGGQQQRLCIARGIAIRPEVLLLDEPCSALDPISTGRIEELITELKQDYTVVIVTHNMQQAARCSDHTAFMYLGELIEFSDTDALFTRPAKKQTEDYITGRYG

SEQ ID NO: 8390 - protein, 458 aa, Enterobacter cloacae
DSDEFSLLVRKLMMSQQHTTQTSGQGLLERVFKLREHGTTARTEVIAGFTTFLTMVYIVFVNPQILGVAGMDTSAVFVTTCLIAALGSILMGVFANLPVALAPAMGLNAFFAFVVVQAMGLPWQVGMGAIFWGAVGLLLLTIFRVRYWMIANIPVSLRVGITSGIGLFIGMMGLKNAGVIVANPETLVSIGNLTSHSVLLGVLGFFIIAILASRNIHAAVLVSIIVTTLLGWMLGDVHYNGIVSAPPSVSTVIGHVDLAGSLNLGLAGVIFSFMLVNLFDSSGTLIGVTDKAGLADEKGKFPRMKQALYVDSISSVAGSFIGTSSVTAYIESSSGVSVGGRTGLTAVVVGLLFLLVIFLSPLAGMVPPYAAAGALIYVGVLMTSSLARVKWEDLTEAVPAFITAVMMPFSFSITEGIALGFISYCVMKIGTGRFRELSPCVIIVALLFVLKIVFIDSH

SEQ ID NO: 8391 - protein, 159 aa, Enterobacter cloacae
PFTSLMPSVSPVTSALLRTTVIGSLAGRRAIKSGQISAGSTASVVVPSTINSTRSACSISCQARSIPIRSTSSLASRRPAVSMMCSGIPSMWICSRSTSRVVPAMSVTIAASRPARAFSRLDFPALGRPAMTTFMPSRSRLPWRASARTASRSFITWLS

SEQ ID NO: 8392 - protein, 85 aa, Enterobacter cloacae
NKLETVMENLNMDLLYMAAAVMMGLAAIGAAIGIGILGGKFLEGAARQPDLIPLLRTQFFIVMGLVDAIPMIAVGLGLYVMFAVA

SEQ ID NO: 8393 - protein, 168 aa, Enterobacter cloacae
NPKPQKFKRYCAVNMNATILGQAIAFILFVWFCMKYVWPPLMAAIEKRQKEIADGLASAERAKKDLDLAQANATDQLKKAKAEAQVIIEQANKRRSQILDEAKAEAEQERTKIVTQAQAEIEAERKRAREELRKQVAILAVAGAEKIIERSVDEAANSDIVDKLVAEL

SEQ ID NO: 8394 - protein, 501 aa, Enterobacter cloacae
LKSCSWFTTKLVRPALLRNSPRSSRGPPRFNQVYELRRGFKMATGKIVQVIGAVVDVEFPQDAVPRVYDALEVQNGNESLVLEVQQQLGGGIVRTIAMGSSDGLRRGLEVKDLEHPIEVPVGKATLGRIMNVLGQPIDMKGDIGEEERWAIHRAAPSYEELSSSQELLETGIKVIDLMCPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSLLQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 8395 - protein, 231 aa, Enterobacter cloacae
GHWIMPGRIVNVLLACCLTGISTMASAGVVIGGTRVVYSSDKSDATITVKNNEAAIPYLIQTWVDPFSNTGTAKKPPFTVIPPVSRLEAGQEKILRIMKTEGNLPQDRESVFWLNIKNIPPASNKPNAMEIAIKTRIKLIWRPASLNITPERAATQVKWHRENRQLVVENPTPLNINVMNVTVDGKDVPLNIVHPFETLRLPLPEGVNGHALVWRYVNDFGAISQDLKAAL

SEQ ID NO: 8396 - protein, 845 aa, Enterobacter cloacae
AKDGLFMECYRIFIALASGMVLGLSGEVAARDMFNPALLEIDHPVDVDIHQFNRANSLPAGNYKVSIYVNGEYVDRREVTFVEDTATSNLHPCFSDIKTVLAELGVKVAAIKALNDIDDKACLDPAPLVPGSTWTFDTDKLQLNVTLPQIYIDVSARGYINPSRWDEGINALMVNYDFSGSSTVHSNEDDNNDFYYLNLRNGANLGAWRLRNYSTLNVTDGESSYHSINTYLQRDIAALRSQIMLGDTWTASDVFDSTQLRGMRLYTDDDMLPSSLTGFAPVVRGVAKSNATVIVRQNGYIIYQSAVPQGAFALKDLNTTNSGGDLDVTIKEEDGSEQHFTQPYASLAILKREDQTDVDISAGELRDQNDFQPTVFQAQVLHGFPAGITLYGGVQGTSDYTSAALGVGKDMGSLGALSLDVTHARSRFEDDDESGQSYRFLYSKRFDETNTTFRLVGYRYSTEGYYTLNEWASRQNNESDFWTTGNRRSRLEGTWTQTFGDGMGNIYLTLSRQQYWKTDEVERLVQLGYSNSWRAISWNVSWNYTDSLTSAQNSTDTDVSDSQGSEQIFMLSLSIPLSGWLHDSYVNYGYTQNNHGKGMHQVGLSGNALDAHNLSWNVQQSYDADNEDYNNSAGVGYDGTYGSVNASYDYTQDNQRLNYGMKGGILAHSDGITFSQELGETVALVKAPGASGLALENGTGKATDWRGYTVQTQLNAYDENRVEIDSDYFAKANVEIDNSILSVIPTRGAVVRAEFVTHVGYRVLFNVRQKSGKPVPFGAMASADLPHGSVTGIVGENGELYLSGMPEEGAFVLKWGADNTMTCPVNYHFTPPEGVELIQISAVCQ

SEQ ID NO: 8397 - protein, 361 aa, Enterobacter cloacae
GNKMKFRTPLFLSALIIFMTPVCKAYTTGDGICHSEGGAYIYNLNLNGQSIPADKNKAGTEIRDLETLSSSASYKAQCNCLTHYSTGFRQIYYTARSSLSEDVVKNGYTYFTLNNNLSIATSILVLGRDYIPVPFSAEPNVMSHSSYCYAPGEEGSEPTLNTGSKIKISFLINKPFIGRVSVPGTIVADLYGGLDAASSTSSTEKMAEIKIAGDIVVPQNCEIAPGQTLEIDFGKIPAPEFSATKGTAVTSHKVKKTIQVQCTGMLDENIVYSTFHGDPVDADATMMKVNGNDDVGIVVYDKWDRQVSVNGGRMDMDRGENNNGAENNSLTFSAAPASATGAQPKPGTFEAYATVTLEIEH

SEQ ID NO: 8398 - protein, 357 aa, Enterobacter cloacae
TMIYEILAGDIMKVMRTTVATVVAATLSMSAFSAFAAASLTGAGATFPAPVYAKWADTYQKETGNKVNYQGIGSSGGVKQITANTVDFGASDAPLSDEKLNQEGLFQFPTVIGGVVLAVNIPGLKSGELVLDGKTLGDIYLGKIKKWDDEAITKLNPGVKLPSQNIAVVRRADGSGTSFVFTSYLAKVNEEWKSKVGSGSTVNWPTGLGGKGNDGIAAFVQRLPGSIGYVEYAYAKQNNLAYTKLVSADGKPVSPTEENFANAAKGADWSKSFAQDLTNQKGEDAWPITSTTFILVHKEQKKPEQGAEVLKFFDWAYKNGGKQANDLDYASLPDSVVEQIRAAWKTNVKDSSGKALY

SEQ ID NO: 8399 - protein, 302 aa, Enterobacter cloacae
KRGGTLMATLDMQNTAQLAESRRKMQSKRRIKNRIALTLSMATMAFGLFWLIWILMSTITRGIDGMSLALFTEMTPPPNTAGGGLANALAGSGLLILWATVFGTPLGIMAGIYLAEYGRKSWIAEVIRFINDILLSAPSIVVGLFVYTIVVAQMEHFSGWAGVIALALLQVPIVIRTTENMLKLVPDSLREAAYALGTPKWKMISAITLKASVSGIMTGILLAIARIAGETAPLLFTALSNQFWSTDMMQPIANLPVTIFKFAMSPFAEWQQLAWAGVLIITLCVLLLNILARVIFAKKKHG

SEQ ID NO: 8400 - protein, 100 aa, Enterobacter cloacae
SLPFRVKVITSPACAPVTLPVTISAWPCSAILTMSSPATMSKVICGTVVSTSTDAPALAGLPALSDTVTVTAALPSAIPARSAAGTSSVQLPFACTWAVY

SEQ ID NO: 8401 - protein, 726 aa, Enterobacter cloacae
TGRSIMKTHPQYEPWLQGMLIIAKYYRLDFSAEHVRVTINHESQSPRQLVLEEMARQLGLGMRWVAAEALSLDPWRLPLLAEFTGGQIAVINRMDNDGNVSVQFSGDGGLETTLTRDELGSRLKGLMVLRPLESTPDARVDDYIKPYEKNWFWQLALKDWRRYSDIMLVALVANVLALSGMVFSMQVYDRVVPSQSEATLWVLFGGVMIAIVFEFIMRMLRVHISDVVGKRADLRISERVFAHALRIKNGARSKSTGSFIAQIRELESVRELITSTTIAAISDLPFFLLFVFILWMIGGPLVLVVLLAVPLLLIPGLLVQRPLGKLSSEGMRESAIRNATLVEAVQGLEDIKLMRAEQRFQNQWNNTNDVAASVGMKQRWLTGLLLTWTQEVQSIVYAVVLLVGCYLVISGDMTTGALVGTSILASRTIAPLSQISGVLSRWQSAKVARKGLDDLMQRPIDDPQHGKKVHKAHLRGDYLLDDVGFYYDEEEKLTVLNISKLRIRAGERVAVLGRNGSGKSTLLHLLAGMQEPQQGSILLDDIALNHLDPADVRRDMQLLSQQARLFFGSVRDNILMGNPLATDEEIHQALVNSGALEYVRKQKMGLNTIINEGGTGLSGGQRQALLLARALITSPNILLLDEPTAWLDEVSEKQFIQHLHQWLGKRRTLVVATHRLPILDLVDRIIVLENGKVVMDGPRDAILRQHGMAPHQAPQRTVKLKTEGVA

SEQ ID NO: 8402 - protein, 6015 aa, Enterobacter cloacae
TAKVVDVIIRKTAEKTKLTGEGNLSVSISSPSVIEIQGSAQDVVRYVRQGNDLLIYMKDGSVIRCNNYFVEDTETHNHSELVFNDNQALTHISFADAGEASGVAATELTAQAAPISSIEPFLEQGSVLSDAPWGWIAGAALGGGAIGALLAHGGDGETKTKVIDNTKEVESATPTFLLTDNAGDKQGVLSAKEVTDDNTPTFSGTGQPGATIQVKDGSGSTIASTMVAKDGTWTVTLPTQADGEHTWSVVQIDGSKTTSAGSINVTVSTADTSVTLATTAGDNVINASEQSAGFTLSGTSKNLAQGTALTVTLNGRTYTAEVGANGAWSVKVPAADAQALGDGTWTVNVSGKDAAGNTVSGSQTIGVDTASPVISVDTIAQDNIINAAEHNQPLTLTGKTDAEAGQIVTVTLNGKNHTATVGSDGSWSVTLPASEVQTLANGEHTLTVNVSDKAGNGSSITADFTVDTAAPVVTINTVAGDDILNTSEQGQAQIISGQANGAAEGDVVTVTVGGKTFTGVVQADGSWSVGVPASVIGALGEGSHSISVAVTDAAGNTGSATHGITLSGNPPEFTLDPISQDNVLNAQEAMQPLSLSGTSNLPNGSAVTVTLNNVNYQATVENGRWSVQVPVSDVLDLANTLYTVSVSGTDSVGNSGSAEANLLVDTVLPQVIVNTFAGDNLVNNAEAAVDQTLSGRVTGAAAGDTVSVTVGGKSYTATVGSDLKWSVTIPSADLQAFGDGDLTFSASVTNAHGNTGTGERDININAELPGLRVNTISGDDVINAIEQQQDLAVTGSSTHLAEGTQITVTINNVEYVTTVNASGSWQIGVPAADLQAWTAGGITVSVSAEDAWGNTVAAEHPIELDLNAVAVTIDTVTTDDMLNAAEKGADVTLSGQTQGVEAGQTVVVKFADQTFTAQVQQDGSWHLTVPASAMETLIDGRAQVSVSVTNVNGNSADASRVVIVDTQPPAITLDNLTDDNIINAAEAQQDLVLSGSTTAETGQTVTVTLNGKSYQTTVQADGRWQLNVPAADVGALTDGNVTVTATVSDVAGNSSSADRVGLVDATVPQVTINDFVTDTNTVNQLAHAQAQILSGSVTGAAAGDLVTITINNVDYTTVVDAAGNWSLGLPASVIQGLTDGTWTINVSVTDRSGNTGSSSVDVVVNTVTPVIGINTLAADDVINAAEKGEDLLLSGTSNQPEGTTITVNLNGINYSATTDASGNWSVTVPASAVSALGEANYTVTASVTDNVGNSAAATHDVLVDSSLPVVTLNNFAGDNIVNAAEVAAGQTLTGKVSNAASGDTVTIILGGQTYTATVQDDLTWSLPLTQSQLTALGNGDLTVSASVTNAHGNTGSSSLDVTIDAQLPGLRIDTVAGDDVINVIEHAQNLVISGTSTDLAAGSTVTVTINGKSYSASVQADGTWQAAVPAADVSRWADGSLTISASAQDTSGNPVNIGTVVDVDLAPVAISINTVTDDNVLNAAEKGQNLVLSGSSSNVEAGQTVTIIFAGKTWTTTVDANGDWTCTVPAADLSGLKDGEASVQVSVTNVNGNAASSSQAFSVATAAPAVTINTISGNNMLNAAEAAQELTLSGTSTAEAGQTVTVTFNGNQYTAQVQANGSWTLDVPAADLAGIADGSAAVTVTVSDKAGNPASAGASVLVDTTVPQITFDIVAGDDIVNIAEHGQALIVTGKVTGAQAGDVITLTLNGKDYTAMLDGAGNWSVGVPAADVGALANGDQTISATVTDKAGNSTSATHAFDVSLTAPVIAINTLAVDDVINATEKGQDLLISGTSNQPDGTRITVTLNGISYAATTDASGNWSVTVPAANVSALGEASYSVTASVTDTAGNSANTSHSVLVDSALPQVTINAVATDDVINAAEVASGQTLSGKVSGAASGDTVTISVGGNTYTTIVQDDLSWSVNVASDVLTAIGNGDLTVSASVTNGHGNTGSGERDITIDANLPGLRVNKVAGDDVINSIEHGQNLIITGSSDGLAAGSALTVTVNGKTYAATVLADGTWTAAVPAADVGALSEGTVTVTVEGQSAAGNPVSISHDVKVDLATVAISIDAIATDDVINAAEKGADLVLSGATTNVEENQTVTITFGGKTYSATVDASGNWTATVPSADLGSLKDGDASVQVSVTNVNGNSASAGREYSVDATAPTVSIEIVSDNNIINAAEAQQDLVVNGVSNAEAGQTVTVTLNGVDYTTTVQANGSWSVTVPSADIGAITDGSYTITAAVADKAGNPALADRDVLVDTTVPQLTINTVSDDDVINSAEHAQALIVTGSVTGAAAGDVVTVTINNKDYTATLDASGRWSVGVPAADVSALTAGDHTITAALTDKAGNSNSTTHEVEVNLTAPVLTIDTVSGDDVINSSEKTQDLTITGTASGLAAGAVVTVMLNGKAYSATVDTNGQWTTTVPASEVGQLGEALYTVSASATDSVGNSTSTSHTVNVESVLPGVIINAVAGDDVINAAELATGQTISGTVVNAEAGNTVTVSVGGHNYTATVQSDLTWSVSVPESVLTALGNGDLTVTASVTNGVGNSGSGERDITIDANLPGLRVDTVAGDDVINSIEHGQNLIITGSSDGLTAGTALTVTVNGKTYAATVLADGTWSAAIPSADVSALAAGAVTVNVEGQSSAGNPVTINHDVTVDLANVAISIDAIASDDVINAAERGADLVLSGTTANVEENQTVTITFGGKSYTATVDAEGKWTATVPSADLAGLKDGDASVQVSVTNVNGNSASAGREYSVDATAPSVTINTIATDDILNASEAQSDLAISGTSTAEAGQTVTVSLNGKDYTTTVSANGSWTLNVPAADLAGLTDGSVTVTASVSDKAGNPASVDHALTVDVTVPAVTIHTVAGDDVINVAEHNQAQIISGSATGAAAGDKVTVTIGGQTYTTVLDAAGNWSVGVPANVISGLSDGTVTVSVSVTDAAGNTGSGMHNVTVDTGLPSVSFNAISDDNVLNAVEKGQDLSVSGTSANLAEGTQVTVTLNGKNYTATTAADGTWSLTVPAADLAGLGQASYTLNATATNGVGNSVSTTANLLVDTALPTVTINTVAGDNVINAAEVAAGQTLSGTVANAEAGNTVTVAIGGHSYTATVQNNLSWSVNVPSDVLTALGNGSLSVTATVTNGHGNTGTGEREIAIDANLPGLRVDTVAGDDVVNTIEHAQNLIVSGTSDGLAPGTALTVTVNGKDYAATVLADGTWRAAIPSTDVSAWPEGTVKISVTGDSAAGNPITISHDVTVDLATVAISINALATDDVINAAEKGADLVLSGVTTNVEAGQTVTISLNGRIYTTTVDDSGNWTYTVPSADLAGLKDGDASVQVSVTNVNGNSASAGREYSVDATAPSVTINTIATDDILNATEAQSDLAISGTSTAEAGQTVTVSLNGKDFTTTVSANGSWTLNVPAADLAGLTDGSVTVTASVSDKAGNPASVDHTLTVDVTVPAVTIHTVAGDDVINVAEHNQAQIVSGSATGAAAGDKVTVTIGGQTYTTVLDAAGNWSVGVPANVISGLSDGTATVSVSVTDAAGNTGSGTHNVTVDTGLPSVSFNAISDDNVLNAVEKGQDLRVSGTSANLAEGTVVAVTLNGKNYTATTAADGTWSLTVPAADLTGLGQASYTLNATATNGVGNSVSNTANLLVDTALPTVTINTIAGDNVINAAEVAAGQTLSGKVANAEAGNTVTVTIGGNTYTATVQSDLTWSVNVPESVLTALGNGDLTVSATVTNGHGNTGTGERDITIDASLPGLRVNTVAGDDVINSIEHGQNLIVSGTSDGLAAGTTLTVTVNGKTYAASVLADGSWNAAIPAADVAAFAAGTVTVTVAGQSAAGNPVTISHDVTVDLAAVAISIDAIATDDVINAAEKGVDLVLSGSTSNVEENQTVTVTFGGKTYTAKVDADGNWTATVPSADLAGLKDGDASVQVSVTNAHGNSASAGREYSVDATAPTVTIDTVAGDNVINGSEAAAGVDISGTTTAEVGQTVTVTLGGNSYTAQVQQGGVWSVNVPGTDLSALADNGYTVQASVSDAAGNPGSAGKAITLDTTPPTVSFNVVAGDDVINSVEHGQAQIVSGTATGASVGDKVVITIGSNQYTTTVDASGKWSVGVPASVISALTDGTVTLSATITDSAGNSSTQTHDVVVNTASVALTVNTLSGDDVINAAEAGASLVINGSSAQFASGTQVTITLNGKSYTATIQSDGSWTTTVPAADVGTLADGASYQVSVSAQDSAGNSASATHTISVDTTAPVISVNTLSGDDVLNAAEAQQPLTVHGSSSAEAGQTVTVTLGGKTYTALVGSDGTWTLDVPAADLAALSQGALTVTASVNDKAGNSGQTTHTLTVDTIAPAVTISTVADDDIVNNAEQLAGQTISGTTTAEQGQTVTVSFNGHSYQATVAANGSWSVFVPGRDFLGLSDGDYTITATVSDKAGNPGSATHDVTLNGDVPTIAINTFAHDDIVNAAEHGTPLVISGTTDAPAGQTVTITLNGKTYTATVQNDGTWSYTVGSADVTALADGGSYVINAQVSNAIGNSVSDNHTVTVDLTAPSMGISIDSLQNDTGLSANDFITNDSQVVVNGSLTAQLGNNEKAQISLDGGVTWIDLTVTGTTWRYTDGRTLTDGTYQYQVRVIDNAGNVGATDSQDVVIDLTKPAAATITVDSVSQDTGLSDSDFITSDNQISLKGTLGAVLGSGDHAQISLDGGATWTDVSVSGLSWTYIDGRTLTDGDYNYQLRVIDEAGNISATTSQVVTIDTVAPDASKTIAIDSISDDTGLSSSDFITRDTSLTLHGSLGATLADGEYAQISIDGGVTWQNVIVTGNSWYYVDGRTLGNQTYDYYVRVVDAAGNVGASAHQQVTVDTVAPDAAITVTVDNITVDTGFDNNDFLTSSTSYTLNGTLGAELGAGEYVQVSMDGGTTWVYATVSGTQWRYTDARTLTDGDYRYQVRVVDQAGNVGATTTQDVTVDTQAPQYGITIDSISEDTGQSGSDFITMDTSLTINGSLGSALASDERVQISLDGGNTWIDATVTNQRWSYTDTRDLADGDYNYQVRIIDQAGNVGSTTSQVVTVDTTPPDTVGTVVSYTDGEGERQGSFGASVATDDNSPVINGTLNRAPDNGEIVQLYRDGVLLGQVTMNGAASWYFQDSGLNDGNHVYMLRVTDLAGNFTDSDDFVLKVDTSIPTTTVTINPQTTTDSTPILSGLVSAGLTNGEYVVITVNDKTYTSETGGAVVVDPDNNTWYLQLPDGDALSVKNYDVTAQVKSSAGNGNTAGLTTGSLIVGSEESLTPAWSFTAANYSYSASYMLDSDGLWTIMANQQFASANTSSRNAYTVSGNFSMTGSYTTGTYADINRDGLADVLAEGTSYSYMVQLINNGDGTYTSSTLTNMGAAVWYGAVVAIDIKGDGYTDFVIGDAGGPDSSTVMLNNNGTLTGSSKSGTYSSFVSGSTVGNYNSLIETSGVDLNNDGKVDIAQHTTNGGNNYALSTMFNQGNGSFTWGQNFTNTMYSGYGSAAASNAVSMTWADFNGDGYMDLYMSMSRTSSGTSQGGVLMLNDGSGNLLAGTAVGTATTDKFVGNVSVAVDWNLDGHMDIIKLANSGQSYLYTNDGLAGTASFTASKFSTATSTQVSGAALLDYDWDGAQDLLIFRQNGTVLLERNTNTVAPGTALHLKIVDSEGINAFFGNTVQLYNAAGQLVASEIINAQSGIGINDSSSLISFYGLDPSETYHAVLVRAVNGVSSNVTWDGLTAGDGKESYALTAEAATGGHQGTLTGTGYNDTFIAEAGTYTYNGSGGWTTTSEHDTWSSTGGMDVVDYRNATSGVTIDLGRSTAQSTGFDTATLVNIEGINGSDYDDVITGNSGDNQFEGRGGNDTFNIGSGGHDTLLYKLINASDATGGNGSDVVNGFTVGTWEGTADTDRIDLRDLLSDSGYTGTGSASYVNGVATLDSSAGNIADYIRVVQNGSNTEIQVDLDGTGGQFSPTTLVTLNGVQTDLATLLANHQLLIA

SEQ ID NO: 8403 - protein, 398 aa, Enterobacter cloacae
TENGGRGMNDFSRFNSRLKEPRLPRSSLVAWSLFALLVVFITWASLFQLDEVTTGSGKVIPSSHEQVIQSLEGGIIHSLMVREGDIVERGQQLAQLDRTKTESSVLESESRLNAAMATAARLNAEVNDTGLTFPAELDDDVELVKQETALYQSRRESLEKGLAGLRQGADLVQRELALTRPLVTQGAASKVEVLRLERQKNELESKITEMKNQYYVRAREELAKANAEIEAQRSVMKGREDSLTRLTFNAPVRGIVKDIDVTTVGGVIPPNGKLMSLVPLDDQMVIEAKISPRDVAFIHPGQKALVKITAYDYSIYGGLEGEVTMISPDTLQDEVKRDVYYYRVYIRTDSNHLTNRQGKAFPVFPGMIATVDIKTGSKSVIDYLLKPLNKAKEALRER

SEQ ID NO: 8404 - protein, 260 aa, Enterobacter cloacae
RKNVPVHNIDNGLLTKQGAVKLFNATKSIGFNYRWEYYLHSQEQVMSQNLPFIQGTCYKQRFVISACGFTFEGYSLLLKSRGVNATRLHFEEDEVCSGDVHKMMQNQPPEVAVFLGRDVAAFLESLKQLVSVLNALPVICSVTLYGAIPERWLYATLCSLVNNTKSLSMIRIANISDVMDCADNIYDVHTDSSRILRDGPEKEGKESLNGLTKRELTVLLNFYRGISIKEQSARLGLSDKTIYTHRKKGVGKIYPNQGFG

SEQ ID NO: 8405 - protein, 109 aa, Enterobacter cloacae
NRVIFSGGLMADFTLSKPIFGGKQPKTSTAGNIAYALFVLFCFWAGTQLLNMLVHAPGVYEHLMQVQDTGRPRVEFGLGVSTVFGLIPFLAGSMVLGVIALVLRWRNRH

SEQ ID NO: 8406 - protein, 444 aa, Enterobacter cloacae
RLSYGRCHKMGATLQVNCSNLPTVTFFSLSLCKSGHCPTPISSITTRNFPYSLDGCFSLKRCLLSIAALCAVSLSTAQAAQPLTAPVLASDIADRYANLIYYGSGATGMALVVIDGNQRVFRSFGETRPGNNVRPQLDSVIRVASITKLMTSEMLVKLLDQGVVKLDDPLSKYAPPGARVPTYQGTPIRLVNLATHTSALPREQPGGAAHRPVFVWPTREQRWNYLSTATLKSAPGSQAGYSNLAFDLLADALATASGKPYPQLFEEQITRPLGMKDTTYTPSPDQCKRLMVAEKGASPCNNTLAAIGSGGVYSTPGDMMRWMQQFLSSDFYARSNQADRMQTLIYQRAQLRRVIGMDVPGKADALGMGWVYMAPKDGRPGIIQKTGGGGGFITYMAMIPQSNVGAFVVVTRSPNTRFVNMSDGVNNLVAELSANKAQVLTASN

SEQ ID NO: 8407 - protein, 575 aa, Enterobacter cloacae
SMFSLDSVLDDLWPQARPAPWQKSLLKRLLHEDEFQQFAASHRHLKGLDMVDQVLEHLDIHCSVSARDLEQIPEHGPLIVIANHPTGTLDGLALLYAVSRVRRDVRVVTNRMLSHLEPLSSLFIPVDNMGGRTAKASLIQMEQHLQNAGVLIFFPAGEVSRPTRKGIRDKKWHPGFIKLAGKLRVPLLPVHIQAHNSLLFYASTLVSPTVSMLLLMQQMFRRRHSQLPIKIGQQIAWNDRFSSTLSSREMAEQCRQHVIRLGKGLPGVFKTQCAIARPEDRATLKRELAQAECLGKTSDGKAIYLWQRNGQEEAPLLRELGRLREIAFRAVEEGSGKRRDTDSYDDDYLHLILWDDDDLEIVGAYRFMPTAMQVEKRGVEGLYSYSLFHYDEKMQDILEHGIELGRSFIQPRYWGRRGLDYLWSGIGAYLARYPHYRYLFGPVSISGGLPPAARDLLVAFYRLWFPATHPLAASRQPYPASLPDVLAQFGGVDYVDDLTKLKSLLGNLGCGIPPLYKQYSELCEPGGVQFVDFGSDPAFNNCIDGLVLVDLCYLKANRYQRYIEAHLIPSPLPSP

SEQ ID NO: 8408 - protein, 291 aa, Enterobacter cloacae
RRRNTKCDAQMLIHTATTAKPEMADSATNTVSGATTLENSASTPPSMETESAVSGTPFLLTRAKQRGSVFSLDRDHSIRPEAYRPEFAAERIAVRITKLKISAAYGMPTFSNTSTNGLFSTPACCMGISAASTNTVPIKKMMSRAMVVRIATGITLCGFSVSPAAMPISSVPEKAKLTATMVIRIGRPPCGNQPSAVMLLKPGAGEPSCIGIKPKIAAPPRIMKAMMVMTFTSENQNSPSAKKRVEITLRAKITTQKTTHHVQTGTCGNQYCIQNPAAVKLDPSATVQVNQ

SEQ ID NO: 8409 - protein, 384 aa, Enterobacter cloacae
ISSIVDTVSSSPGLTMRFNGLTKGFFILILALVTWAFFDVLSPYFSAILWAAILTIIFNPVKNKLRTALGDRNGLASLLTLGIICLIVFIPLMVILSSLAVELNMVYTKLQQNNTQFPEVIAGIFNRLPDWASGFLADHNLTNAAQIQKKLSDVALQGGQYLAGSAFLIGKGTFGFAISFGIMLYLLFFLLKDGPYLVRQILDSLPLSDFVKQHLFAKFVGVSRATVKGTAVVAVVQGTLGGIAFAIVGIDGSVLWGALMAFLSLVPAVGSAIVWVPAAIFLFATHQLWQGLFIVGFFVIIVGLVDNLLRPLLVGKDTKMPDYLILITTLGGMELYGINGFVIGPLIAALFIACWNLFSGRDHAGNAEELDADFIEEGKNPPDL

SEQ ID NO: 8410 - protein, 606 aa, Enterobacter cloacae
TLFHICRRRIQQVRIATITNWAYGVTVCLTIASGIVMLMASHADNVERQAVKQRQIFDQLTEEIEAETWMLSDLARLYAIKKEPDVLKTYQAKEGELKNIERKLGQLKDTGATGEELALLYEGLKIVDDLQDEQQAAIASVARGEEQQAIALLFGKIYELEMERAQSKIDHFRVLLDKRIIADVQAATNTSKTLRTASEMMVGLTALLFLFVMGFILKHRVLRPVVRLSDVVHRLASQDYAVETPNFNQVDEIGDMAQAIRIFRENGLARQRLEKERDADWAIRELLARMTQRLQGCENVSDVIEVAELFAPNIAPGVAGRLYILDRNPWEMRCAAEWLSPQGEKNAFHPDQCWAIRRGQSHPPVNGEPDIGCQHLPESQKDSSLCVPLIAQGEAIGLLSFQNITPETAPSRAYLELMAEALGLALANQRLRDALLEKALFDPLTGLRNRHHLEDTLRTQIAQAMRNDEPVSCMMIDIDHFKSINDRFGHEAGDHVIKSVATIVQRAVHDAGLAFRFGGEEFLVLLTGADEEAAHACATEIYNGVHTLSLRYGLAEIGPVDVSIGIASYPQHAQSDDLLRAADVALYRAKELGRSRIVSFSMLEAG

SEQ ID NO: 8411 - protein, 262 aa, Enterobacter cloacae
TTFALSLIIVEERMMDIPRIFTVSESEHRIHNPFTEEKYATLGRVLRMKPGTRILDLGSGSGEMLCTWARDYGITGTGIDMSQLFTAQATLRAEELGVSERVHFIHNDAAGYVANEKCDVAACVGATWIAGGVAGTMDLLAKSLKPGGIMLIGEPYWRQVPATEETAQACGVSSITDFLTLPGLVASFDQQGYDLVEMVLADQEGWDRYEAAKWMTMRRWLEENPDDDFAQEVRAELTIAPERHVTYTREYFGWGVFALMAR

SEQ ID NO: 8412 - protein, 406 aa, Enterobacter cloacae
TDLFLSRAPLQHPSKYYGRRPRNPPGIVVCYWLFVRLEESEMAKQRVGIVFGGKSAEHEVSLQSAKNIVDAIDKSRFDVVLLGIDKQGQWHVNDASQYLLHADDPAHIALNPSDISVATVPGVVQGQLIDAGNAQALAQIDVVFPIVHGTLGEDGSLQGMLRMANLPFVGSDVLGSAACMDKDVTKRLLRDAGLNIAPFVALTRANRDKHSFAQIQAQLGLPLFVKPANQGSSVGVSKVTSEAQFNEAVRLAFEFDHKVVVEQGINGREIECAVLGNDFPQASTCGEVVLNSDFYSYDTKYIDDKGAQVVVPAALDPDVNDKIRAIAVEAYQALGCCGMARVDVFLTPDNEVVINEINTLPGFTNISMYPKLWQASGISYPELITRLIELALERHAADSALKSSVN

SEQ ID NO: 8413 - protein, 364 aa, Enterobacter cloacae
TKYMQRILVDFENLKDNFSKTPLPAFRYTIPLCSTNIRHTMTDLIARPRRLRKSPALRAMFEETTLTLNDLVLPIFVEEEIDDYKAIDAMPGVMRIPEKHLAREIERIANAGIRSVMTFGISHHTDATGSDAWKEDGLVARMSRICKESVPEMIVMSDTCFCEYTSHGHCGVLCDHGVDNDATLLNLGKQAVVAAAAGADFIAPSAAMDGQVQAIRHALDAAGFTDTAIMSYSTKFASSFYGPFREAAGTALKGDRKTYQMNPLNRREAIRESLLDEAQGADCLMVKPAGAYLDILRDIRERTELPLGAYQVSGEYAMIKFAAQAGAIDEEKVILESLGAIKRAGADLIFSYFALDLAEKKILR

SEQ ID NO: 8414 - protein, 652 aa, Enterobacter cloacae
IVVQENIMNRILVGIIFSLFITTGYIAFLVYDRQQELQKLTHYTESWSVAQLVSEYYRFESWIGLYATETDDVTVDQVRMRLEIMLSQNDLLKEGGLGRYINSEKAHQALALRLENILNYLDGHLEKMSRSELKLYLNNMHSLDAPLSQLSSTALTKDVNTINETNLKIQVLYYIYSALSLLLVILSFILGFLIIYQNKNILKAHMQVKTLAEELQLSKETLQIQNTKLEYDVYHDSLTGMKNRLFFWDDLNKLNLQAEKKHISVTVMLFDLDRFKEVNDTYGHDTGDLLLREVSTRLNALGRFSETFYRLGGDEFAFLSSGLTETAAVSRAREISDSISKPYTINNQLIKIATCVGIVLSDNERRSDYLYKFADLALYEAKKEGSQQIKVFRQRMLQKLQESRTLENDMARAIENDEFVVYYQPIVNSVSKEIYGYEALIRWMHPVKGMLAPDSFIFAAEKTGMINEIGKTVLKLACREAVSWTVPARISVNVSPVQLGSKSFINTVQSVLAETGLPANRLELEVTESSLFSDRNNPIAILKKLRALGVRISIDDFGTGYSSLSRLSELNFDKIKIDKSFVNPISTQEDALNIVKLITGMAKSLNMGVIAEGVETEEQLERLQALGCELVQGYLFSKPQPQVDSKIKSGQE

SEQ ID NO: 8415 - protein, 60 aa, Enterobacter cloacae
SNSFSMMFDNSGDITPPCGTPSLAARKRPTSICPALMVFHSRVMKRASLILRRTAFISSR

SEQ ID NO: 8416 - protein, 147 aa, Enterobacter cloacae
IRRDGSVAAHVASLRCISLIIKGLHLVRSVNSRRKHIQTASLRHVMGFPHRGLLRKLRQPARHRSHAPLTSVADLPRFTCLDSGILRRLPVALFILACRKLAEVSNASVIDAAAPVFRIHVKTPSTGSAYVSLPVPPARPVRSRRPW

SEQ ID NO: 8417 - protein, 140 aa, Enterobacter cloacae
TLLPRCFAYMSKHLRPAVLTYHCQFLLHGLSDHVGRGDVFNPQRRINGFMFFSLSVLNLEDHLGLVISPQSPLSAGYITLRACRRSLPLRFSTVTPGGIVGFLIVSYRFNIPDRLAVHLSIHARPELRAHYTSHRRTTPD

SEQ ID NO: 8418 - protein, 173 aa, Enterobacter cloacae
NGKRHIKKGYRAFDVRLPEQFSLIEKLRAQYPVVTLCQVFGVHRSSYKYWVKSPEKPDGKRAVLRSQVLELHNISHGSAGARSIAIMATLRGFRMGRWLAGRLMKELGLVSCQQPTHRYKRGGHEHIAIPNHLERQFAVTESNQVWCGDVTYSVPGVQGGHGCLNEPRVCLEY

SEQ ID NO: 8419 - protein, 509 aa, Enterobacter cloacae
RPLIISEMQRKLATWAATDPSLRIQRLLRLITQPEWLAEAARITLSSKGAHTPGVDGVNKTMLQARLAVELQILRDELLSGHYQPLPARRVYIPKSNGKLRPLGIPALRDRIVQRAMLMAMEPIWESDFHTLSYGFRPERSVHHAIRTVKLQLTDCGETRGRWVIEGDLSSYFDTVHHRLLMKAVRRRISDARFMTLLWKTIKAGHIDVGLFRAASEGVPQGGVISPLLSNIMLNEFDQYLHERYLSGKARKDRWYWNNSIQRGRSTAVRENWQWKPAVAYCRYADDFVLIVKGTKAQAEAIREECRGVLEGSLKLRLNMDKTKITHVNDGFIFLGHRIIRKRSRYGEMRVVSTIPQEKARNFAASLTALLSGNYSESKVDMAEQLNRKLKGWAMFYQFVDFKAKVFSYIDRVVFWKLAHWLARKYRTGIASLMRWWCKSPKPGQSKTWVLFGKTNHGKLSGEILYRLVGQGKKLFRWRLPEGNPYLRTETRNTYTSRFTEVAMAFASI

SEQ ID NO: 8420 - protein, 69 aa, Enterobacter cloacae
GRMTITVGYPQTNRKTDTGKTLKPWPVLVDHFKQLNPSMLHFLAECLTLSVERRHNPKGYTASVMLSRH

SEQ ID NO: 8421 - protein, 318 aa, Enterobacter cloacae
CGTGRDRSDRRDRLWIRTGTARATASPDALAWRNTMSERLTIIPLGPYIGAQVSGLDVTRPLSDNQFEQLYHAVLRHQVVFLREQAITPHQQRALALRFGDLHIHPVYPHAEGVEEIIVLDTHNDNPPDNDNWHTDVTFIDTPPAGAILAAKLLPETGGDTLWASGIAAFEALSAPLQTLLSGLRAEHDFKKSFQEYKYRKTEEEHQRWLDAVEKHPPLLHPVVRTHPVTGKQALFVNEGFTTRIVDVAEKESEALLGFLFAHITKPEFQVRWRWQENDLAIWDNRVTQHYANADYLPQRRIMQRATILGDKPFYRAV

SEQ ID NO: 8422 - protein, 143 aa, Enterobacter cloacae
GMKLGYDWKPNLSGYVTPYAAISGLFQSRDEYQLSNDMRIDGQSYDSMRYEVGVDAGYTFNTGGEQALTPYFKLAYVYDDADNNADINNDSIDNGVEGSAVRVGLGTQFSFTKNFSAYTDATYLGGGDVDQNWGANLGVKYTW

SEQ ID NO: 8423 - protein, 412 aa, Enterobacter cloacae
QQEGSTMFKSFFPKPGPFFLSAFIWALLAVIFWQAGGGAWLTRLTGATGDIPISAARFWSMSYLLFYAYYVLCVGLFAMFWFVYSPHRWQYWSILGTSLIIFVTWFLVEVGVAVNAWYAPFYDLIQTALSSPHKVTINQFYHEVGIFLGIALIAVVIGVMNNFFVSHYVFRWRTAMNEHYMAHWQHLRHIEGAAQRVQEDTMRFASTLEDMGVSFINAIMTLIAFLPVLVTLSSHVPELPIVGHLPYGLVIAAIVWSLMGTGLLAVVGIKLPGLEFKNQRVEAAYRKELVYGEDDANRASPPTVRELFGAVRRNYFRLYFHYMYFNIARILYLQVDNVFGLFLLFPSIVAGTITLGLMTQITNVFGQVRGSFQYLISSWTTLVELMSIYKRLRSFERELDDKDVQEVTHTLG

SEQ ID NO: 8424 - protein, 369 aa, Enterobacter cloacae
KGIAMPFAVPRALPLTLLAAFVLAGCAEKGAAPLKEGEKPVDVASVVRQKMPASVKDRSEWADALATTFKSQKIAPTEENICSVLAVAQQESMYQSDPVVPGLNKIAWKEIDRRAESMHIPVFLVHTALKITSPNGKSYSERLDTVKTEKQLSAIFDDFINMVPMGQKLFGSLNPVHTGGPMQVSIAFAEKHTDGYPWGIDGTVRQEVFSLRGGLWFGTYHLLNYPANYDKPLYRFADFNAGWYASRNAAFQNAVSRASGVKLALDGDLIAYGSSEAGTTERAVRKLSTKLEMSNNDIRRQLEKGDSLAFEKTDLYKQVFALAEKKSGKALPRAILPGIQLESPKITRNLTTAWFAKRVNDRRARCMGL

SEQ ID NO: 8425 - protein, 131 aa, Enterobacter cloacae
PHAAQRCVKWFTEFGHLNRGDMLISEQYRCPNEKRNFSAEFKRESAQLVLDQNYTVAAAASAMDVGLSTMTRWVKQLRDERQGKIPKASPITPEQIEIRELKKKLQRIEMENDILKKATALLMSDSLNSSR

SEQ ID NO: 8426 - protein, 474 aa, Enterobacter cloacae
MSIRLEGNMQTEQQNGQLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWTWCVVFCVVIFALNVISTRFFAEGEFWFSLVKVITIIAFIILGGAAIFGFIPMQDGSPAPGLSNITAEGWFPHGGLPILMTMVAVNFAFSGTELIGIAAGETENPHKVIPVAIRTTIARLIIFFIGTVFVLAALIPMQQAGVEKSPFVLVFEKVGIPYAADIFNFVILTAILSAANSGLYASGRMLWSLSNEKTLPRCFARVNKNGVPLTALSVSMLGGVLALFSSVVAPDTVFVALSAISGFAVVAVWISICASHFVFRRRHVQSGQPLSALQYRAPWYPLVPVLGFILCLVACVGLWFDPSQRIALYCGLPFVALCYGAYYLTRNLTTQEPEHVAE

SEQ ID NO: 8427 - protein, 345 aa, Enterobacter cloacae
RFFFIPLSKFSRRKYCSHNNKGADIMAISSRITLLGALALWAFQAQAVDVTVAYQTSAEPAKVAQADNTFAKASGANVDWRKFDSGAAIVRALASGDVQIGNLGSSPLAVAASQQVPIEVFLLASQLGNSEALVVKKSITKPEDLIGKRIAVPFISTTHYSLLAALKHWGIKPGQVQIINLQPPAIIAAWQRGDIDGAYVWAPAVNELEKEGTVLTDSEKVGQWGAPTLDVWVVRKDFAEKHPEVVKAFAKSAIDAQQPYISNPDEWLKQPTNLEKLSRLSGVPEADVPGLVKGNTYLTPAQQVQQLNGPVSKAIVDTATFLKEQGKVPAVAADYSQFVTDRFVK

SEQ ID NO: 8428 - protein, 281 aa, Enterobacter cloacae
ATGGVLMSIVFSEKTRRTRLALRWPFSRQITLSVSTLVVLLAVWWAVAAQQWVSPLFLPPPGQVLEKLITIAGPQGFMDATLWQHLGASLTRILVALLAAVIIGVPVGIAMGLSPTVRGILDPLIELYRPVPPLAYLPLMVIWFGIGETSKILLIYLAIFAPVAMSALAGVKSAQQVRIRAAQSLGASRAQVLLFVILPGALPEILTGLRIGLGVGWSTLVAAELIAATRGLGFMVQSAGEFLATDVVLAGIAVIAAIAFGLELGLRALQRRLTPWHGEIQ

SEQ ID NO: 8429 - protein, 796 aa, Enterobacter cloacae
WTNLLTSLRRDDPMQTWKKKLVVSQLALACTLAIASQANAKDISGTTYNTFGYDNTASTPWYYGYADWNYSDATHDGDIYPVVNKSTVNGVISTYYLDDGVNGRANALSISNSTINGMITSECMTTTCADGVDTDGTAHTQYDRFSLTVDNSTINDTYEHYAYDVVNGETTETHYLDTYDLGNAITLDVESDIVIQNNSHVAGITLTQGYQDLDNTPYDGVEGVANSSNVFTDTLVVKDSVLTSGAYSDLGTSGFYGQTAKPSDYGETNATAADDAALIVVAGASDNAMQTTATFDHSTITGDILFSSTFDNNFYENGDPATDTTDDGIYNPTTNGWDDTDKLDVTLTNGSKWVGAAQSSVEAIGTAQMYGEGYSNVDWHALSPNSIWPDSTFDSNGHVAGEEVYQSGLFNVALDNGSEWDTRKISNIDALTVNNQSQVNVENSGLLADSITLTNASSLNIGDNGAVATDSLYLDSYSRAALTEETAELYANTITVDNGAELALGLGQVDTHNMVLTDGGVLNVASRDYVLNSDLNNARYITNDRNKADYDYGVVALNSDGHLAVNGDVAGNYKVRIDDATGAGSVADYKNKEIIRVSDNNADTAASFTAANKADLGAYTYQAQQKGDTVVLQQEELTDYANMALSIPSANTNIWNLQQDTVGTRLTNSRHGLADNGGAWVSYFGGNFDADNGTVSYDQDVSGIMVGLDTQIDGNNAKWIVGGAAGFAKGDISDRTGQVDQDSQTAMIYASAKFMNDIFLDSSLSYTRFNNDLSATMSNGQYVDGNTTTEPVGFRG

SEQ ID NO: 8430 - protein, 212 aa, Enterobacter cloacae
LEVCMNVNAKPLSELSRLIKCLEIAGTPFKTEPQQLITTGNNDDEPLTVVIQSGLTAVHRKSDELLMGIARAPYIHGLSAWINDNYLEYSLIAQTPCTGFYLPASTACELIQEAHVWQEAFCWLSWLNHLLGKRDIQLIGNNSYSQIRAMLLNMAEWDDALRSKIGVMNHIQRSTRISRSVVAEVLAALRQGNYINMSRGKLVSINRLPTDY

SEQ ID NO: 8431 - protein, 168 aa, Enterobacter cloacae
SDYALPLTLLWTGRRWAYLAIVLDLFARKPVGWAMSFSPDSKLTIKALEMAWETRDKPAGVMFPSDQGSHYTSRQIRQLLWRYRIRQSMSRRGNCWDNSPMERFFRSLKNEWVPVTGYINFSEAAHAITDYIVGYYSSVRPHDYNGGLPPNESENRYWKNSKAVASFG

SEQ ID NO: 8432 - protein, 91 aa, Enterobacter cloacae
RLYRQRYVIAPLTQTLPSQSTPACTSHDVQALSSAPPEPPARSHRLGFPPASAAWSSILRLRTCPSLPGQPAPFQPGHSPVDRKTQPDRAE

SEQ ID NO: 8433 - protein, 316 aa, Enterobacter cloacae
PRRSLNMSQNNPLTALLENQPFVVLDGAMATELEARGCNLADSLWSAKVLMENPELIRDVHLDYYRAGAQVAITASYQATPAGFAARGLDESQSRALIGKSVELARKAREVYLAENANAGTLLVAGSVGPYGAYLADGSEYRGDYVRSAEEFTAFHRPRVEALLDAGADLLACETLPSFTEIKALAALLTAYPRARAWFSFTLRDSEHLSDGTPLRDVVSALENYPQVVALGINCIALENTTSALTHLHSLTSLPLVVYPNSGEHYDAVSKTWHHHGEACETLAGYLPQWLAAGAKLIGGCCRTTPKDIAALTVQR

SEQ ID NO: 8434 - protein, 260 aa, Enterobacter cloacae
NKGAAMLNITNLSADYGGKPALEAINLTLDSGELLVVLGPSGCGKTTLLNLIAGFVPYQHGSIQLEGKRVTGPGAERGVVFQNEGLLPWRNVQENVAFGLQLAGVAREQRLNTARDMLKKVGLEGAEKRFIWQLSGGQRQRVGIARALAANPQLLLLDEPFGALDAFTREQMQTLLLRLWHETGKQVLLITHDIEEAVFMATELVLLSPGPGRVLERLPLEFARRYVAGEPVRSIKSDPLFIEQREYVLSRVFEQREAFS

SEQ ID NO: 8435 - protein, 83 aa, Enterobacter cloacae
EDSFFSAGVVMKLTSKLRRDWHYYAFAIGLIFILNGVVGLLGFEAKGWQTYAVGLVTWVISFWLAGFIIRRRPDETTTAEKTD

SEQ ID NO: 8436 - protein, 224 aa, Enterobacter cloacae
SSAEIWINCDLFHKYDDWEDKTPKSARPHLWRYVIARNLLICRRIRLKMKTISVMESWKVNLISVWFGCFFTGLAISQILPFLPLYVSQLGVTSHEALSMWSGLTFSVTFLVSAIVSPMWGSLADRKGRKLMLLRASLGMAIAILLQAFATNVWQLFILRAIMGLTSGYIPNAMALVASQVPRERSGWALSTLSTAQISGVIGGPLLGGFLADHVGLRAVFIIT

SEQ ID NO: 8437 - protein, 388 aa, Enterobacter cloacae
GEDDRDIRDPMELMDEVENELKIACAPITWPIGCGKLFKGVYHLYKDETYLYQTGKGHTIQEVRIVKGLDNPDLDAAVGEELAAQLHDELELVKGASHEFDRELFLSGEITPVFFGTALGNFGVDHMLDGLVEWAPQPMPRKTDTREVEAKEEKFSGFVFKIQANMDPKHRDRVAFMRVVSGKYEKGMKLRQVRIGKDVVISDALTFMAGDRSHVEEAYPGDIIGLHNHGTIQIGDTFTQGEMMKFTGIPNFAPELFRRIRLRDPLKQKQLLKGLVQLSEEGAVQVFRPIANNDLIVGAVGVLQFDVVVARLKSEYNVEAIYESVNVATARWVECSDVKKFEEFKRKNEVQLALDGGDNLTYIAPTMVNLNLTQERYPDVQFRKTREH

SEQ ID NO: 8438 - protein, 243 aa, Enterobacter cloacae
KELKMATPHINAEMGDFADVVLMPGDPLRAKHIAETFLEDVREVNNVRGMLGFTGTYKGRKISVMGHGMGIPSCSIYTKELITDFGVKKIIRVGSCGAVRMDVKLRDVVIGMGACTDSKVNRIRFKDHDFAAIADFDMVRNAVDAAKALGVDARVGNLFSADLFYSPEGDMFDVMEKYGILGVEMEAAGIYGVAAEFGAKALTICTVSDHIRTHEQTTAAERQTTFNDMIKIALESVLLGDKE

SEQ ID NO: 8439 - protein, 462 aa, Enterobacter cloacae
TVAKAPKRAFVCNECGADYPRWQGQCSACHAWNTITEVRGVAASPSVARNERLSGYAGNAGVSKVQKLSDISLEALPRFSTGFKEFDRVLGGGVVPGSAILIGGNPGAGKSTLLLQTLCKLAEQMKTLYVTGEESLQQVAMRAHRLGLPTGNLNMLSETSIEQICMIAEEEQPKLMVIDSIQVMHMADIQSSPGSVAQVRETAAYLTRFAKTRGVAIVMVGHVTKDGSLAGPKVLEHCIDCSVMLDGDADSRFRTLRSHKNRFGAVNELGVFAMTEQGLREVSNPSAIFLSRGDEITSGSSVMVLWEGTRPLLVEIQALVDHSMMGNPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKIPEGMQVFGVKKLADALNVFDDL

SEQ ID NO: 8440 - protein, 301 aa, Enterobacter cloacae
TIMFKQLQDMALFALVAEMGSFTAAAQKAELPKSSVSQRISQLEQQVGIRLLNRTTRRISLTFAGEHYLVHCREMLAASERAEYAIQRLRENPSGRLRITCPAGIGATLLAHMNAEFQLRYPDVSLDVSISDDVVDLVESGFDVALRTGKPQDSSLIGRMIGHCPRYMLASPDYLARREPLIHPRQLVEHRCITHRAWSEWLLRSENEDYRYLPDNAHMTDNLVYARECAIAGAGITLLPAFLLEDKIEKGALVKVLSAWSVEGNDLWLAYPSRKLNSPALMSYIDFAMQFDEVKRYYVGG

SEQ ID NO: 8441 - protein, 137 aa, Enterobacter cloacae
AMPSGRDVTDRRGLCYAVLANEYKRQHNMTQHSPYSSAMAEQRHQEWLRFVELLRQSYDKDLHLPLLQLMLTPDEREALGTRVRIIEELLRGEMSQRELKNELGAGIATITRGSNSLKSAPVELRQWLEAVLLKNAG

SEQ ID NO: 8442 - protein, 143 aa, Enterobacter cloacae
RQNYGLVVNARTGELARGKDANRPLFTTNIINAGVVRHYRTQRLTRADFLQYDLRQRQRGRTRFAALLAAFDDNPAEGRSFVDTSINRDPEVSVWRGGFCIRHAISCASACFLAAKRLFRHTALDADGVNMAGSFAKDLFKCP

SEQ ID NO: 8443 - protein, 191 aa, Enterobacter cloacae
  UNSURE (191)
RKKSMLQVYLVRHGETQWNAERRIQGQSDSPLTDKGVQQAWQVAERARTLGITHVISSDLGRTQQTARIIADACGCDVTLEPRLRELDMGVLEKRPIDTLTETEEGWRRTLVNGTEDGRIPEGESMQELSVRMHAALAECLKLPAGSRPLLVSHGIALGCLVSTILGLPAYAERRLRLRNCSISRIDYHEX

SEQ ID NO: 8444 - protein, 213 aa, Enterobacter cloacae
WAKHRNKSMNMTRLKISKTLLAVTLGSVLVSGSALAESSTMDKAQSSANTAGEKIDSSMNKVGNFMDDSSITAKVKAALVDHDSIKSTDISVKTDNKVVTLSGFVESQTQAEEAVKVAKGVEGVSSVSDKLHVRDSKESSVKGYAGDAATTSEIKAKLLADDIVPSRMVKVETTDGVVQLSGTVENQAQSDRAESIAKAIDGVKSVKNDLKTK

SEQ ID NO: 8445 - protein, 108 aa, Enterobacter cloacae
RGSGMTHCFIDTHCHFDFPPFSGEETSSLARAAEAGVRAIIVPAIEAARFDKVLALARGHDALYAALGLHPIVIEHHLDDHLDRLDATLQNADTKLVAIGEIGLDLYR

SEQ ID NO: 8446 - protein, 155 aa, Enterobacter cloacae
DPQFERQQTILDAQLRLAKRHDLPVILHSRRTHDKLAMHLKRIDVPRRGVVHGFAGSLQQAQRFIELGYKIGVGGTITYPRASKTRDVMAQLPLTSLLLETDAPDMPLNGFQGQPNRPEQAARVFDVLCELRQEPEDVIASALLENTRAVFGITL

SEQ ID NO: 8447 - protein, 412 aa, Enterobacter cloacae
VRRTIMKRAFIMVLDSFGIGATEDAERFGDVGSDTLGHIAEACAKGEADNGRKGPLNLPNLTRLGLVKAHEGSTGKIAAGMDGNAEVVGAYAWAHELSSGKDTPSGHWEIAGVPVLFDWGYFSDHENSFPQELLDKLVKRANLPGYLGNCHSSGTVILDQLGEEHMKTGKPIFYTSADSVFQIACHEETFGLDKLYELCEIAREELTEGGYNIGRVIARPFIGDKAGNFQRTGNRHDLAVEPPAPTVLQKLVDEKDGHVVSVGKIADIYANCGITKKVKATGLDALFDATIKEMKEAGDKTIVFTNFVDFDSSWGHRRDVAGYAAGLELFDRRLPELMELVGEDDILILTADHGCDPTWTGTDHTREHIPVLVYGPKVKPGSLGHRETFADIGQTIAKYFGTSDMEYGKAMF

SEQ ID NO: 8448 - protein, 356 aa, Enterobacter cloacae
NLRLNVARSDGYRVASCVIFPLEPSGANEITGASMPNITWCDLPTDVSLWPGLPLSLSGDEVMPLDYHAGRSGWLLYGRGLDKQRLTQYQTKLGAAMVIVAAWCVEDYQVIRLAGSLTQRATRLAHDAGLDVAPLGKIPHLKTPGLLVMDMDSTAIQIECIDEIAKLAGSGELVAEVTERAMRGELDFTASLRQRVATLKGADANILRQVRDELPLMPGLTQLVLKLETLGWKVAIASGGFTFFADYLRDKLRLTTVVANELEIMDGKLTGQVIGDIVDAQYKANTLTRLAEKYAIPVEQTVAIGDGANDLPMIKVAGLGIAYHAKPKVNEKTEVTIRHADLMGVFCILSGSINQK

SEQ ID NO: 8449 - protein, 589 aa, Enterobacter cloacae
KTATEVAVLLLFRNTLVLNTLRLQRVCAQRAFLVLFVFGEVTFEELHLTFVLVVQDVGRDTVQEPAVVRDNHRAARELQQGVFQCAQGFDVQVVGGFIEQQNVAANLEQFRQVQTTAFAAGQFAHAFALVGALEVKAANIGAAWHLGVADTHDIQTAGDFFPHGFAVVHRVAELVNGGQLHGLTQGDRAAVRLFLTRHHAEQGGFTRAVRTDDADDSAFRNGEGQIVDQHAVAVGLTQVSHFNHFIPQTSSRWNKQFVGFVTFLVFGVVQLFEACQTGFALRLTAFRALTHPLQLFLNRLTAGGFLRRFLRQTLVFLLQPGGVVAFPRNTFAAVQLQDPARNVVEEVTVVGNRYHGAFEVMQEALQPRHGFGIQVVGRFVEQQHVWFFQQQAAQRHAAAFTTGQVSDFRIPVWQTQGISRALQLHVQVVTIVRLDNFLIFALLSGQFVEVRIRLGVFGIHFIQTFQGVNHLGYRFFNGFTHGVLRVQLRFLRQVADLNARLRTGFTFDVCIDAGHDAQQGGLTGTVETQNTDFCAREEAQRDIFKNMTFRRDNFADTMHGINELSHVGLRLFYRDENEFQPRSVAFFTP

SEQ ID NO: 8450 - protein, 370 aa, Enterobacter cloacae
EPPGKCVTVSHHNNENRKAEVGQRIPVTLGNIAPLTLKPFHADQLALVCEGGGQRGIFTAGVLDEFMRAQFNPFDLYFGTSAGAQNLSAYVCNQPGYARKVIMRYTTSKEFFNPVRFVRGGNLIDLDWLLDATSSQMPLAMDTASRLFDTGKEFWMCASRGDDYSPGYFSPQKENWLDIIRASSAIPGFYRTGALLEGISYLDGGISDAVPVQEAARRGAKTIVVIRTVPSQMYYTPQWFKRMERWLGDSSLQPLVNIAKQHETTYGAMQRFIEKPPGKLRIFEIYPPKPLLSMALGSRLPALRMDYKTGRLCGRYFLATVGKMLAEQPPLHRHKSIILPPAVVANDAVAMPLVDAPQANDGLLDNEDLA

SEQ ID NO: 8451 - protein, 315 aa, Enterobacter cloacae
SAINALKFEEDLITVMQICTQFSLTVMNVEVWMRVNVRILTDPQGKIYTALPLENVMTDLTASSLRALKLMDLTTLNDDDTNEKVIALCHQAKTPVGNTAAVCIYPRFIPIARKTLKEQGTPEVRIATVTNFPHGNDDIEIALAETRAAIAYGADEVDVVFPYRALIAGNEQVGFDLVKACKDACAAANVLLKVIIETGELKEEALIRKASEISIKAGADFIKTSTGKVPVNATPESARIMMEVIRDMGVSKTVGFKPAGGVRTAEDAQQFLAIADELFGADWADSRHYRFGASSLLASLLKALGHGDGKSASSY

SEQ ID NO: 8452 - protein, 473 aa, Enterobacter cloacae
VELPGGATLTRPKGSWGGSTYPPPFTRFRMEVTVFLAQEIIRKKRDGHALSDEEIRFFINGIRDNTISEGQIAALAMTIFFHDMSMPERVSLTMAMRDSGTVLDWKSLNLNGPIVDKHSTGGVGDVTSLMLGPMVAACGGYIPMISGRGLGHTGGTLDKLEAIPGFDIFPDDNRFRDIIKDVGVAIIGQTSSLAPADKRFYATRDITATVDSIPLITASILAKKLAEGLDALVMDVKVGSGAFMPTYELSEALAEAIVGVSNGAGVRTTALLTDMNQVLASSAGNAVEVREAVQFLTGEYRNPRLFDVTMALCVEMLISGKLAKDDADARAKLQAVLDNGKAAEIFGRMVAAQKGPTDFVENYAKYLPTAMLSKAVYADSEGFVSAMDTRALGMAVVSMGGGRRQASDTIDYSVGFTDMARLGDSVDGQRPLAVIHAKDEASWQDAAKAVKAAISLDDKAPETTPTVYRRITE

SEQ ID NO: 8453 - protein, 85 aa, Enterobacter cloacae
NSGAGGSLNDGQPAARGGRSGTEPPGDPAGGAAPSRRSANGGSGRVRQCGWWGEGYGNQRGPGAAAGNGFQPARQTVAAGSGGIW

SEQ ID NO: 8454 - protein, 411 aa, Enterobacter cloacae
FMSSFDYIKTAIRQKGCTLQQVADASGMTKGYLSQLLNAKIKSPSAQKLEALHRFLGLEFPRMQKNIGVVFGKFYPLHTGHIYLIQRACSQVDELHIIMGYDETRDRQLFEDSAMSQQPTVPDRLRWLLQTFKYQKNIRIHAFNEEGMEPYPHGWDVWSNGIKAFMEEKGIAPNWIYTSEESDAPQFREHLGIETVLIDPKRTFMNISGAQIRENPFRYWDYIPTEVKPFFVRTVAILGGESSGKSTLVNKLANIFNTTSAWEYGRDYVFSHLGGDEMALQYSDYDKIALGHAQYIDFAVKYANKVAFIDTDFVTTQAFCKKYEGREHPFVQALIDEYRFDLVILLENNTPWVADGMRSLGSSVDRREFQTMLVEMLNENNVEFVHVEESDYDTRFLRCVELVKEMMGEQG

SEQ ID NO: 8455 - protein, 660 aa, Enterobacter cloacae
RGKTLQLTKNNEEELVEKAKRVVWRLLAASVCVMAVSQAVHADSLDEQRSRYAQIKQAWDNKQMDTVQALMPTLKDYPLYPYLEYRQITDDLMNQPTVTVNNFIQANPTLPPARTLKSRFVNELARREDWRGLLAFSPDKPGATEAQCNYYYAKWATGQQEEAWVGAKKLWLTGKSQPNACDPLFSAWRASGQQDPLSYLERIRLAMKAGNTRLVTVLAGQMPADYQTIASAVIGLANDPNTVLTFARTTGATDFTRQMAAVAFASVARDDVENARLMIPQLVQAQQLNDDQTQELRDIVAWRLMGTDVTDEQARWRDDAVMRSNSVSLVERRVRMALGTGDRRGLNTWLARLPMDAKEKDEWRYWQADLLLERGRDDEAKEILHSLMQQRGFYPMAAAQRLGEEYTLKIDKAPANANPALTQGPEMARVRELMYWNLDNTARSEWANLVTSRTTEEKAQLARYASDNRWWDLSVQATIAGKLWDHLEERFPLAYKDLFDRYTSGKDIPQSYAMAIARQESAWNPKVRSPVGASGLMQIMPGTATHTVKMFNIPGYSSPSQLLDPETNINIGTSYLQYVYQQFGNNRIFASAAYNAGPGRVRTWLGNSAGRIDAVAFVESIPFSETRGYVKNVLAYDAYYRYFMGQKDTLMSDAEWQRRY

SEQ ID NO: 8456 - protein, 188 aa, Enterobacter cloacae
HAFFPLYCDEFFKSSLIMHHVVSATTNPAKIQAILRAFEEIFGEGSCHIDAVGVESGVPEQPFGSEETRAGARNRVANAKAAAPDADFWVAIDAGIDEGATFSWVVIESREQRGEARSATLPLPEVILEKVRAGEALGPVMSHYTGIDDIGRKEGAIGVFTAGKLTRSSVYHQAVILALSPFHNAIYR

SEQ ID NO: 8457 - protein, 346 aa, Enterobacter cloacae
TSLNKTNAIEEHTMSVKAIAVNPENPSTFVEITPPMPQPGEHDLLVEVKAVSVNPVDTKVHAGIAKSGLKEPRILGWDASGIVKAVGAGVTGFKPGDEVWYAGDITRPGSNTTHQLIDARIVGHKPASLDWAAAAALPLTALTAWEGLFERLKIQDADADKTLLIIGGAGGVGSLAIPFAKHNSKVKIVATASREDSAQWCRDRGADIVVNYRDLKGEMAKQGLTFVDYIFILNDTDGHWDAVSDLIAPQGHICSIVENAHPLNQDKLKSKSAALHWEFMYTRSMYQTADMARQGEILNEVAKLVDNGVVESSLSETLHGLSVESITEAHRKVLEGHMRGKVVVEY

SEQ ID NO: 8458 - protein, 106 aa, Enterobacter cloacae
ISLIINPIKCELCLLLTEEVFCQVKGLILMSVESTIAQCAIAAPLLFSALFAQAYAAGMVPETTLLVIEESTHSGTMNVKNTDTFPALIYTIIVDLPDDTGVTLNA

SEQ ID NO: 8459 - protein, 542 aa, Enterobacter cloacae
LNRRYPLSDQSATRLASYNSFTIRRTTKEVNMPDALQQRCQHIVTSPVLTPEQKRHFLALEAENNLPYPALPEAARAALDEGFICDMFEGHAPYKPRYVLPDYAKFLANGSEWLELEGAKDLDDALSLLTILYHHVPSVTSMPVYLGQLDEILSPYVKILTQDEIDSRIKRFWRYLDRTLPDAFMHANIGPADTPVTRAILRADAELKQVAPNLTFIYDPDVTPSDLLLSVAKNICECSKPHISNGPVNDKIFTKGRYGVVSCYNSLPLAGGGSTLVRLNLKAIAEHSRSPEDFFTRTLPHYCQQQIAIINARCDFLYEQSGFFENSFLVKEGLIDADRFVPMFGMYGLAEAVNVLCQKAGITGRYGKNEQANALGYRISEQLAAFVENTPVKHGWKQRAMLHAQSGISSDSGTTPGARLPYGDEPDPISHLLAVAPHHKHYASGISDILTLDETVKRNPQAVVQLCLGAFRAGMREFTANVAGNDLVRVTGYMVRLSDLEKYREAGSRTNTTWLGEEAARNTRILERQPRVISHEQQMRFS

SEQ ID NO: 8460 - protein, 587 aa, Enterobacter cloacae
HSRRSWLGLGREKGYTSRLKFILITIKEAKSNVAQFVYTMHRVGKVVPPKRHILKNISLSFFPGAKIGVLGLNGAGKSTLLRIMAGIDTDIEGEARPQPGIKIGYLPQEPQLNPEHTVRESVEEAVSEVVNALKGLDEVYAKYAEPDADFDKLAAQQGKYEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGAKGRQSKGKARLARFEELNNTEYQKRNETNELFIPPGARLGDKVVEVTNLRKSYGDRVLIDDLTFSVPKGAIVGIIGPNGAGKSTLFRMMSGQEQPDSGSITLGETVKLASVDQFRDAMDNSKTVWEEVSGGLDIMRIGNTEMPSRAYVGRFNFKGTDQGKRVGELSGGERGRLHLAKLLQVGGNVLLLDEPTNDLDIETLRALENALLEFPGCAMVISHDRWFLDRIATHILDYQDEGKVEFFEGNFTEYEEYKKRTLGADALEPKRIKYKRIAK

SEQ ID NO: 8461 - protein, 220 aa, Enterobacter cloacae
ILSRWNMARAKLKFRLHRAVIVLICLALLVALMQGASWFSQNHQRQRNPQFEELGRTLARQVTLNVAPSMRTETPDDKRIALVLRQLTENSRILDAGVYDEQGDLIARAGEHVDVRDRLALDGKKAGGYFNQQIVEPIQGKNGPLGYLRLTLDTHTLPTEAKQVDNTTNILRLMLLLSLAIGVVLARTLLQGKRTRWQQSPFLLTASKSVPEEEESEKKE

SEQ ID NO: 8462 - protein, 349 aa, Enterobacter cloacae
SRRMIRKRNSAMSTLRLLISDSYDPWFNLAVEECIFRQMPATQRVLFLWRNADTVVIGRAQNPWKECNTRRMEEDNVRLARRSSGGGAVFHDLGNTCFTFMAGKPEYDKTISTSIVLNALNSLGVTAEASGRNDLVVKTPDGDRKVSGSAYRETMDRGFHHGTLLLNADLSRLANYLNPDKKKLQAKGITSVRGRVANLVELLPGITHEQICDAIREAFFEHYGERVEAEVISPDKTPDLPNFAETFARQSSWEWNFGQAPAFSHLLDERFTWGGVELHFDVEKGHITRTQVFTDSLNPAPLEALAARLQGCLYHADSLQQACEALWVDFPDHERELRDLSQWIAGAVR

SEQ ID NO: 8463 - protein, 231 aa, Enterobacter cloacae
GLTMKKIIIATAVAMTLSATAHADSTAVLKLKGVLTNNACTPTLSDGAVVDFGTKYISSLSATADNQLGYKDISLTINCSAATKVAWSITDDHADSMKKMTIDNATFAGDQAWSSTNQYGVGKTAGGVNIGAYSVGMNSNVTVDGNVKALGYSAIADDPMWLLANTGSQLVTHSDGSIQYSALNSSDRTLVPFMNAVFPLRVALAVQKTDTLAITDDTPIDGQATITLHYL

SEQ ID NO: 8464 - protein, 232 aa, Enterobacter cloacae
GTTMKKILVATAVALALSATAANAASTAVLKVTGLLSVAACTPQLSGGGEVDYGLIHLADLSATSVNQLGQKDISLTITCPVATKAGWTISDDRADTHPGASVITINTADAAGGNVSDTTQSYGVGKTAGGVKIGAYSIFADVANVTADGVKSDVISGTVDSPSWQKTATGIIKNANMEMMTVAASGTTAPLPFTTAVFPLKTSLAIQNTAALAITDDTNLDGQATITVKYL

SEQ ID NO: 8465 - protein, 287 aa, Enterobacter cloacae
VMNSRCALVSQVIPFSCVDGPGSRLALFLQGCNLRCKTCHNPWTIGRCNDCGDCVPHCPHDALTIQAGRVWWQESHCQQCDTCLHLCQQQATPMAQRYSVEEILSRVLTSAPFIEGVTVSGGEATTQLPFLVALFTAIKADPSLRHLTCLVDSNGLLSETGWQKLFPVFDGAMVDLKAWGNEHHRFLTGRENTLIKQSIRWLADRHRLTELRLLVIPDRCDYLQHLPSLTAFIHTLENVPVRINAFHAHGVYGEAARWRSATPEDIEPLAQALERQQITVIRPALYL

SEQ ID NO: 8466 - protein, 104 aa, Enterobacter cloacae
RRIDLNELLVAHPSSTYFVKAAGDSMIEGGINNGDLLVVDSSRKPEHGDIVIAAVEGEFTVKRLQLRPNIQLNPMNSAYSPIIVGSDDTLDIFGVVTYIVKSAS

SEQ ID NO: 8467 - protein, 189 aa, Enterobacter cloacae
SRHYISPCAAAPRMRRSTGMRVLSPQVAIRYMSRVAAWRLRRKTSAMPIRAPCRSRFPPGIALPESGLRRVSAPLLRLLSIWPAHRKAMQCIPPSKRRCRMHVNVRITTFRYTFAMPPTKLMKEMGYGQEYRYAHDEPNAYAAGEEYFPQEMAQTRYYHPTNRGLEGKIGEKLAWLAGQDQNSPIKRYR

SEQ ID NO: 8468 - protein, 816 aa, Enterobacter cloacae
VFMKIKAPEALMAAEVTRRGLMKTTAIGGLAVASSAFTLPFTRLASAAEALSPASAPEKVVWSACTVNCGSRCPLRMHVVDGEIKYVETDNTGDDNYEGLHQVRACLRGRSMRRRVYNPDRLKYPMKRVGKRGEGKFERISWDEAYDIIATNMQRLIKEYGNESIYLNYGTGTLGGTMTRSWPPGKTLVARLMNCCGGYLNHYGDYSSAQIAAGLNYTYGGWADGNSPSDIENSKLVVLFGNNPGETRMSGGGVTYYLEQARAKSNARMIIVDPRYTDTGAGREDEWIPIRPGTDAALVNALAYVMITENLVDQPFLDKYCVGYDEKTLPASAPANGHYKAYILGQGSDGVAKTPEWASTITGIPVERIVQLAREIGSTKPAYISQGWGPQRHSNGEIATRAISMLSILTGNVGIHGGNSGAREGSYEVPFERMPTLDNPVQTSISMFMWTDAIERGPEMTALRDGVRGKDKLDVPIKMIWNYAGNCLINQHSEINRTHEILQDDKKCEMIVVIDCHMTSSAKYADILLPDCTASEQMDFALDASCGNMSYVIFTDQAIKPRFECKTIYEMTSELAKRLGVEQQFTEGRTQEGWMRHLHELSRKAIPDLPDFDTFRKQGMYKQRDPEGHHVAYKAFRDDPQANPLTTPSGKIEIYSEELAKIAATWELPEGDVIDPLPIYTPGFENYNDPLTEKFPLQLTGFHYKARVHSTYGNVDVLKAACRQEMWINPMDAKARGISNGDRVRIFNGRGEVHIEAKVTPRMMPGVVALGEGAWYNPDANRIDQAGCINVLTTQRPSPLAKGNPSHTNLVQVEKA

SEQ ID NO: 8469 - protein, 383 aa, Enterobacter cloacae
SMTTYTRPVLLLLCGLLLLTLAIAVLNTLVPLWLAHENLPTWQVGMVSSSFFTGNLLGTLLTGSLIKRFGFNRSYYLASLIFAVGCAGLGLMVGFWSWMVWRFIAGVGCAMIWVVVESALMCSGTSRNRGRLLAAYMMVYYVGTVLGQLMVSKLPTDLMSVLPWVTGMVLAAILPLLFTRIVNQNSEHQEATHVWPMLRLRQARLGVNGCIISGIVLGSLYGLMPLYLNHQGVSDSGIGFWMAVMVSAGIVGQWPIGRLADRFGRLLVLRVQVFVVIMGCLAMLSNAAMAPALFILGAAGFTLYPVAMAWACEKVEHHQLVAMNQALLLSYTIGSLLGPTFTAMLMQNYSDNLLFIMIASVSFIYLLMLLRKVGEHPTPVAHA

SEQ ID NO: 8470 - protein, 255 aa, Enterobacter cloacae
RVLSPAKINGWAMLISSNLLLRHRKMKAFDLQRMAFDKVPPEFLGEVALRSLYTFVLVFLFLKITGRRGVRQMSLFEVLIILTLGSAAGDVAFYDDVPMVPVFIVFVTLALLYRLVMWLMSKSEKLEDLLEGKPVVIVEDGQLAWENVQSANMTEFEFFMELRLSSVEQLGQVRLAIMETNGQISVYYYPDDEVKPGLCILPDMLIERYKTVPEAGEYACIKCSHVVVMQAGDHQLCPRCTNPEWTKVSRAKRIT

SEQ ID NO: 8471 - protein, 364 aa, Enterobacter cloacae
GEMAQVFNFSSGPAMLPTDVLKQAQQELCDWNGLGTSVMEVSHRGKAFIKVAEEAEKDFRDLLNIPSNYKVLFCHGGGRGQFAGIPLNLLGDKTTADYVDAGYWAASAVKEAHKYCTPNVIDAKVTVDGLRAVKPMSEWQLSDNAAYLHYCPNETIDGIAIHEEPDFGENVIVTADLSSTILSTPLDVSRYGVIYAGAQKNIGPAGLTIVIVREDLLGKAHKSCPSILDYTVLNDNDSMFNTPPTFAWYLSGLVFKWLKLKGGVAQMDKINQQKAELLYGVIDKSDFYRNDVAKTNRSRMNVPFQLADSNLDNVFLEESFAAGLHALKGHRVVGGMRASIYNAMPLEGVKALTDFMIDFERRHG

SEQ ID NO: 8472 - protein, 155 aa, Enterobacter cloacae
YALRRSFVSSVDEDQKDGRISTVELSKRVGLSPTPCLERVRRLERQGFIQGYTALLNPHYLDASLLVFVEITLNRGAPDVFEQFNAAVQKLEEIQECHLVSGDFDYLLKTRVPDMSAYRKLLGETLLRLPGVNDTRTYVVMEEVKQSNRLVIKTR

SEQ ID NO: 8473 - protein, 1234 aa, Enterobacter cloacae
HTGRTCLIPGEPFLSQEYTEDKEVTLSKLSSGRRLLEALLIVIALFAVWLMAALLSFNPSDPSWSQTAWHEPIHNLGGVPGAWLADTLFFIFGVMAYTLPVIIIGGCWFAWRHRQNDDYIDYFAVSLRLIGALALILTSCGLAAINADDIWYFASGGVIGSLLSSALQPMLHSSGGTLALLCIWAAGLTLFTGWSWVSIAEKIGSFILTLLTFASNRTRRDDTWVDEDEYEDEYEEEDEAPVQRRESRRARILRGALARRQRVAEKFANPLGRKTDAALFSGKRMDEDEQIEYRGAAVDPDDVLFSGHRATPGEYDEYDPLLHGHSVTEPVAAAAAATTAAQAHVAPVEAVMPSSPVPAPESAIQQPQVDWQTAPGVHTPEPTIAPEPESYIPVQQEQCQQSYQPSEPASEPQQPYQAYTPEPAVPEQPYVAPVSEPEVVEEAKPSRPPLYYFEEVEERRAREREQLAAWYQPVPEPVQEPVVKAPSASVAPVDPAPAVASGAETVKQATAAAAASAPLFSPATDSAPRPQVKEGIGPQLPRPNRVRVPTRRELASYGIKLPSQRMAEEKARGSDYEDDADELHQDELARQFAAQQNQRYGDEYQHDVPSHQEDDDAAEAELARQFAATQQQRYSGEQPSGANPFSLSDFEFSPMKDLVDDGPSEPLFTPSVMPEAEPVRQSPPPQVYAQPQQPAPQAYAQPQTPAQPPQPQFQQPAPQPQESLIHPLLMRNGDSRPLQRPSTPLPSLDLLTPPPAEVEPVDTFALEQMARLVEARLADFRIKADVVNYSPGPVITRFELNLAPGVKAARISNLSRDLARSLSTVAVRVVEVIPGKPYVGLELPNKKRQTVYLREVLDNTKFRDNPSPLTVVLGKDIAGDPVVADLAKMPHLLVAGTTGSGKSVGVNAMILSMLYKAQPEDVRFIMIDPKMLELSVYEGIPHLLTEVVTDMKDAANALRWSVNEMERRYKLMSALGVRNLAGYNEKIAEAARMGRPIPDPYWKPGDSMDAQHPVLEKLPYIVVLVDEFADLMMTVGKKVEELIARLAQKARAAGIHLVLATQRPSVDVITGLIKANIPTRIAFTVSSKIDSRTILDQGGAESLLGMGDMLYSGPNSTSPVRVHGAFVRDQEVHAVVQDWKARGRPQYVDGITSDSESEGGGGGFDGGEELDPLFDQAVNFVTEKRKASISGVQRQFRIGYNRAARIIEQMEAQGIVSEQGHNGNREVLAPPPFD

SEQ ID NO: 8474 - protein, 206 aa, Enterobacter cloacae
PMTTQYGFFIDSSRCTGCKTCELACKDYKDLTPEVSFRRIYEYAGGDWQEDNGVWHQNVFAYYLSIACNHCEDPACTKVCPSGAMHKRDDGFVVVDEDVCIGCRYCHMACPYGAPQYNAAKGHMTKCDGCHSRVADGKKPICVESCPLRALDFGPIEELRKKHGQLAAVAPLPSAHFTKPSIVIKPNANSRPTGDTTGYLANPKEV

SEQ ID NO: 8475 - protein, 164 aa, Enterobacter cloacae
CGISLRFLTLILFHFFYTLLQSFRNLHAKVTVAHVGAYNARRSCKRYALIKEKKMTAIAPVITIDGPSGAGKGTLCKAMAEALQWHLLDSGAIYRVLALAALHHHVDVASEEALVPLAAHLDVRFVSTDGNLEVILEGEDVSGEIRTQEVANAASQVAAFPTRS

SEQ ID NO: 8476 - protein, 108 aa, Enterobacter cloacae
AVQLMGLKGTGGIMTKSELIERLASQQPHIPAKAVEDAVKEMLEHMATTLAQGERIEIRGFGSFSLHYRAPRTGRNPKTGDKVELEGKYVPHFKPGKELRDRANIYGN

SEQ ID NO: 8477 - protein, 330 aa, Enterobacter cloacae
NAVRSMIARIWSGESPLWVLLLPLSWLYGLVSGAIRLLYRLGIKRAWRAPVPVVVVGNLTAGGNGKTPVVIWLVEQLQRRGIRPGVVSRGYGGKAAQYPLVLSPATTTAEAGDEPVLIYQRTGAPVAVSPVRSDAVKALLAEHNVQIIITDDGLQHYALARDKEIVVIDGVRRFGNGWWLPAGPMRERASRLKTVDAVIVNGGEARAVEIPMLLRPGQAVNMLTGERKDVAQLEHLVAMAGIGHPPRFFATLEQCGARLEKRVPLADHQALVAEEVERLAAPGQTLIMTEKDAVKCRAFAKENWWYLPVDAELSGEQPEHLLKELLALVQ

SEQ ID NO: 8478 - protein, 259 aa, Enterobacter cloacae
SPFTGGRRDQTMSFVVIIPARYASTRLPGKPLVDINGKPMIVHVLERARESGAGRVIVATDHPDVARAVEAAGGEVCMTRADHQSGTERLAEVVEKCGFSDETVIVNVQGDEPMIPAAIIRQVADNLARRQVGMATLAVPIHHAEEAFNPNAVKVVMDAEGYALYFSRATIPWDRDRFAQSKETIGETFLRHIGIYGYRAGFIRRYVAWAPSPLEHIEMLEQLRVLWYGEKIHVAVAQEIPGTGVDTPEDLERVRVEMR

SEQ ID NO: 8479 - protein, 207 aa, Enterobacter cloacae
GITMKKIAIACALLSSFVASSVWADAASDLKSRLDKVSSFHASFTQKVTDGSGNAVQEGQGDLWVKRPNLFNWHMTQPDESVLVSDGKTLWFYNPFVEQATATWLKDATSNTPFMLIARNQSSDWQQYNIKQNGDEFVLTPKGSNGNLKQFTINVSSNGTINQFGAVEQDDQRSSYQLKSQQNGAVDASKFTFTPPQGVTVDDQRNK

SEQ ID NO: 8480 - protein, 393 aa, Enterobacter cloacae
VSNLSLDFSDNAFQPLAARMRPENLAQYIGQQHLLAAGKPLPRAIEAGHLHSMILWGPPGTGKTTLAEVIARYANADVERISAVTSGVKEIREAIERARQNRNAGRRTILFVDEVHRFNKSQQDAFLPHIEDGTIFFIGATTENPSFELNSALLSRARVYLLKSLTTEDIEKVLTQAMEDKARGYGGQDIVLPDETRRAIAELVNGDARRAMNTLEMMADMAEVDDAGKRVLKQELLTEIAGERSARFDNKGDRFYDLISALHKSVRGSAPDAALYWYARIITAGGDPLYVARRCLAIASEDVGNADPRAMQVALSAWDCFTRVGPAEGERAIAQAIVYLACAPKSNAVYTAFKAAMSDARERPDYDVPVHLRNAPYKADERDGLRAGVSLRP

SEQ ID NO: 8481 - protein, 437 aa, Enterobacter cloacae
FDKHRISMLDPNLLRNEPDAVAEKLARRGFKLDVDKLRALEERRKVLQVQTENLQAERNSRSKSIGQAKARGEDIEPLRLEVNKLGEELDQAKAELDVLQAEIRDIALAIPNIPDDSVPVGKDENDNVEVKRWGTPREFDFEVRDHVTLGEMHAGLDFAAAVKLTGSRFVVMKGQIAHLHRALAQFMLDLHTEQHGYSETYVPYLVNHDTLYGTGQLPKFAGDLFHTRPLDEEADSSNYALIPTAEVPLTNLVRDEIIDEDDLPIKLTAHSPCFRSEAGSYGRDTRGLIRMHQFDKVEMVQIVRPEESMDALEEMTGHAEKVLELLGLPYRRMALCTGDMGFGACKTFDLEVWVPAQNTYREISSCSNVWDFQARRMQARCRSKSDKKTRLVHTLNGSGLAVGRTLVAVLENYQQADGRIEIPEVLRPYMKGQQFIG

SEQ ID NO: 8482 - protein, 311 aa, Enterobacter cloacae
LNLTPTAVRRGTPPATWQTRRRCEMGSGWHEWPLMIFTVFGQCVAGGFIVLALALLKGNLNTEQQQRLVLSMFGLWVLMGIGFIASTLHLGSPMRAFNSLNRVGASSLSNEIASGAIFFAVGGLGWLLAAVKKLPSGLRALWLIVTMVLGVVFVWMMVRVYNTIDTVTTWYSVWTPMSFFLTMFIGGPLLGYLLLRVAGINGWAMRLLPAVSLLALVISTVVALMQGAELATIHSSIQQASALVPDYGSLMAWRVVLLTAALVCWIAPQLKGYSPALPLLSLAFVLVLAGELIGRGVFYGLHMTVGLAIAS

SEQ ID NO: 8483 - protein, 431 aa, Enterobacter cloacae
ELSFMESLTLQPIARVDGTINLPGSKSVSNRALLLAALANGTTVLTNLLDSDDVRHMLNALKALGVQYALSDDRTRCEVTGNGGALHSAEALELFLGNAGTAMRPLAAALCLGSNDIVLTGEPRMKERPIGHLVDALRQGGAQIDYLEQENYPPLRLRGGFTGGNVEVDGSVSSQFLTALLMTAPLAPQDTVISIKGDLVSKPYIDITLHLMNTFGVEVENQSYQRFVVRGAQQYQSPGHYLVEGDASSASYFLAAGAIKGGTVKVTGIGRNSVQGDIRFADVLEKMGAVVTWGDDFISCTHGELNAIDMDMNHIPDAAMTIATAALFAKGTTTLRNIYNWRVKETDRLFAMATELRKVGAEVEEGEDYIRVTPPAKLQFAEIGTYNDHRMAMCFSLVALSDTPVTILDPKCTAKTFPDYFEQLTRISTLA

SEQ ID NO: 8484 - protein, 147 aa, Enterobacter cloacae
SWKGKMSAVKSVPRKWPMRPLRWRLSPRVREALLRRQRGFREAPGLIADGRDMGTVVFPDAPVKIFLDASSEERAHRRMLQLQEKGFSVNFDRLLSEIKERDDRDRNRAVAPLVPAQDALVLDSTSLTIEQVIEKALQYARQKLALA

SEQ ID NO: 8485 - protein, 560 aa, Enterobacter cloacae
RLNMTESFAQLFEESLKEIETRPGSIVRGVVVAIDKDVVLVDAGLKSESAIPAEQFKNAQGELEIQVGDEVDVALDAVEDGFGETLLSREKAKRHEAWITLEKAYEEAETVVGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKNNPWQQFAETHNKGDRVEGKIKSITDFGIFIGLDGGIDGLVHLSDISWNVAGEEAVREYKKGDEIAAVVLQVDAERERISLGVKQLAEDPFNNWVALNKKGAIVNGKVTAVDAKGATVELADGVEGYLRASEASRDRVEDATLVLSVGDDVEAKFTGVDRKNRAISLSVRAKDEADEKDAIATVNKQEDANFSNNAMAEAFKAAKGE

SEQ ID NO: 8486 - protein, 759 aa, Enterobacter cloacae
NMEVKMGIHVISMCAILAIIPLYWLPVLPDLHIVWLLIAAGIALSVQQRKWLRFSGLALLFMCWGILAAQESVWPMNHLTKVPQQAEVVITATDGATMHQGRIVSLNGERVWAAMGVALYGNYLPQNVCVGQRWAMTLRLRAVHGELNDGGYDSQKNAFVRHQTLSGRFTHAALVDEGCSLRAQYLTSLQSTLSAYQWGPVILGLGMGERLSVSREIKNLMRETGTMHLMAISGLHIALAASVIWFLARGIQFFLPGRWIIWQIPLLAGLIFAAFYAWLTGLQPPALRTVIALVVLAVLKMSGRQWSPWQVWLTCVAAILVFDPLAVLSQSLALSAFAVAALIFWYQWLPLPLWQRGRCLRPLVTLLYLQVGMLLLLLPLQVLIFHGFSLSSLAANLFAVPLVTFISVPLILLGMFLHLFPVATLESIVWLAADKSLAGLFWLLMRLPNGWQDVDERWQYLTLLPWLLIIGWRFRAFSAVPAVCLAGSVVLAFPLWHRAKTDSWSLHMLDVGQGLAMVIERHGKAILYDTGLAWPGGDSGQQLIIPWLRWHHLRPEGVILSHEHLDHAGGLASLKAAWPAMWIRSPLSWAGHLPCFRGERWQWQGLTFSVHWPPENTSAKGNNRSCVVKIDDGEQSVLLTGDIERQAELAMLSHRWRQLASTLIQVPHHGSNTSSSTPLLQRVEGQVSLASMARYNAWRFPSIKVVRRYRTEGYLWLDTPQSGQISVTFSHQSRQIRRLREHYLPRWYHQWFGAPVDNG

SEQ ID NO: 8487 - protein, 582 aa, Enterobacter cloacae
MHNDKDLSTWQTFRRLWPMIAPFKAGLIVAGVALILNAASDTFMLSLLKPLLDDGFGKTDRSVLLWMPLVVIGLMILRGISSYVSSYCISWVSGKVVMTMRRRLFSHMMGMPVSFFDKQSTGTLLSRITYDSEQVASSSSSALITVVREGASIIGLFAMMFYYSWQLSLILIVLAPIVSIAIRVVSKRFRNISKNMQNTMGQVTTSAEQMLKGHKEVLIFGGQEVETKRFDKVSNRMRLQGMKMVSASSISDPIIQLIASLALAFVLYAASFPSVMETLTAGTITVVFSSMIALMRPLKSLTNVNAQFQRGMAACQTLFSILDSEQEKDEGTRVIERAKGDLEFRNVTFTYPGREVPALRDISLSIPAGKTVALVGRSGSGKSTIASLITRFYDIDQGEILLDGHDLREYTLQSLRNQVALVSQNVHLFNDTVANNIAYARTEEYSREEIENAARMAYAMDFINKMDNGLDTIIGENGVLLSGGQRQRIAIARALLRNSPILILDEATSALDTESERAIQSALDELQKNRTSLVIAHRLSTIEQADEIVVVEDGVIVERGSHADLLEQRGVYAQLHKMQFGQ

SEQ ID NO: 8488 - protein, 414 aa, Enterobacter cloacae
LTGKRMSLPQLSLAAARNLHLAAQGLLKKPRRRAQPADILSTVQRMSLLQIDTINIVARSPYLVLFSRLGNYPPQWLDNALSQGELMEYWAHEACFLPRSDFALVRHRMLAPDKMGWKYRQEWMVEHADEIEQLIAHIQKNGPVRSADFEHPRKGASGWWEWKPHKRHLEGLFTSGKVMVVERRNFQRVYDLTHRVMPHWDDTHDLLSQDVAEAIMLGNSARSLGIFRPQWLADYYRLRQPRLKPLLETWQREQRVMPVSVESLGEMWLHADLFPLLAQAQEGKLQATHSAVLSPFDPVVWDRKRAEQLFDFSYRLECYTPAPRRQYGYFVLPLLHKGQLVGRMDAKMHRKTGMLEIIALWLEEGIKVTAGLEKGLTTALSEFARWQGAHEIVLGRVPVELFATCRDGWETDTP

SEQ ID NO: 8489 - protein, 75 aa, Enterobacter cloacae
KGNVISFSDYPYGGTMDHRLLEIIACPVCNGKLYYSQDKQELICKLDSLAFPLRDGIPVLLENEARSLVAEEIKP

SEQ ID NO: 8490 - protein, 299 aa, Enterobacter cloacae
SHMEQLRAELSHLLGEKLSRVECVNEKADSALWSLYDSQGNPMPLMARSFTSPGVARQLAWKMSMLAREGTVRMPTVYGVMTHEEHPAPDVLLIERLRGVSVEAPTRTPERWEQLKDQIVEALLAWHRQDSRGLVGAVDSTQENLWPLWYRQRVEVLWGTLNQFNNTGLTMQDKRILFRTRECLPTLFEGFNDNCVLVHGNFTLRSMLKDSRSDQLLAMVGPGIMLWAPREYELFRLSEGGAAEDLLWHYLQRAPVAEAFLWRRWLYLLWDEVAQLVNTGRFNRASFDLAAKSLLPWLA

SEQ ID NO: 8491 - protein, 258 aa, Enterobacter cloacae
APGWAKFGDITAMSIIGRIHSFESCGTVDGPGIRFITFFQGCLMRCLYCHNRDTWDTHGGKEVTVEDLMKEVVTYRHFMNASGGGVTASGGEAILQAEFVRDWFRACHKEGIHTCLDTNGFVRRYDPVIDELLEVTDLVMLDLKQMNDEIHQNLVGVSNHRTLEFAKYIANKGVKTWIRYVVVPGWSDDDDSAHRLGEFTRDMGNVEKIELLPYHELGKHKWVAMGEEYKLDGVKPPKKETMERVKGILEQYGHKVMY

SEQ ID NO: 8492 - protein, 100 aa, Enterobacter cloacae
RGGGMGRATSLPDAVCEDDVPFLLVTSASHLPRAMIFFEKQGLHPLPAPANQMAIDAPLNPWERIIPSPVWLMHSDRVGYETLGRLWQWLKGSSGKPGQE

SEQ ID NO: 8493 - protein, 655 aa, Enterobacter cloacae
RLRNATSPKNSGGTLSNAIRWRSNAFIFLCLNSRLLLISIAQPFIFAGDSTRHAKPVSLRALRTIKVNAMTQTFIPGKDAALEDSIARFQQKLTDLGFNIEEASWLNPVPHVWSVHIRDKDCALCFTNGKGATKKAALASALGEYFERLSTNYFFADFWLGETIANGPFVHYPNEKWFPLTENDELPEGILDARLRAFYDPENELTGSMLIDLQSGNEDRGICTLPFTRQSDEQTVYIPMNIVGNLYVSNGMSAGNTRNEARVQGLSEVFERHIKNRIIAESISLPEIPADVLARYPGVVESIAKLEAEGFPIFAYDGSLGGKYPVICVVLFNPANGTCFASFGAHPDFGVALERTVTELLQGRSLKDLDVFTPPTFDDEEVAEHTNLETHFIDSSGLISWDMFKQDADYPFVDWSFAGTTEEEFATLMAIFHAEDQEVYIADYEHLGVYACRIIVPGMSDIYPAEDLWLANNSMGAHLRETLLALPGSEWDKEDYLNLIAQLDEEGHDDFTRVRELLGLATGKDNGWYTLRIGELKAMLALAGGDLDQALAWTEWTMEFNQSVFSAERTNYYRCLQTLLLLSQEDDRQPLQYLNAFVRMYGADAVEAASAALSGEEPFYGLQAVDSDLQAFPAHQSLLNAYEKLQKAKAAYWSK

SEQ ID NO: 8494 - protein, 322 aa, Enterobacter cloacae
NHTHCGPISQARYDLYQFLFYNALLVSRRRLNKERVSVKADNPFDLLLPAAMAKVAEEAGVYKATKHPMTTFFLAITAGVFISIAFVFYITATTGTAGMPFGIAKLIGGICFSLGLILCVICGADLFTSTVLIVVAKASGRITWGQLGRNWLNVYVGNLIGCLLFVLLMWLSGEYMTANGGWGLNVLQTADHKMHHTFIEAVALGILANLMVCLAVWMSYSGRSLMDKAMIMVLPVAMFVASGFEHSIANMFMIPMGIVIRNFASPEFWTAVGSTPESFSHLTIMNFITDNLIPVTIGNIIGGGLLVGLTYWVIYLRGGDHH

SEQ ID NO: 8495 - protein, 765 aa, Enterobacter cloacae
EGRCYMSELNEKLATAWEGFTKGDWQNEVNVRDFIQKNYTPYEGDESFLAGATDATTKLWDSVMEGVKLENRTHAPVDFDTSVASTITSHDAGYINKALEKIVGLQTEAPLKRAIIPFGGIKMVEGSCKAYNRELDPMLKKIFTEYRKTHNQGVFDVYTKDILNCRKSGVLTGLPDAYGRGRIIGDYRRVALYGIDFLMKDKYAQFVSLQSDLENGVNLEATIRLREEIAEQHRALGQIKEMAAKYGCDISGPATNAQEAIQWTYFGYLAAVKSQNGAAMSFGRVSTFLDAYIERDLKAGKITEQDAQEMIDHLVMKLRMVRFLRTPEYDELFSGDPIWATESIGGMGVDGRTLVTKNSFRFLNTLYTMGPSPEPNITVLWSEKLPLNFKKFAAKVSIDTSSLQYENDDLMRPDFNNDDYAIACCVSPMVVGKQMQFFGARANLAKTMLYAINGGVDEKLKMQVGPKSEPIKGDVLNYDEVMDRMDHFMDWLAKQYVTALNVIHYMHDKYSYEASLMALHDRDVVRTMACGIAGLSVAADSLSAIKYAKVKPIRDEDGLAIDFEIEGEYPQFGNNDARVDDMAVDLVERFMKKIQKLTTYRNAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMEHPEKYPQLTIRVSGYAVRFNSLTKEQQQDVITRTFTQSM

SEQ ID NO: 8496 - protein, 105 aa, Enterobacter cloacae
RLRTDAALPVPGGCPPHALSVPDAQSALPLSYQRSSSGRQIHPPAPRCKAVFPAPDAGHPCCHPASSMGPESDGPYAPPRRFSRYNRPGYARPAPTSACSDAPFH

SEQ ID NO: 8497 - protein, 562 aa, Enterobacter cloacae
HKILFLQIYDGELTMNGAQWVVHALRAQGVETVFGYPGGAIMPIYDALYDGGVEHLLCRHEQGAAMAAIGYARATGKTGVCMATSGPGATNLITGLADALLDSVPVVAITGQVASPFIGTDAFQEVDVLGLSLACTKHSFLVQSLEELPRVMAEAFEVASSGRPGPVLVDIPKDIQVALGELEPHFSTVESDNAFPHAEVEEARQMIAQAKQPMLYVGGGVGMAQAVPALREFIAATQMPATCTLKGLGAVDADYPYYLGMLGMHGTKAANLAVQECDLLIAVGARFDDRVTGKLNTFAPNAKVIHMDIDPAEMNKLRQAHVALQGDLNALLPALEQPLDINPWRQHTADMRAEHAWRYDHPGEAIYAPLLLKQLSDRKPADSVVTTDVGQHQMWSAQHMTYTRPENFITSSGLGTMGFGLPAAVGAQVARPNDTVICISGDGSFMMNVQELGTVKRKQLPLKIVLLDNQRLGMVRQWQQLFFQERYSETTLTDNPDFLTLASAFGIPGQHITRKDQVEAALDTMLSSEGPYLLHVSIDELENVWPLVPPGASNSQMLEKLS

SEQ ID NO: 8498 - protein, 61 aa, Enterobacter cloacae
KTCIAPVRRASVPPRRSRRIAVGTRLMTIAPKAAFARWNMPIAKTAAWPCCTVTLRKMAVS

SEQ ID NO: 8499 - protein, 73 aa, Enterobacter cloacae; identical to SEQ ID NO: 6038

SEQ ID NO: 8500 - protein, 129 aa, Enterobacter cloacae
LILRAINSSAKELGACRMAESFTTTNRFFDNKHYPRGFSRHGDFTIKEAQLLERHGYAFNELDLGKREPATEDEKQFVSVCRGEREPQSDAERVWIKYMARIKRPKRFHTLSGGKPQMEGAEDYTESDD

SEQ ID NO: 8501 - protein, 519 aa, Enterobacter cloacae
TGGLTMAESQPLSAAPEGAEYLRAVLRAPVYEAVQVTPLQKMEKLSSRLDNVILVKREDRQPVHSFKLRGAYAMMAGLTDEQKARGVITASAGNHAQGVAFSSARLGLKALIVMPVATADIKVDAVRGFGGEVLLHGANFDEAKAKAIELAQQQGFTWVPPFDHPMVIAGQGTLALELLQQDAHLDRVFVPVGGGGLAAGVAVLIKQLMPQIKVIAVEAEDSACLKAALDAGHPVDLPRVGLFAEGVAVKRIGDETFRLCQEYLDDIVTVDSDAICAAMKDLFEDVRAVAEPSGALALAGMKKYIAQHNIRGERLAHVLSGANVNFHGLRYVSERCELGEQREALLAVTIPEEKGSFLKFCQLLGGRSVTEFNYRFADAKDACIFVGVRLSRGVEERKEILSLLHDGGYSVVDLSDDEMAKLHVRYMVGGRPSKPLKERLFSFEFPESPGALLKFLHTLGTHWNISLFHYRSHGTDYGRVLAAFELGEHEPDFETRLNELGYECHDETHNPAFRFFLAG

SEQ ID NO: 8502 - protein, 500 aa, Enterobacter cloacae
TTQHHEVSPMANYFNTLNLRQQLAQLGKCRFMARDEFADGASYLQGKKVVIVGCGAQGLNQGLNMRDSGLDISYALRKEAIAEKRASWRKATENGFKVGTYEELIPQADLVVNLTPDKQHSDVVRSVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAFALSEQLKTIMAPLFQKHMDDIISGEFSSGMMADWANDDKKLLTWREETGKTAFETAPQYDGKITEQEYFDKGVLMIAMVKAGVELAFETMVDSGIIEESAYYESLHELPLIANTIARKRLYEMNVVISDTAEYGNYLFSYACVPLLKEFMTTLQAGDLGQAIAEGAVDNAQLRDVNEAIRSHEIEKVGQKLRGYMTDMKRIAVAG

SEQ ID NO: 8503 - protein, 143 aa, Enterobacter cloacae
ERVGWRKALRRLIVFSTINIIRAGSLVTAISLSKKLNFLSAMVMPLTSWIWVNVNRQPKMKNSLSLFAVVSVSRNLMQNVYGLSIWLALSVLSVSIRCLAASRRWKVQKTTPSLTIKKRRGYGPFFFYASIFCRCNSSRSIAR

SEQ ID NO: 8504 - protein, 95 aa, Enterobacter cloacae
LTNAGEIIMMQHQVAVQARFNPETLERVLRVVRHRGFQICSVNMETATDAQNISIELTVASPRPVDLLFSQLSKLVDVAHVAICQSTTTSQQIRA

SEQ ID NO: 8505 - protein, 313 aa, Enterobacter cloacae
QDEKMTTKKADYIWFNGEMVRWEDAKVHVMSHALHYGTSVFEGIRCYDSHKGPVVFRHREHMQRLHDSAKIYRFPVSQSVDELMEACREVIRQNKLTSAYIRPLVFVGDVGMGVNPPAGYNTDVIIAAFPWGAYLGAEALDQGIDAMVSSWNRVAPNTIPTAAKAGGNYLSSLLVGSEARRHGYQEGIALDVNGYISEGAGENLFEVKDGILFTPPFTSSALPGITRDAIIKLAKDLGIEVREQVLSRESLYLADEVFMSGTAAEITPVRSVDGIQVGEGRCGPVTKRIQQAFFGLFTGETEDKYGWLDQVNH

SEQ ID NO: 8506 - protein, 617 aa, Enterobacter cloacae
SMPKYRSATTTHGRNMAGARALWRATGMTDADFGKPIIAVVNSFTQFVPGHVHLRDLGKLVAEQIEASGGVAKEFNTIAVDDGIAMGHGGMLYSLPSRELIADSVEYMVNAHCADAMVCISNCDKITPGMLMASLRLNIPVIFVSGGPMEAGKTKLSDKIIKLDLVDAMIQGADPKVSDEQSDQVERSACPTCGSCSGMFTANSMNCLTEALGLSQPGNGSLLATHADRKQLFLNAGKRIVELTKRYYEQDDASALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPESLEQYDVMLTKDDAVKNMYRAGPAGIRTTQAFSQDCRWDTLDDDRAEGCIRSLEHAYSKDGGLAVLYGNFAENGCIVKTAGVDDSILKFTGPAKVYESQDEAVDAILGGKVVEGDVVVIRYEGPKGGPGMQEMLYPTTFLKSMGLGKACALITDGRFSGGTSGLSIGHVSPEAASGGNIAIIEDGDLIEIDIPNRGIQLKLSDQEIAARREAQEARGDKAWTPKDRQREVSFALRAYASLATSADKGAVRDKSKLGG

SEQ ID NO: 8507 - protein, 141 aa, Enterobacter cloacae
PGRCPATRGVLAPMGSCFLTMCPASLMGCFSSARALPAIADAVKGDIAILADSGIRNGLDVVRMIALGADSVLLGRAYLYALATSGQAGVANLLNLIEKEMKVAMTLTGAKSISEINKDSLVQELSKLPAALAPLSQGNAA

SEQ ID NO: 8508 - protein, 475 aa, Enterobacter cloacae
ENLTHPAPPQLYRQANTRTQKQHHIGGERMTYSGRVDIQQVIDESPFSGFHWLLIVLGFLVLAIDGFDTAAMGYIAPTLSTEWGIHKQDLGPVLSAALLGLSLGALIAGPVSDRMGRKRVLVFSCLFFGLASLGTAWAQSLNTLTLWRFLTGLGLGAAMPNAITLISEFAPQRCRAMAINTMYCGFPLGAAGGGAISSWLIPHHGWRSVLLTGAIAPLILTVLLALLLPESVKFLVQRGKDIAQVRRIASRFARSTLDSVTGFFLTEEKVASKKGSVSQLFSMPWLPGTLMLWVTYFMGLVIYYVLLSWMPTLMQGMGYALAESAWLTSLFTFGGTAGILLAGWMMDRWEAHKVVACGFVLTMGLILLLGIEHNHIALFGGLIFLMGIAMNGAQSGMQTLAATFYPTECRATGIAWMQGIGRFGGVAGTMTSAQLLSMQWQADSILMILSVPALVAAAATVYKMLYSRAQEPGVA

SEQ ID NO: 8509 - protein, 160 aa, Enterobacter cloacae
GGSMLNIVLFEPEIPPNTGNIIRLCANTGFRLHIIEPMGFTWDDKRLRRAGLDYHEFTAVVRHHDYAAFLDAEKPQRMFALTTKGTPAHSAVSYQDGDYLMFGPETRGLPATILDALPAEQKIRIPMMPDSRSMNLSNAVSVVVYEAWRQLGYPGAILRS

SEQ ID NO: 8510 - protein, 284 aa, Enterobacter cloacae
IITTNNFAEKDVDTELLKTFLEVSRTRHFGRAAEALYLTQSAVSFRIRQLENQLGVNLFTRHRNNIRLTPAGEKLLPYAETLMNTWQAARKEVAHTSRHNEFSIGASASLWECMLSQWLMRLYRSHNHLQFEARIAQRQSLVKQLHERQLDLLITTEAPKMDEFSSQIVGQFSLALYASEPAMMKADLNYLRLEWGPDFQQHETGLIASDDIPQLTTSSAEIACQHLPALKGCTWLPVRWADNKPALHVVTDSTTLSRPLYAIWLQNSDKQSQIKDLLKTSILD

SEQ ID NO: 8511 - protein, 302 aa, Enterobacter cloacae
KEGVESVDLRDLKMFLHLAESRHFGRSARAMHVSPSTLSRQIQRLEEDLGQPLFVRDNRTVTLTEAGEELRIFAQQTLLQYQQLRHTIDQQGPSLSGELHIFCSVTAAYSHLPPILDRFRAEHPSVEIKLTTGDAADAMEKVVTGEADLAIAGKPETLPGAVAFSMLENLAVVLIAPALPCPVRNQVSVEKPDWSTVPFIMADQGPVRRRIELWFRRQKISNPSIYATVGGHEAMVSMVALGCGVALLPEVVLENSPEPVRNRVMILERSDEKTPFELGVCAQKKRLHEPLIDAFWTILPNH

SEQ ID NO: 8512 - protein, 75 aa, Enterobacter cloacae
LKRPWSDIRELMGRPGCDSKDTLTRKMPRDAWRFGADGIVFSNHVPRQLDGVFFLRPRPAGHCRCGERRYCDPGR

SEQ ID NO: 8513 - protein, 516 aa, Enterobacter cloacae
CWHSHRQGGLMSLSVVYTRAAIGVKAPLISVEVHLSNGLPGLTLVGLPETTVKEARDRVRSAIINSGYAFPAKKITINLAPADLPKEGGRYDLPIAIALLAASEQLNTPGLSSCEFVGELALTGALRGVPGAISGALEAIRAGRQIIVANENASEVSLIAEKGCLVAGHLQEVCAWLEGRHELAEPQENDEVAPDSPEDLSDIMGQEQGKRALEITAAGGHNLLLIGPPGTGKTMLASRLSGLLPPLNNHEALESAAIFSLVSSTSLHKQWRRRPFRSPHHSASLTAMVGGGSIPGPGEISLAHNGILFLDELPEFERRVLDALREPIESGEIHLSRTRAKISYPAQFQLVAAMNPSPTGHYQGNHNRCTPEQTLRYLSKLSGPFLDRFDLSLEIPLPPPGLLRQTGIKGESSATVRERVIAAQARQYVRQNRLNARLDNSGIRQFCSLNAEDAGWLEETLTRFGLSIRAWQRLLKVARTVADVEGCPGIERRHLQEALSYRAIDRLLLHLQKMLA

SEQ ID NO: 8514 - protein, 62 aa, Enterobacter cloacae; identical to SEQ ID NO: 6039

SEQ ID NO: 8515 - protein, 495 aa, Enterobacter cloacae
QLAKSSLFLLLIYTVSNKENLMKKYQRLAQQIISQIELGVWLPGDKLPSLREQVAGSGMSFMTVGHAYQMLESQGRIVARPQSGYYVAARPTTHQPAPPAQVMRDEVVDINTYIFDVLQASRDPSVVPFASAFPDPRLFPLQQLNRSLANVSKTATAMSVIENLPPGNVDLRHAIARRYAQQGMNISPDEIVITAGALEALNLSLQAVTEPGDWVIVENPCFYGALQALERLKLKALSVATDVREGIDLSALEQALNDYPVKACWLMTNSQNPLGFTLSAEKKAQLVALLTRHNVTLIEDDVYSELYFGREKPLPAKAWDKQDMTLHCSSFSKCLVAGFRIGWVTAGKHARRIQQLQLMSTLSTSSPMQLALVDYLATKRYDAHLRRLRRTLAERKQQAWQSLLRHMPAGVKIHHNDSGYFLWLELPEQLDAGRLSEKALIHQISIAPGKMFSTSNIWTPFFRFNTSWGWGEREEQAVVQLAGLIREMMLHPVTP

SEQ ID NO: 8516 - protein, 88 aa, Enterobacter cloacae
YLSGYDVTKKLDLCQHMTHIACGYFSAQVNRMTLYQKMLVFYAIMASICALITWFLSKDRKRIRLLSAFLVGSTWPMSFPVALLISLF

SEQ ID NO: 8517 - protein, 277 aa, Enterobacter cloacae
LPCQLVKRGDHQQQPLRRRKRGRQGTGLQRTMYGGNGPGFGLHLNNPRDIAPDVFYPITSPGVSLFSHRGAGSDGVDGDHFAGTKRNRRDCTIAVNSLHRTTPLHCAKRGVCKTTTDPEYYLCILAKLRFYDFRFCVLGMRCINDSKAIRVKKLREIVTRAHNYAHPLSTMRRVMPIMHRFRVNYGEEGMRSAFWVGCAALLLSACSNEPVQQATAAHVTPGMRAAMSSSGQANCAMIGGSLSVARQLDGSAIGMCALPNGKRCSEQSLAVGSCGSY

SEQ ID NO: 8518 - protein, 486 aa, Enterobacter cloacae
QRKQCRFQQDNAMQNQLLINGELVAGEGEKQAVYNPATGDVLLEIAEASEAQVDAAVQAADRAFTEWGQTTPKTRAECLLKLADVIEANADAFANLESLNCGKPLHCVQGDEIPAVVDVFRFFAGAARCLNGLAAGEYLEGHTSMIRRDPVGVVASIAPWNYPLMMAAWKLAPALAAGNCVVIKPSEITPLTALKLAELAKDIFPPGVLNVLFGRGKTVGDPLTGHEKVRMVSLTGSIATGEHIIGHTASSVKRTHMELGGKAPVIVFDDADLDAVVEGVRTFGFYNAGQDCTAACRIYAQKGIYPALVEKLGAAVASLKMGAPDDASTELGPLSSAAHLSRVCAAVDEAKTLGHIRVVTGGSKKEGAGYYFQPTLLAGAKQEDAIVQREVFGPVVSVTEFEDEAQVLNWANDSQYGLASSVWTKDVGRAHRLSARLQYGCTWVNTHFMLVSEMPHGGMKLSGYGKDMSVYGLEDYTVVRHVMFKH

SEQ ID NO: 8519 - protein, 80 aa, Enterobacter cloacae
GVTMSHLNKVIARVDATIEESVITHMNELLIELSDDAELSREDRYTQQQRLRTAIAHHGKQHKEEAEARHAHLTQGGTIL

SEQ ID NO: 8520 - protein, 194 aa, Enterobacter cloacae
YDVMNTMTDNMNQRISARIRLERESRGWSLSELAERAGISRAMIHKIERGDSSPTATLLARLSGAFGISMSTLIARAEMQEGKLLRLANQPVWRDPQTHYLRRHVSPRTDMPIDLVQVELPAGSDVPMPASSYALARQLIWLQAGELVFLEGDTRHEMKAGDCLELGPPNDCRFINETDESCLYLVVRLNQSGS

SEQ ID NO: 8521 - protein, 366 aa, Enterobacter cloacae
CKGDPQDNVPDLNDIFSSKERRMNQSTTQNRRWVLASRPHGAPVAENFRLEEQPIPTPAEGQVLLRTVWLSLDPYMRGRMSDAPSYSPPVEIGAVMVGGTVSRVETSRHPDYKEGEWVLGYSGWQEYELSDGQGLVKLGENPSHPSWALGVLGMPGFTAYMGLLDIGQPQAGETLVVAAATGPVGATVGQIGKIKGCRVIGVAGGEEKCRHAVDVLGFDACLDHHADDFAEQLAKACPQGIDVYYENVGGKVFDAVLPLLNTSARVPVCGLVSGYNATNLPEGPDRLPLLMGTILKKRIRMQGFIIAQDYGHRIVEFQQEMGRWVKEGKIHYREQVTEGLNAAPEALIGLLEGKNFGKVVIRVAAD

SEQ ID NO: 8522 - protein, 265 aa, Enterobacter cloacae
GCINIQSVIHGVLMNSFYSQQAGCTVRWQDLPGFGDPVVFIHGLGCASSYEYPRIVCDTRFGGRRAILIDLPGSGYSDKPDNYRYRTSEQAQVVVELLNHLGLDSLWLYGHSMGGSIAIETATLLTSRVKGLIVSEPNFHAGGGMFSRAIAAQTEQHFLAQGYDDMLRAETSPWAGSLQSNAPWAVWRGATSLVEGVKPDWEHLFLSLRCPVMLVFGERSLPDDDFNRLQQNGVAVKIIPDAGHSMSWENPSALAQALSGFINGS

SEQ ID NO: 8523 - protein, 562 aa, Enterobacter cloacae
NNLIVIRYLSGQYVCAVITVHYNKTERVITMSTGKTVLALALSALLPASAAWAANKDTIIYCSEASPESFNPQIASSGPSFVASSQTLYNRLINFDPVKNTPVPSLAESWTISPDGKTYTFTLRKGVKFNSNKYFKPTRDFNADDVIFSVMRQKDPKHPYHNVSQGNYEYFNDVGLDKLIQDVKKIDDYHVQFTLSEPNAAFLADWGMDFASILSAEYADAMLKKGTPENVDTWPIGTGPYVLQQYKVDSLIRYVANPNYWDGEVPTKHLIFSITPNVETRLAKLQTNECQIIPAPSPVQFEAIKKNKDLTLHSVDALNVGYLAFNTEKKPFDNVLVRQALNYATDKKAIVNAVFMGSGTVAKSPIPPNMLGFNNDLKDYGYDPEKAKALLKQAGLEKGAEVTLWSMPVQRPYNPNSRRIAEMIQADWAKVGVKAKIVSYEWGEYLSGMRKGEHDSALFGWMSDNGDPDNFADVLLGCNSIKTGSNAARWCDKGYDELVQKAKLTSNPDERAKLYGQAQEIFYQQAPWIALANGKTFYATRSNVTGYSVSLMGSDFSKAKLN

SEQ ID NO: 8524 - protein, 237 aa, Enterobacter cloacae
TVAENGILFWLRELNMLDLENLEKAQRISLTMQVENSLKGALITGSLKPGARLITKEIADKLGTSITPVREALLRLVSAGALQATPAQAFLVPEVTLERYNEINAIRKQLEPMAVAAACQNMTETKLGALRALSDNFSTAMHQGDVQKAIHANRVFRFTLYQYAEMPTLNSLIEQLWVRIGPCINYLHEEMKDIPATTYHYADLLSALEQRDVTASREAIDRAIDEANILLQRQYYS

SEQ ID NO: 8525 - protein, 230 aa, Enterobacter cloacae
FILSVIVFMTSYYSVRMVFRGSFVTKKQGFCRSDGIHELCNIVTKPYYYSEQHSQRLTMIVRHACKEDCAAIGEIYNHAVLHTAAIWNDTTVDTDNRIAWFEARTLLGYPVLVSEEEGVVTGYASFGDWRAFDGFRHTVEHSVYVHPDHQGKGIGRLLMTELIKEARQIGKHVMVAGIEAQNQASIHLHETLGFITTGNMQQVGTKFGRWLDLTFMQLQLDERSDPDALP

SEQ ID NO: 8526 - protein, 116 aa, Enterobacter cloacae
QQAFKGGNMLRIPQSCIHTRSTPFWNKETAPAGIFKRHLDTGTRPGVYPRLSVMRGAVRYLGYADEFTSEPDSELVIEAGRFGVFPPERWHHIEVMTDDTLFNIEFFVEPEVLKSL

SEQ ID NO: 8527 - protein, 126 aa, Enterobacter cloacae
APANMKETMMLRIPENFVHTRSTPFWNKETAPKALFTHHNTKAGVYGRLSVMQGAVRYFGFADGDATEPDLEVVIEAGSFGISPPQKWHRIELLTDDTYFNIDFFADPAVTLSGAGIGKVVNTHKE

SEQ ID NO: 8528 - protein, 61 aa, Enterobacter cloacae
IMGKATYTVTVTNNSNGVSVDYETEAPMELLIPDVAADVVKDLVNTVRAYDTENEHEVCGW

SEQ ID NO: 8529 - protein, 340 aa, Enterobacter cloacae
GVTVMGIDLSIIWFVIIVFATLMYIVMDGFDLGIGILFPATPNADDRDVMVNSVAPVWDGNETWLVLGGAALFGAFPLAYAVIIDALTIPLTIMLIGLIFRGVAFEFRFKATPAHRPFWDKAFIGGSIVATFSQGITVGAVIQGFSVTGRAYSGGPFDWFTAFNFFCGAGLVVAYALLGSTWLVMKSENALQKRMRQLSKVLLPLLLVFIAIISIWTPLAQPAIAARWFTLPNLFYLLPVPALVAILSLCQWRCLHDPASHTLPFIMTLGLVFLGFSGLGISIWPHIIPPDITLWQAAAPAQSQGFMLVGALLIIPVILVYTFWSYYVFRGKVQHGEGYH

SEQ ID NO: 8530 - protein, 80 aa, Enterobacter cloacae
AVSVDNPSVLTKLLLWGSFVNRAGIRRCNPYHTRHTFACWFLPVAANPSFIANQMGHVNAQMVYEIYATWIEEMNTKLTL

SEQ ID NO: 8531 - protein, 128 aa, Enterobacter cloacae
CGTLPPLWMKTDCGGNRMPGIARNMGYASFGWEPEEGWYAGADARYMSDVMANDTNTAKAPSYTVVGLNTGYKLNYGKWGMDIFGRVDNLFDKEYVGSEIVNAGYNRYYEPAPGRNYGVGLSVSYRFE

SEQ ID NO: 8532 - protein, 483 aa, Enterobacter cloacae
YLIPPLFIITVHRLTLRQCMFGPDAFHLARIQFAFTVSFHIIFPAITIGLASYLAVLEGLWLRTKNPVWRSLYHFWSKIFAVNFGMGVVSGLVMAYQFGTNWSGFSQFAGSITGPLLTYEVLTAFFLEAGFLGVMLFGWNKVGPGLHFFSTCMVALGTLMSTFWILSSNSWMQTPQGYEIINGQVVPVDWFAVVFNPSFPYRLLHMSIAAFLSSALFVGASAAWHLLRGNNTPAIRTMFSMALWMTLIVAPVQALVGDMHGLNTLKHQPAKIAAIEGHWENPPGEPTPLLLFGWPDMEQERTRFGLEIPALGSLILTHSLDKQVPALKEFPKEDRPNATIVFWSFRIMAGLGMLMLLLGVTAIWLRYKQRLYTSRSFLWFALLMGPSGLIAILAGWVTTEVGRQPWVVYGLQRTKDAVSAHGDLHMSISLLAFFVVYTAVFGVGYSYMVRLIKKGPQPHESFATESDGRPARPLSAVTTEFKE

SEQ ID NO: 8533 - protein, 146 aa, Enterobacter cloacae
KMKKLAAVSLISLVLAGCVNPGKASVQTDQLENHRFVLENVDGKAVKGGKTQPEIRFSAQPNISLINNIVVSGTMCNGFNGQGKLSEGELTVKTLAMTRKLCTEPQLNELDQTIADMLRTGAQVDLTEDQLTLATANKTLMFKRVE

SEQ ID NO: 8534 - protein, 157 aa, Enterobacter cloacae
AQRSGCSAMNQSLTLAFLVAAGIGLVVQNTLMVRITQSSSTILIAMLLNSLVGIVLFVSMLLVKNGMAGFNELASTVRWWTLIPGLLGSFFVFASISGYQNVGAATTIAVLVASQLIGGLVMDILKSNGVPLRALVGPVCGAVMLVAGAWLVARRQF

SEQ ID NO: 8535 - protein, 1178 aa, Enterobacter cloacae
GCCPMQTIDGNGAVASVAFRTSEVIAIYPITPSSTMAEQADAWAGNGIKNVWGDVPRVVEMQSEAGAIATVHGALQTGALSTSFTSSQGLLLMIPTLYKLAGQLTPFVLHVAARTVATHALSIFGDHSDVMAVRQTGCAMLCASSVQEAQDFALISHIATLKSRVPFIHFFDGFRTSHEINKIVPLPDDTILNLLPQADIDAHRARALNPEHPVIRGTSANPDTYFQSREATNPWYNAVYEHVEQAMDDFAAATGREYKPFEYYGHPQAERVIVLMGSAIGTCEEVVDELLTRGEKVGVLKVRLYRPFSAKHLLAALPDSAHAVAVLDRTKEPGAQAEPLYLDVMTALAETFNRGERETLPRVIGGRYGLSSKEFGPECVLAVFAELREAKPKPRFTVGIYDDVTNLSLPLPENTLPSNAKLEALFYGLGSDGSVSATKNNIKIIGNSTPWYAQGYFVYDSKKAGGLTVSHLRVSEHPIRSAYLISQADFVGCHQLQFIDKYQMAERLKPGGIFLINTPYSADEVWARLPQEVQAVLNQKQARLYVINAAKIARECGLAARINTVMQMAFFHLTNILPGDSALMELQGAIAKSYSSKGQELVERNWQALALARESLFAVPLQPVNASSPNRPPVVSDAAPDFVKTVTAAMLAGLGDTLPVSALPPDGTWPMGTTRWEKRNIAEAIPIWKEELCTQCNHCVAACPHSAIRAKVVSPEALDGAPESLHSLDVKSRDMRGQKYVLQVAPEDCTGCNLCVEVCPAKDRQDPSIKAINMMSRLEHVEEEKVNYDFFLDLPEIDRNKLERIDIRTSQLITPLFEYSGACSGCGETPYIKLLTQLYGDRMLIANATGCSSIYGGNLPSTPYTTDANGRGPAWANSLFEDNAEFGLGFRLTVDQHRARIMRLLAQFADKIPAELNDALHAEATPDVRRAQVAELRHALQGVEGAEQLLTDADALVEKSIWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKLPLALDSRPPSDALAETLLQEQRFRRLNAQQPEVAEQLWKDAAADLQKRYDFLAQLAGKAEKSTSE

SEQ ID NO: 8536 - protein, 384 aa, Enterobacter cloacae
KNNCKGIIKMQRKVLALMIPALLMAGAAHAAEIYNKDGNKLDLYGKVDGLHYFSDDASKDGDQTYMRLGFKGETQINDMMTGFAQWEYNIQANNTEGSDNQSWTRLAFAGVKVGDYGSFDYGRNYGVLYDVEGWTDMLPEFGGDSYTYADNFMTGRANGVATYRNTDFFGLVQGLNFAVQYQGNNEGNNCDENFCSTNEGTNNGRDTRHENGDGYGISATYDFGMGFSAGAAYTSSDRTNDQVNYTTAGGDTADAWTAGLKYDANNIYLAAMYSETRNMTPYGDNADAVANKTQNFEVTAQYQFDFGLRPAISYLQSKGKDLGNGQDDKDLVKYADVGATYYFNKNMSTYVDYKINLLDEDDSFYKNNGIGTDDIVALGLVYQF

SEQ ID NO: 8537 - protein, 188 aa, Enterobacter cloacae
KRRYSGSCGESGAGLPVGRRGENRQRSVCHRSAMATAALSDITTRVEKMKRYTPDFPEMMRLCETNFAQLRRLLPRNDAPGETVSYQVSNAQYRLTITESTRYTTLVEIEQTAPSISYWSLPSMTVRLYHDAMVAEVCSSQQIFRFKARYDYPNKKLHQRDEKHQINQFLADWLRYCLAHGAMAIPVC

SEQ ID NO: 8538 - protein, 278 aa, Enterobacter cloacae
GHHLESLLNLTVAGGAPVRILQITDTHLFAEKHETLLGVNTWESYQAVLDAIHAEKRPCDLIVATGDLAQDQSSAAYQHFAEGIASFSVPCVWLPGNHDFQPAMYSSLQDAGISPAKCVFAGDQWQILLLDSQVFGVPHGELSDYQLDWLETKLAAEPNRNTLLLLHHHPLPAGCSWLDQHSLRNSAALDGVLAKFPRVKNLLCGHIHQEQDLDWNGRRLLATPSTCVQFKPHCANFTLDTIAPGWRWLELHADGSLTTEVCRLAGAQFRPDTASEGY

SEQ ID NO: 8539 - protein, 631 aa, Enterobacter cloacae
IMTQTYNADAIEVLTGLEPVRRRPGMYTDTTRPNHLGQEVIDNSVDEALAGHAKRVDVILHADQSLEVIDDGRGMPVDIHPEEGVPAVELILCRLHAGGKFSNKNYQFSGGLHGVGISVVNALSKRVEVNVRRDGQVYNIAFENGEKVQDLQVVGTCGKRNTGTSVHFWPDESFFDSPRFSVSRLTHLLKAKAVLCPGVEITFKDHVNNTEQTWCYADGLNDYLCEAVNGLPTLPEKPFVGNFEGDTEAVDWALLWLPEGGELLTESYVNLIPTMLGGTHVNGLRQGLLDAMREFCEYRNILPRGVKLSAEDIWDRCAYVLSVKMQDPQFAGQTKERLSSRQCAAFVSGVVKDAFTLWLNQNVQAAEMLAEMAISSAQRRLRAAKKVVRKKLTSGPALPGKLADCTAQDLNRTELFLVEGDSAGGSAKQARDREYQAIMPLKGKILNTWEVSSDEVLASQEVHDISVAIGIDPDSDDLSQLRYGKICILADADSDGLHIATLLCALFVKHFRALVKNGHVHVALPPLYRIDLGKEVYYALTEEEKAGVLEQLKRKKGKPNVQRFKGLGEMNPMQLRETTLDPNTRRLVQLTISDEDEQQTNAVMDMLLAKKRSEDRRNWLQEKGDMADIEA

SEQ ID NO: 8540 - protein, 758 aa, Enterobacter cloacae
VEESHVMSDMAERLALHEFTENAYLNYSMYVIMDRALPFIGDGLKPVQRRIVYAMSELGLNATAKFKKSARTVGDVLGKYHPHGDIACYEAMVLMAQPFSYRYPLVDGQGNWGAPDDPKSFAAMRYTESRLSKYAEVLLGELGQGTVDWVPNFDGTMQEPKMLPARLPNILLNGTTGIAVGMATDIPPHNLREVAKAAITLIEQPKTSLDDLLDIVQGPDYPTEAEIITSRAEIRKIYQNGRGSVRMRAVWNKEDGAVVITALPHQVSGAKVLEQIASQMRNKKLPMVDDLRDESDHENPTRLVIVPRSNRVDMEQVMNHLFATTDLEKSYRINLNMIGLDGRPAVKNLLEILTEWLAFRRDTVRRRLNHRLEKVLKRLHILEGLLVAFLNIDEVIEIIRTEDEPKPALMSRFGISETQAEAILELKLRHLARLEEMKIRGEQNELEKERDQLQAILASERKMNTLLKKELQADADAFGDDRRSPLHEREEAKAMNEHDMLPSEPVTIVLSQSGWVRSAKGHDIDAPGLSYKSGDSFKAAVKGKSNQPVAFIDSTGRSYAIDPITLPSARGQGEPLTGKLTLPPGATVEHMLMEADDQKLLMASDAGYGFICTFNDLVSRNRAGKALISLPDNAHVMPPLIIENESDMLLAITAAGRMLMFPVSDLPELSKGKGNKIISIPSAEAAKGEDSLAHLFLLPPQSTLTIHVGKRKIKLRPEELQKVVGERGRRGSLMRGLQRIDRVEIDSPARSKADDSEE

SEQ ID NO: 8541 - protein, 255 aa, Enterobacter cloacae
LSAVRASEVAMLYIVRLILTVIYCILVCIFGSIYCLFSPRNPKHVATFGHMFGRLAPLFGLKVEKRLPEGAENFGNAIYIANHQNNYDMVTASNIVLPPTVTVGKKSLLWIPFFGQLYWLTGNLLIDRNNRAKAHGTIAEVVDQFKKRRISIWMFPEGTRSRGRGLLPFKTGAFHAAIAAGVPIIPVCVSNTSNKINLNRLNNGLVIVEMLPPVDTSKYGKDQVRELATHCRELMAQHIAQLDKEVAEREAAGKI

SEQ ID NO: 8542 - protein, 79 aa, Enterobacter cloacae
  UNSURE (79)
VDCMAMRLNENLDDNGEMHEINVTPFIDVMLVLLIIFMVAAPLATVDVKVNLPASSSQPQPRPEKPIYLSVKADKSMFX

SEQ ID NO: 8543 - protein, 233 aa, Enterobacter cloacae
PYKRQPNSLEIHNFITIATRTRPMQKPENVPVTFAKNDVEIIARETLYSGFFSMELYRFRHRLFNGEMSGEIKREIFERGHAAVLLPYDPVRDEVVLVEQVRIAAYDTSETPWLLEMVAGMIEEGESVEDVARREALEEAGLVVGRTKPVLSYLASPGGTTERSSIMVGEVDATTAEGIHGLADENEDIRVHVVSRELAYQWVEEGKIDNAASVIALQWLQLHYQTLRHEWKK

SEQ ID NO: 8544 - protein, 452 aa, Enterobacter cloacae
PIAGSSLANPEANVSCRSHYKNLALHVGEDDMKSTSTTNRTEYYKISSFIFLYFFTWSASIGLLAIWLGQKANLSGSVIGTVFAVNGIFSVILKPIYGYILDKIGMSKYLLYFVVIMSALMAPFFIYVYQPLLMSNTLLGIIIGALYLSFAWYAGVAACESYSDRFSRLNGMEFGQIRMWGSLGWAVASSFSGLLFNLSPAYNFILGSVASVVMLIVLLSLKVNTNSAHAGEVLTKEKIAPSDVYALLRNRKFWAFCLYVAGVAWMMFIAEQQFSRYFVTFFDDIHQGNAVFGYLGTVQSGMEFVMYMVIPLFVNFIGAKRGLLIVGLVVGARLIISGMCDSHLLISVLKPLYGLEICLLLVSVFKYIAEHFDKRVNATMYLLGYQAMLYVGNVVVSSPAGYMYDRIGFEHTYIIMGATALTFTLISAFTLSACQSKWRGARALNVAETSTR

SEQ ID NO: 8545 - protein, 100 aa, Enterobacter cloacae
LLLIPGYQLSKNFREMLAIFCDIARDVRHFNYVVDDKGRQRLHSQELIRLVERQIRAVYAHAFEELIFLGEGFQRRVPGQGEHIFFALNQTARTVFFRRI

SEQ ID NO: 8546 - protein, 138 aa, Enterobacter cloacae
TGAAVAGIQRTVTFGKHIVHVFFHGPRCAHPPARHLPDHHVGPQEVLHFGLHVVIAVRAHDLNIMSGVAQETIRDLGQGVIELAFRVRKFFRAVDNQNVAHYLSSMMRVCRVFYARGRSGKISKMCKVFCAQRNNLTS

SEQ ID NO: 8547 - protein, 512 aa, Enterobacter cloacae
WLSILRSSIKKLQSEKPPVRFNPVSCKGKRIPALLVVSDGAYMSLSRRQFIQASGIALCAGAIPRTASAAGQQQPLPIPPLIESRRGQPLFLTLQRSHWSFTQGTRAQVWGINGRYLGPTIRVWNGDDVKLIYSNRTTENVAMTVSGLQVPGPLIGGAARMMSPNADWAPVLPIRQSAATLWYHANTPNRTAQQVYNGLAGMWLIEDEVSKTLPIPNHYGVDDFPIIIQDKRLDNFGTPEYSEPGSGGFVGDTLLVNGAQSPYVEVSRGWVRLRLLNASNSRRYQLQMSDGRALHVISGDQGLLPAPVSVKQLALAPGERREILVDMTNGDEVSVTCGEAASIVDRIRGFFEPSSVLVSTLVLTLRPTGLLPLVTDSLPMRLLPQEIVTGPAVRSRDISLGDDPGINGALWDVNRIDITAQQGTWERWTVRSEMPQSFHIEGVSFLIRNVNGAMPFPEDRGWKDTVWVDGQVELLVYYGQPSWPHFPFLFHSQTLEMMDRGSVGQMLVNPAP

SEQ ID NO: 8548 - protein, 205 aa, Enterobacter cloacae
SGGRQRQHGAHRDRTADVAAARFQNMPRVDAVSVMGRRRDEFGAVQHGTAAHRQQEGDLLLAGDFYRVHQRFIRRVRLDTAELAHVQTFQSAVHLIQYAGFFHAAAAVGNQDAGVRRDLRAQVSDSVFTKQNAGWGMKIKVVHGLFPVVGKKSWWRRRQPDAAHCGGQALSSQCTFLPMSCPFLQRAGETVRKCAHCQRRKPYPE

SEQ ID NO: 8549 - protein, 301 aa, Enterobacter cloacae
LKMNRDAICRQLTSQIKTLIDNGNDSAELLPDIRLLYGTQPGTRTPVMYQPGIVFLFSGHKIGYINERVFRYDTNEYLLLTVPLPFECETFATEEVPLAGIRVNVDILQLQELLMDIGEDELFRPSMAASGINSATLSEEILCAIERLLDVMERPLDARILGKQIIREILYHVLLGPGGGALLALVSRQTHFSLISRVLKRIESQYTENLSVDQLAAEANMSVSAFHHNFKSVTSTSPLQYLKTYRLHKARMLMIHDGMKASAAAMRVGYESASQFSREFKRYFGVTPGEDASRIRTMQGA

SEQ ID NO: 8550 - protein, 241 aa, Enterobacter cloacae
AALRQLYAGYHRTGLALAGAACRWLADHRSLPSGRGTIPPGYRFGRLLMSTLLYLHGFNSSPRSAKATQLRQWLSAHHPHVEMIIPQLPPYPADAAEMLESLVLEHGGESFGVVGSSLGGYYATWLSQCFMLPAVVVNPAVRPFELLRDFLGENENPYTGQQYVLESRHIYDLKVMQVDPLEAPDLIWLLQQTGDEVLDYRQAVAYYASCRQTVEEGGNHAFTGFEDHFTQIVDFLGLHSH

SEQ ID NO: 8551 - protein, 150 aa, Enterobacter cloacae
GLPCLMDCETTLKGEIKMKKFAAIAAIMMMTTAPVFAAQGGFSGPSATQNQTQTQQGGFVDNNANLTTAAKVKDLKDDAWVKLRGNITERLSDDRYTFRDESGTVVVEIDHKRWNGVTVTPQDKVELQGKIDKDWNEFEIDVKQVIKLNK

SEQ ID NO: 8552 - protein, 754 aa, Enterobacter cloacae
GQQPAQYPFISPGKPAYNPAPFVYFFFGSIMSAISLIQPDRDLFSWPQYWAACFGPAPFLPMSREEMDQLGWDSCDIILVTGDAYVDHPSFGMAICGRMLEAQGFRVGIISQPDWNSKDDFMRLGKPNLFFGVTAGNMDSMINRYTADRKLRHDDAYTADNVAGKRPDRATLVYTQRCKEAWKDVPVILGGIEASLRRTAHYDYWSDTVRRSVLVDSKADMLIFGNGERPLVEVAHRLAQGEAVSEIRDVRNTAIMVKEALPGWSGVDSRIIDMPGKIDPIPHPYGDDLPCADNKPVEPKKAEAKAVVVQPPRPKPWEKTYVLLPSYEKVKSDKVLYAHASRILHHETNPGCARALMQKHGERYIWVNPPAIPLSTEEMDSVFALPYKRVPHPSYGSSRIPAYEMIRFSINIMRGCFGGCSFCSITEHEGRIIQSRSEESIVNEIEAIRDTVPGFTGVISDLGGPTANMYMLRCKSPRAEQTCRRLSCVYPSICEHMDTNHEPTINLYRRARDLKGIKKILIASGVRYDIAVEDPRYIKELATHHVGGYLKIAPEHTEEGPLSKMMKPGMGSYDRFKQLFDTYSKQAGKEQYLIPYFISAHPGTRDEDMVNLALWLKQRRFRLDQVQNFYPSPLANSTTMYYTGKNPLSKIGYKSEDVVVPKGDKQRRLHKALLRYHDPKNWPLIRQALEEMGKKHLIGSRRDCLVPAPTLEEMREARRQNRNTRPALTKHTPIAHQRSNGVAGTKKNVKRKTG

SEQ ID NO: 8553 - protein, 250 aa, Enterobacter cloacae
FASWRYRVGNNLMQTDLSVWGMYQHADIVVKIVMIGLILASVITWAIFFSKSAELLSQKRRLKREQKQLAEARSLDQASDITSSFHAKSLTTLLVNEAQNELELSAGSEDNEGIKERTGFRLERRVAAVGRHMGRGNGYLATIGAISPFVGLFGTVWGIMNSFIGIAQTQTTNLAVVAPGIAETLLATAIGLVAAIPAVVIYNIFARMIGSYKATLGDVAAQVLLLQSRDLDLNASAVKPVHAASKLRVG

SEQ ID NO: 8554 - protein, 448 aa, Enterobacter cloacae
CRNFRSLSLRLRSKNFLCEFLIIFSAYSISIRMHILTIVVVWTSRRIKIGLANMTKKQLETTLVQAGRSKKYTQGSVNSVIQRASSLVFDTVEDKKIATRNRAKGGLFYGRRGTLTHFSLQEAMCELEGGAGCALFPCGAAAVANTILAFVEQGDHVLMTNTAYEPSQDFCTKILSKLGVTTSWFDPLIGAGIAGLIQPNTRVVFLESPGSITMEVHDVPAIVKAVRSIAPEAIIMIDNTWAAGVLFKALEFDIDISIQAATKYLIGHSDGMIGTAVSNARCWDQLRENAYLMGQMVDADTAYMTSRGIRTLGVRLRQHHESSLQIAQWLALHPQVERVNHPALPGSKGHEYWQRDFTGSSGLFSFVLKKRLNDAELASYLDNFTLFSMAYSWGGFESLILPNQPEQIAALRPGGEVDFEGTLIRLHIGLENVDDLIADLSAGFERIV

SEQ ID NO: 8555 - protein, 279 aa, Enterobacter cloacae
PVTSIFRTFLGQQHVHHGVSLLFIFIADGQLHQTAGIRIQRGFTQLHRVHLTQPLKALNVRFALLALKLFQHARFLFFRQCIVNFFAEVDSVQRRQRHVDVTVFHQRAEMLHKQRTEQRGDVQAIGVRIRENADLAVAQLAQIVAVRIDTDRNRDVVYFLRGQHFIRRDLPGVEDLTLERHDRLIFTIPRLLGRSACRVSFHQEQLGAVEILRGTVRQLARQRGAAGQLFTHHFLRRAQTTLGTGDRHFSQHFRGLNVLVQPQGKGIFHHAGDERRTLA

SEQ ID NO: 8556 - protein, 125 aa, Enterobacter cloacae
QGVNHGDPHAVQAAGELVVFVGELTARVQTTEDQLNGGNTLFRVDIYRHAAAVVDDFQRLIGVQDNVHAFGMACQRFVHTVINYFLAQVVWARRIGVHPRAAANRLKPGEYLNGISVIGLRHDLS

SEQ ID NO: 8557 - protein, 222 aa, Enterobacter cloacae
IGFSGRGCGWLEDAGRFTFTSTVASGAATIKIISRTSMTSINGVTLISCISPLSSRFSLRRIAIQSTYAQFGRRMNRFNGAGVQVQIAALQQQNLRGNVTQCGFVTANHAREDVIDNNRRDSGNQTDSRCQQRFCDTRRDDRKVSGLRLGDTDKAVHDAPDGTEQADERGDSADSRQVAVTAAHMTTHGRNATLQTEAGTLFNAFVIFTACGEFQLVLRFVH

SEQ ID NO: 8558 - protein, 229 aa, Enterobacter cloacae
RYICCSTGKSMAVIQNIITALWQHDFAALADPHVVGIVYFVMFATLFLENGLLPASFLPGDSLLLLAGALIGKGVMDFAPTMVILTSAASLGCWLSYLQGRWLGNTRVVKGWLAQLPHKYHQRATCMFDRHGLLALLAGRFLAFVRTLLPTMAGISGLSNRRFQFFNWLSALLWVGVVTTLGYALNMIPFVKRHEDQVMTFLMVLPIFLLVAGLVGTIAVVIKKKYCSA

SEQ ID NO: 8559 - protein, 450 aa, Enterobacter cloacae
RMKLTQRLSLKLRLTLLFLLLSLAAWFAASVVAWHQTTDKLDKLFDTQQMLFAKRLLTMDVDELRAPERMREVPKKAKHGHLDDDALAFAIFTADGSMVLNDGENGRDIPYLYRRDGFDDGRLQDDNDEWRFLWLTSPDGKYRVVVGQEWEYRQDMALDVVSSQLTPWLVALPIMLLLLIVLLSRELKPLKKLAQTLRSRSPDATDTLPTHGVPTEVRPLLDALNHLFARTQEMMARERRFTSDAAHELRSPLAALKVQTDVAQLSLDDPGAQSKALGQLHAGIDRASRLVDQLLTLSRLDSLDNLDDVEPVMMADLLQSAVLDIWHPAQQAGIDVRLNVNAPEVMRHGQPLLLSLLARNLLDNAVRYSPRGSVVDVTLNTQSFTVRDNGPGISTDALTRLGERFYRPPGQDATGSGLGLSIVKRIAALHGMHVSLGNAPEGGFAVTVSW

SEQ ID NO: 8560 - protein, 150 aa, Enterobacter cloacae
QKDGMGLFNFVKEAGEKLWDNLTDHKGQSDKITEHLKKLNIPGSDKVQVNVTDGKASVTGDGLTQEQKEKIQVAVGNIAGVSEVENNITATDAKDEATYYTVKSGDTLSAISKTVYGDANQYNKIFEANRPMLSSPDKIYPGQTLRIPKA

SEQ ID NO: 8561 - protein, 299 aa, Enterobacter cloacae
ENLKRWFIKTIRQEKVEFYCTMRDTPTTDLLELIALNDTVASFSRLFANTVRYHHWHQCLEILYVEEGFGVAIVDNRHYTMRPGRLFFFPPFTLHKVMVDEQAEAIYRRTIIHLDQHAVLKILRDFPQTRQRLERLSRRGGEAWVADLAHCHHHIDHLFSCYKPPMNGESIASLLIGLFAMLPDDRDGEPGNSQGIASQVMIWLDEHYQEKFRLDALAAELGKSRSYVSRRFHAETGEKIHDYLNTLRLRKACECLLHTDSSVRDIAAQAGFSDVTWFISAFKKGIGETPLQYRKNHSS

SEQ ID NO: 8562 - protein, 413 aa, Enterobacter cloacae
RLPATMSSIRLPSAPPRFFTHYREQAMNNFNLHTPTRILFGKNAIADLRAQIPTDARVLITYGGGSVKKTGVLDQVYSALEGLDVREFGGIEPNPSYETLMNAVKIAREEQITFLLAVGGGSVLDGTKFIAAAAHYADGIDPWHILETGGSDISSAIPMGSVLTLPATGSESNKGAVISRKTTGDKQAFMNEHVQPVFAILDPVYTYTLPARQVANGVVDAFVHTVEQYVTYPVNAKIQDRFAEGILLTLIEEGPKALKEPDNYDVRANVMWAATQALNGLIGAGVPQDWATHMLGHELTAMHGLDHAQTLAVVLPALWNEKRDAKRAKLLQYAERVWNITDGSDDARIDAAIEATRHFFESLGVPTRLSGYGLDGSSIPALLAKLEAHGMTQIGEHGDITLDVSRRIYEAAR

SEQ ID NO: 8563 - protein, 281 aa, Enterobacter cloacae
APEGGKMANQTVIKLQDGNVMPQLGLGVWKAGNDEVVSAIHKALEVGYRSIDTAAAYKNEDGVGKALASAGVPRDELFITTKLWNDDQKRPREALQESLEKLQLDFVDLYLMHWPVPAIDHYVDAWKGMIELQKEGLIKSIGVCNFQVHHLQRLIDETGVAPVINQIELHPLMQQRQLHSWNATHKIQTESWSPLAQGGEGVFDQKIIRELADKYGKTPAQIVIRWHLDSGLVVIPKSVTPSRIAENFDVWDFRLDKDELGEIAKLDQGKRLGPDPDQFGG

SEQ ID NO: 8564 - protein, 225 aa, Enterobacter cloacae
RHQGGNMRILLVEDDKLIGDGIKAGLSKMGFNVDWFTDGKTGQAALYTAPYDAVVLDLTLPEIDGLEILRAWRESGKSEPVLILTARDALNQRVEGLRLGADDYLCKPFALIEVAARLEALVRRSHGQARSELRHGKVTLDPASLVATLEGETLVLKPKEFALLELLMRNAGRVLPRKAIEEKLYNWDDDVSSNAVEVHVHHLRRKLGSDFIRTVHGIGYTLGDA

SEQ ID NO: 8565 - protein, 232 aa, Enterobacter cloacae
PSAGKIIALSAKDFAHFAYFSAPSSRVEYPAYSHHRGQIMSNILIINGAKEFAHSKGQLNDTLTEVADGFLRDAGHDVKVVRADSDYDVKAEVQNFLWADVVIWQMPGWWMGAPWTVKKYMDDVFTEGHGSLYASDGRTRSDASKKYGSGGLIQGKKYMLSLTWNAPLEAFTEKDQFFEGVGVDGAYLPFHKANQFLGMEPLPTFIVNDVIKMPDVPRYIAEYRKHLAEIFA

SEQ ID NO: 8566 - protein, 108 aa, Enterobacter cloacae
KELIMLTVIAEIRTRPGQHHRQAVLDEFAKIIPTVLKEEGCHGYAPMVDAATSASFQATAPDSIIMVEQWETVAHLEAHLQTAHMKAWSDAVKGDVLETHIRILEQGV

SEQ ID NO: 8567 - protein, 412 aa, Enterobacter cloacae
PHTTNEEHLMNTTTTRAVSRWVILMLALGAGFSVASIYYAQPLLPLMGSDLNLSIEGMGMVPTLTQAGYALGILFLLPLGDRHDRRTLILIKSAALALFLLGCSLTGQLHSLLLTSLLIGMAATMAQDIVPAAAILAPEGKQGKTVGTVMTGLLLGILLSRTVSGVVGEAFGWRVMYQLAAASIAFVGVVMWAVLPRFAVHSTLSYPALMRSMEHLWRRYPALRRAALAQGFLSIAFSAFWSTLAVMLLERYHLGSAVAGGFGIAGAAGALAAPLAGGLADKLGAGKVTQLGAALVTLSFALMFLMPALGIHGQLILIALSAVGFDLGLQSSLVAHQNLVYSLEPQARGRLNALLFTVIFIGMALGSALGSNIYTLAGWSGVVALATLCGAIALAIRVIESARVLSAQAESV

SEQ ID NO: 8568 - protein, 237 aa, Enterobacter cloacae
WKTTAGRICLILDMVERAMRTFKRGLAATLLLLSPLVQAEGLEDQLNAFFAQKLAGFSDDVRVTVRTPPNLYPSCEAPSFSVTGSTKLWGNVNVLARCANEKRYLQVAVQATGNYVVAAVPIPRGSLLQPDSVTLKRGRLDQLPPRTMLDINQAQEAVSLRDVAPGQAIQLSMLRQAWRVKAGQQVMVVANGEGFSINSEGKALNNAAVAQNARVRMSSGQVVSGTVGPDGNILINL

SEQ ID NO: 8569 - protein, 111 aa, Enterobacter cloacae
CQAQTPRTLDEDNTMSIDRTSALKPVSTVQPRETNEAAPQKTRLEKTSTANSTSVTLSDAQSKLMQPGSSDINMERVEALKTAIRNGELKMDTSKIADALIQDAQSFLQSN

SEQ ID NO: 8570 - protein, 206 aa, Enterobacter cloacae
DHPDILAYQDRCADFMLRNAMKKIVIAAALIVSGLLVGCNQLTQYTVSEQEINQALEKHNNFSKDIGVPGLADAHIVLTNLASQIGREEPNKVTLSGDASLDMTSLFGNQKADIKLKLKALPVFNKDKGAIFLQEMEIVDAVVTPDKMKPVLQTLMPYLNQSLQNYFNQQPAYVLSEDKSKGESLAKKYAKGIEVKPGEIIIPFTD

SEQ ID NO: 8571 - protein, 119 aa, Enterobacter cloacae
LRSARHGNDACHVWNGLVYSVVRPWTLLLNYLRFKLANTANGFGFCASSGSSPKTMSASDTSQCSESCTGTTGRERMTSSSTSARRSISPNSLTSIGSYASGSASACSSERTGLKQYVV

SEQ ID NO: 8572 - protein, 1040 aa, Enterobacter cloacae
VTMKRMLINATQQEELRVALVDGQRLYDLDIESPGHEQKKANIYKGKITRIEPSLEAAFVDYGAERHGFLPLKEIAREYFPANYNSHGRPNIKDVLREGQEVIVQIDKEERGNKGAALTTFISLAGSYLVLMPNNPRAGGISRRIEGDDRTELKEALASLELPDGMGLIVRTAGVGKSAEALQWDLSFRLKHWEAIKKAAESRPAPFLIHQESNVIVRAFRDYLRQDIGEILIDNPKVLELARQHIAALGRPDFTSKIKLYTGEIPLFSHYQIESQIESAFQREVRLPSGGSIVIDTTEALTAIDINSARATRGGDIEETAFNTNLEAADEIARQLRLRDLGGLIVIDFIDMTPVRHQRAVENRLREAVRQDRARIQISHISRFGLLEMSRQRLSPSLGESSHHVCPRCSGTGTVRDNESLSLSILRLIEEEALKENTKEVHAIVPVPIASYLLNEKRAAVSAIEARQGGVRCIIVPNDEMQTPHYHVLRVRKGEETSTLSYLLPKLHEEEMALPSDEEPAERKLPEQPALATFIMPEAPPEATLEKPAAKPAVQKAAPAAAKAQPEQPGLLSRIFGALKKMFAGEEVQPEQPKEAPKEAKPERQQDRRKRQNNRRDRNDRNDRSDRNERRDNRSENNEGREQREDNRRNRREKQQQNVEDREIRQQAGDESEKSKQRDEQQPRRERNRRRNDEKRQAQQEVKNLNREAPVEQQDTEQEERTQVMPRRKQRQLTQKVRVGAVQAEENDVIAVEAAESTTGTQVAKVDLPAVVENQVEQDESSENRDNAGMPRRSRRSPRHLRVSGQRRRRYRDERYPTQSPMPLTVACASPEMASGKVWIRYPVARPEQAIEEQAVTQEVIAPVAAVEDVVSEAATVVEPQVVDTAAPQAVEVETTHPEVIAAPVDAAPQIIAEEDTVVAEEVAEDAEPVSAAEETADVAVETVTEEVVQDVEIQVEPVVEEVKAPEVKSEPIEVVAAVAPAHVATAPMTRAPAPEYVPEAPRHSDWVRPAFNFEGKGAAGGHSATHMATAPATRPQPVE

SEQ ID NO: 8573 - protein, 154 aa, Enterobacter cloacae
FRTHRVSSRVTNRMSRLSEILDQMTVVLNDLKTVMDAEQHHLSSGQINGSALQRITEDKSSLLATLDYLEKQRRAEQDAKRSANDEINERWQTITEKTQHLRDLNQHNGWLLEGQIIRNQQALEVLKPYKEPGLYGADGQTATARITGGKKISI

SEQ ID NO: 8574 - protein, 543 aa, Enterobacter cloacae
GAPASQRGSSGSRPERVPRVLKTGDSRRNNPPDARHHAHAPDERPACPSSDALLAHYCDSQTSLPLLPVASALPVSFTIPVPAPSVKTVTYHFDRFSHFSMRTLYQSTFLIKKYCRQRVWEKERRHRRMLACSPFIFPGGKMSRVSQARSLGKYFLLVDNMLVVLGFFVVFPLISIRFVDQMGWAALMVGIALGLRQFVQQGLGVFGGAIADRFGAKPMIVTGMLLRAAGFATMAIAHEPWLLWFSCFLSGIGGTLFDPPRTALVVKLIRPQHRGRFFSILMMQDSAGAVVGALLGSWLLQYDFRLVCATGAVLFILCALFNGLFLPAWKLSTVKAPVREGLDRVLSDKRFVTYVLTLTGYYMLAVQVMLMLPIMVNDIAGTPAAVKWMYAIEACLSLTLLYPIARWSERRFRLEHRLMAGLLLMTLSMMPIGLVSSLQQLFMLICTFYIGSIIAEPARETLSASLADARARGSYMGFSRLGLALGGALGYTGGGWLFDAGKALHQPELPWVMLGMVGFMTLIALWWQFSDKRSTRGMLEPGA

SEQ ID NO: 8575 - protein, 118 aa, Enterobacter cloacae
  UNSURE (114)
NRKLDGKTLKNCRPLLSNRQYNCINKQYITQGAFMRIEVTIAKSTVLPAGALDALAGELSRRINSTFPENDGAVTVRYATANHLSVIGGAKEDKERISEILQETWESADDWFMXSQTD

SEQ ID NO: 8576 - protein, 207 aa, Enterobacter cloacae
NGWHRYAISGDKNMPNLVLASTSPYRRMLLEKLGIPFECAAPEVDETPQPGESPRHLVTRLAKEKAQSLAVRYPAHLIIGSDQVCVLDGEITGKPYTEEIACQQLLRARGSIVTFYTGLALYNSASGHLQTECEPFDVHFRHLSEQEIMDYVRRERPLNCAGSFKSEGLGIALFDKLDGRDSNTLVGLPLIALCQMLRREECNPLTM

SEQ ID NO: 8577 - protein, 367 aa, Enterobacter cloacae
FVSGKNSHLMTDLFQAGASMTVQSQVLKIRRPDDWHIHLRDGDMLKTVVPYTSEIYGRAIVMPNLVPPVTTVEAAIAYRQRILDAVPAGHDFTPLMTCYLTDSLDPNEVERGFNEGVFTAAKLYPANATTNSSHGVTSIDAIMPVLERMQKLGMPLLVHGEVTHADIDIFDREARFIETVMEPLRQRLPGLKVVFEHITTKDAAEYVRDGNELIAATITPQHLMFNRNHMLVGGVRPHLYCLPILKRNIHQQALRELVASGFPRAFLGTDSAPHARHRKEASCGCAGCFNAPTALASYATVFEEMNALDHFEAFCSLNGPRFYGLPINDTFIELERKESQVEASIALTDDTLIPFLAGETVNWTVKR

SEQ ID NO: 8578 - protein, 355 aa, Enterobacter cloacae
RGALCAGRRIRHASIKRKPDRARGSPGRRGCRAEAASGCVTRTSGRLIVTTLRIGVVGLGGIAQKAWLPVLGAASDWTLQGAWSPTREKAERICKTWRIPYAGSLQDLARECDAVFVHTSTATHYQVVSELLNAGVHVCVDKPLAENVQDAERLIELAARKKLTLMVGFNRRFAPLYQQLKAQPGSFASLRMDKHRTDSVGPNDLRFTLLDDYLHVVDTALWLSNGKAQLQSGTLLTNEQGEMVYAEHHFAVEHMQVTTSMHRRAGSQRESVQAVMDGALYDVTDMREWREEKGNGVVALPVPGWQSTLEQRGFVGCARHFITCVQNQTVPETSGEQAILAQRIVERLWREAMSE

SEQ ID NO: 8579 - protein, 539 aa, Enterobacter cloacae
TKRRLLALPGGAFAYPSWKSVGLWNFTLMNLLKSLAAVSSMTMFSRVLGFARDAIVARVFGAGMATDAFFVAFKLPNLLRRIFAEGAFSQAFVPILAEYKSKQGEDATRVFVAYVSGLLTLALAIVTVLGMLAAPWVIMVTAPGFADTADKFALTTQLLRITFPYILLISLASLVGAILNTWNRFSVPAFAPTFLNVSMIGFALFAAPHFNPPVLALAWAVTVGGVLQLAYQLPHLKKIGMLVLPRISFKDAGAMRVIKQMGPAILGVSVSQISLIINTIFASFLVSGSVSWMYYADRLMEFPSGVLGVALGTILLPSLSKSFASGNHDEYCRLMDWGLRLCFLLALPSAVALGILAKPLTVSLFQYGKFTAFDAAMTQRALVAYSVGLMGLIVVKVLAPGFYSRQDIKTPVKIAIVTLIMTQLMNLAFIGPLKHAGLSLSIGLAACLNAGLLYWQLRKQDIFTPQPGWASFLLRLAIAVVVMAAALVGMLYVMPEWAQGTMPYRLMRLMAVVAVGVVAYFATLAVLGFKVKEFARRTV

SEQ ID NO: 8580 - protein, 255 aa, Enterobacter cloacae
YREEHDAQNTHSRPVKETRMSIAVNVNDPTNTGVNSTSSATGSSSLTGSNASDLQSSFLTLLVAQLKNQDPTNPMQNNELTTQLAQISTVSGIEKLNTTLGSVSGQIDNSQSLQAANLIGHGVMIPGTTILAGTSTTDGTSTTTTTPFGVELQQPADKVTATIKDASGNVVRTIEIGELKAGVHTFTWDGSLTDGTKAPNGSYQVAISASNGTTQLVAQPLQFALVQGVIKGSDGNKLDLGTSGTTTLDEVRQII

SEQ ID NO: 8581 - protein, 271 aa, Enterobacter cloacae
PTSGYELTGLPMISSLWIAKTGLDAQQTNMDVIANNLANVSTNGFKRQRAVFEDLLYQTIRQPGAQSSEQTTLPSGLQIGTGVRPVATERLHSQGNLSQTNNSKDVAIKGQGFFQVQLPDGTSAYTRDGSFQVDQNGQLVTAGGFQVQPAITIPANALSITIGRDGIVSVTQQGQAAPVQVGQLNLTTFMNDTGLESIGENLYTETQSSGTPNESTPGLNGAGLLYQGYVETSNVNVAEELVNMIQVQRAYEINSKAVSTTDQMLQKLTQL

SEQ ID NO: 8582 - protein, 251 aa, Enterobacter cloacae
GVARCGKRRTGSLFSKMKAMQKNAAFRYPILTVLAVTLSGCAWIPSKPLVQGATTAQPVPGPAPVVNGSIFQTAQPINYGYQPLFEDRRPRNVGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGTNTVPSTQVADARIEYVGNGYINEAQNMGWLQRFFLNLSPM

SEQ ID NO: 8583 - protein, 366 aa, Enterobacter cloacae
PMYKFLFAVALSLVATVAQADRIRDLTSVQGVRENSLIGYGLVVGLDGTGDQTTQTPFTTQSLNNMLSQLGITVPAGTNMQLKNVAAVMVTASYPAFARQGQTIDVVVSSMGNAKSLRGGTLLMTPLKGVDSQVYALAQGNILVGGAGASAGGSSVQVNQLNGGRITNGAIIERELPTQFGTGNTINLQLNNEDFTMAQQIADTINRSRGYGSATALDARTVQIRTSTGSSNQVRMLADIQNMEVNVPVQDAKVIINSRTGSVVMNREVTLDSCAVAQGNLSVTVNRSANVSQPDTPFGGGQTVVTPQTQIDLRQSGGSLQSVRSSANLNSVVRALNALGATPMDLMSILQSMQSAGCLRAKLEII

SEQ ID NO: 8584 - protein, 317 aa, Enterobacter cloacae
MLTDSKLLTSAAWDAQSLNELKTKAGKDPAANIRPVARQVEGMFVQMMLKSMRETLPKDGMFSSDSTRLYTSMYDQQIAQQMTAGKGLGLADMIVKQTAAAQGLPPEEAPQQVPLKFDLEKVTSYQNQALTQMVRKAMPKPAETRDEPLSGDSKDFLAQLSLPARLASEESGVPHHLILAQAALESGWGQRQIRRENGEPSFNIFGVKATSSWKGPTTEITTTEYENGAAVKVKAKFRVYSSYLEALSDYVGLLSRNPRYTAVTQAATPEQGAQALQNAGYATDPNYARKLTSMIQQLKSMSEKVSKAYSTDLENLF

SEQ ID NO: 8585 - protein, 560 aa, Enterobacter cloacae
PSSGLVSERIKGTPMSSLINSAMSGLSAAQSALNTVSNNISSYNVAGYTRQTTILGASNSTLTGGGWVGNGVYVSGVQREYDAFITNQLRAAQNQSSGLTTRYQQMSKIDDVLSDTTNSLSANLQDFFKSLQTLVSNAEDPAARQTVLGKADGLVNQFKTNDQYLRDQDAQVNTAISTSVDQINNYAKQIANLNDQISRLTGVGAGASPNELLDQRDQLVSELNKIVGVDVTVQDSGTYNISIANGYTLVQGSNASQLAAVKSSADPARTTIAYVDAAAGNVEISEKQITTGSLGGLLTFRSQDLDQARNTLNQMALAFADAMNTQHQAGFDANGDKGGKLFDFGSPAVLSNGKNTGSASVTATMTDSTKVQATNYKVEYNGTDWTITRLSDNTSFTAKPDASGNLSFDGLNVKISGSANNKDSFIVKPVNDVIVNMDVAISDESKLAMASAQGSGESDNTNGQKLLDLQSAKLVGGNKTFNDAYAALVSTVGSTTASLKTSSETKVNVVTQLTKQQQSISGVNLDEEYGNLQRYQQYYLANAQVLQTASTLFDALINIR

SEQ ID NO: 8586 - protein, 64 aa, Enterobacter cloacae
KINTSYAIAAWMIGQTKLVIPSTSLQNPDLTRKTDSLFHCSPGYSKMTFTNYHPVTHSFFTSTG

SEQ ID NO: 8587 - protein, 177 aa, Enterobacter cloacae
YARPMQKVKLPLTLDPVRTAQKRLDYEGIYSSDQAERIAESVVSVDSDVECSMSFAIDNQRLAVLTGDAKVTVTLECQRCGKPFVQHVHTTYCFSPVRSDEQAEALPEAYEPIEVNEFGEIDLLALVEDEVILSLPVVPVHDSEHCEVSEADMVFGELPDEAQKPNPFAVLASLKRK

SEQ ID NO: 8588 - protein, 206 aa, Enterobacter cloacae
QAEQKRREGVVTMFGYRSNVPKVRLTTDRLVVRLVHERDAWRLADYYAENRQFLKPWEPVRDESHCYPSGWQARLSMIAEFHKQGSAFYFALLDPEEKEIVGIANFSNVVRGSFHACYLGYSIGQKWQGQGLMFEALTAAIRYMQRTQHIHRIMANYMPHNKRSGDLLARLGFEKEGYAKDYLLIDGEWRDHVLTALTTQEWTAGR

SEQ ID NO: 8589 - protein, 219 aa, Enterobacter cloacae
GEKMKYQLNGAEARVIGCLLEKQVTTPEQYPLSVNAVTMACNQKTNREPVMNLGEHEVQDILDELVKRHYLRTVSGFGNRVTKYEQRFCNSEFGDLKLSAAEVAVITTLLLRGAQTPGELRARASRMHEFQDMQDVEQTLEGLASREDGPYVVRLPREPGKRESRYMHLFSGDVEPSALAVVSDTPASNESLTARVAALEDEVAGLKQRLDALLAHLGD

SEQ ID NO: 8590 - protein, 146 aa, Enterobacter cloacae
NFLISGGDMLDKLDAALRFQQEALNLRAQRQEILAANIANADTPGYQARDIDFSSELKKVMERGRAEGTGVSLALTSSRHIPAQAMTAPTTDLLYRIPDQPSLDGNTVDMDRERTQFADNSLQYQTGLTLLGGQIKGMMTVLQGGN

SEQ ID NO: 8591 - protein, 134 aa, Enterobacter cloacae
MALLNIFDIAGSALTAQSKRLNVAASNLANADSVTGPDGQPYRAKQVVFQVDAAPGAATGGVKVADVVESQAPDKLVYEPGNPLADASGYVKMPNVDVVGEMVNSMSASRSYQANVEVLNTVKSMMLKTLTLGQ

SEQ ID NO: 8592 - protein, 255 aa, Enterobacter cloacae
RESAMDHAIYTAMGAASQTLNQQAVTASNLANASTPGFRAQLNALRAVPVEGLSLPTRTLVTASTPGADMTPGQMDYTARPLDVALQQDGWLAVQTADGGEGYTRNGNIQVSATGQLTIQGHPVMGEAGPLTVPEGSELTIAADGTISALNPGDPANTVAPVGRLKLVKAEGNEVQRGDDGMFRLTQAAQATRGATLQADPTIRVMSGVLEGSNVKPVEAMTDMIASARRFEMQMKIISSVDENAGKANQLLAMS

SEQ ID NO: 8593 - protein, 318 aa, Enterobacter cloacae
KMRISTQMMYEQSMRGVTNSQSLWLSYGEQMSTGKRINRPSDDPIAASQAVVLSQAQTQNSQYALARSFATTKVSLEENVLSQVTTAIQAAQEKIVNAGNGTLSDDDRASLATNLQGIRDQLMNLANSTDGNGRYIFSGYKTEAAAFDQTTGDYKGGGTPISQQVDSARTMQISHTGTEVFDSFTSNAKPEPDGSKPETNLFKILDSAIEALNTPIGEDETKAEAFTAAIDKANRGLSNSLNNVLTVRADLGIKLDELGKLDALGEDRALGQTQQMSNLVDVDWNSVISSYTMQQAALQASYKAFSDMQGMSLFQMNR

SEQ ID NO: 8594 - protein, 318 aa, Enterobacter cloacae
RMDGNGMKRPERIDRVELMRTFVRIVEAGSLSAAARQLATTQATVSRRLQSLETMLGVRLMLRTTHTTRLTDDGERCYQHARRVIDSWLALEDEVGQTEDEPVGVLRVRAPHAFGQDQLLKPLTEFLQRYPQLSVEWMLNDRSVDFLGDNLDCAIRVGVEVDPATVSVLLAEVPRSVVASPELLARYPAVKTPEDLQQLPWIAISSFYQRHVELFHDASSAPTRVTITPRLSTDSLYVARNTALTGLGVAVVSSWTVQDDIQEGRLVHLLPEWQPAALPVHLVYPWSRYYPARLRRFLELMRQIMPEVTGMRKPLQQP

SEQ ID NO: 8595 - protein, 61 aa, Enterobacter cloacae
GVRSMAVQQNKPTRSKRGMRRSHDALTAVTSLSVDKTSGEKHLRHHITADGFYRGRKVITK

SEQ ID NO: 8596 - protein, 106 aa, Enterobacter cloacae
SRVSVIRLSEELPRANGEFTEPGCDDTLTRLTLALDVMGGDFGPTVTVAAALQALNSNSQLKLLLFGNPDTITPLLGKTDLDQRSRPQIIPGQSRMPMMPGLACFP

SEQ ID NO: 8597 - protein, 403 aa, Enterobacter cloacae
VMAFSQAVSGLNAAATNLDVIGNNIANSATYGFKSGSASFADMFAGSKVGLGVKVAGITQDFTDGTTTNTGRGLDVAISQNGFFRMVDANGSVFYSRNGQFKLDENRNLVNMQGLQLTGYPVAGTPPTVQTGANPQAISIPTTLMAAKSTTTASQQINLNSTDTAPTVAFDPANPDSYNKKGTVTVFDSQGNAHNMNLFYVKNATPANSWKVYSQDGSVAGDAAKLATTLTFNASGVLTGGDDIKITTGTVPGATPATFDMSFANSMQQNTGANNIVATSQNGYKPGDLVSYQINDDGTVVGNYSNEQTQVLGQIVLANFANNEGLKSEGDNVWSATQSSGVALLGTAGSGNFGTLTNGALEASNVDLSKELVNMIVAQRNYQSNAQTIKTQDQILNTLVNLR

SEQ ID NO: 8598 - protein, 89 aa, Enterobacter cloacae
EAQSVGCLCFIRKHSAIIRGIAWENSPENNPYTGKYCNPQPANCLKDQYVLRHCCVDDRSDKIGHSVDILTKPGFNAENGFIIPLLAGL

SEQ ID NO: 8599 - protein, 322 aa, Enterobacter cloacae
RYLESPTMKTETPAVKMVAIADDEAGQRIDNFLRTQLKGVPKSMIYRILRKGEVRVNKKRVKPEYKLEAGDEVRIPPVRVAEREEEVVSPKLQKVAALSDVILYEDDHILVLNKPSGTAVHGGSGLSFGVIEGLRALRPEARFLELVHRLDRDTSGVLLVAKKRSALRSLHEQLREKGMQKDYLALVRGQWQSHVKVVQAPLLKNILQSGERIVRVNQEGKPSETRFKVEERYEFATLVRCSPVTGRTHQIRVHTQFAGHPIAFDDRYGDREFDKQLAGTGLSRLFLHAAALKFTHPNTGEVIRIEAPLDEQLKRCLKVLRG

SEQ ID NO: 8600 - protein, 405 aa, Enterobacter cloacae
HYLHNFMRTRTENLTDVVAPKANWSLALGAGLLGIGQNGLLVMLPQLVSLTGLSLSVWAGLLMFGSMLFLPASPWWGRQSERHGCKIVMLASLGGYLASFVVMALVVWAMANGALNALWGMAGLVLSRMLYGLTVSGLVPAAQTWAIQRAGLDKRMAALATISSGLSCGRLLGPPLAALMLGVSPVAPLWLMALAPLIALLLVLREAADPPLPPVAHQSTRLQASMLPFLVLALLLAALVSLMQLGLSPHLHPLFNGDVVQISHHVALLLSLAALATLAAQFLVVRPQHFTPRVLLLIAAVLMVAGLGLMSLASLALFYVGIVITSLGAAMATPGYQLLLNDRLTTGKGAGVIATSHTLGYGASALLVPVVTRFYGEQFLITAAWGMALLFLAVSVWVRSTDRTP

SEQ ID NO: 8601 - protein, 401 aa, Enterobacter cloacae
PSIPIPACWTATTTYCRERLLRVRLSGASTAVTASAVMRWQISLFLVRLQDIRRLCVRKHGKAPVSPAARCLPGLHLRTHAMPDSHRVYSYSAVLMGSPILLKLFSHDEALASRVFRLIKQYEDLLTVNRAHSQVMDINHAAGQHPVAVSRPVFELIRCAKAASLLKDSAFNLAIGPLVKCWKIGFKGDAVPPADEIAALMGITDPADVVLDEANSSVFLTRQGMEIDLGAIAKGYIADRVRDYLHKEGAELGLINLGGNVQTLGSPEGGWRVGLKKPFAGDALIGAMTVENRSVVTSGTYERYFEQNGKRYHHILDPRTGYPLDNELDSVTIISPDSLDGDIWTTLIYGMGVEKGCAALRSRPDIEAIFVTKTKEVVISSMHHFRFTLLDDSYRITGSTA

SEQ ID NO: 8602 - protein, 337 aa, Enterobacter cloacae
HSAMKKKGLIIADDGRFIKPCKERRFVSLLSGDLYKTLYSVWVLIIRRQFMSIMLTGTARERRHASTMNIDRLSTLDMLNVIHQDDAQITSALTPHLSMLARVVDNAAATLSHGGRLVLTGAGASGRMAEQAAEAFAPGKHPVIAMTAGDNAGSYASGVADLQTIEFGEHDMMLALSVSGKTPWVWGAMRHAWSLGSTVALITEDAQSEAAQLASMVIAPDLGADVVAGYTNAKAGIAQSMILHMITTGLAVRTGRVYSNLRVDLEASNTRWAERQIAIVMEAGGCSRAQAKAALESCNHQCKTAVLMVLTGLNAWKAHELLAQNNGFVRLALQEAP

SEQ ID NO: 8603 - protein, 501 aa, Enterobacter cloacae
PISVAVCDPELWYSVFCLYCPVKRMQENRSVTVPAPERVEKSTAAVQALLRQLLEMYDAKTLANQLVAHGESHWSPAILKRLLISDRAGHRLSDGEFRYLRNLLPRPPAAHPNYAFRFIDLFAGIGGIRHGFEAIGGQCVFTSEWNKHAVRTYKANWYCDPDAHQFNADIRDVTLSHKTGVSDEEAAEHIRNTIPAHDVLLAGFPCQPFSLAGVSKKNALGRAHGFACDTQGTLFFDVARIIDARRPAIFVLENVKNLKSHDGGKTFRIIMQTLDELGYDVADAEDMGPDDPKIIDGKHFLPQHRERIVLVGFRRDLNLKGDFTLRDLPSLYPARRPTVADLLEPAVDAKFILTPVLWKYLYRYAKKHQAKGNGFGFGMVNPLNPDSVTRTLSARYYKDGAEILIDRGWDKALGEKDFDDPQNQQHRPRRLTPRECARLMGFETPQGYSFRIPVSDTQAYRQFGNSVVVPAFAAVAKLLASRISKAVQLRQSEAVNGGRSQ

SEQ ID NO: 8604 - protein, 320 aa, Enterobacter cloacae
VLFHTIHLISKKRRIEILAGSSLLTLLDDIATLLDDISVMGKLAAKKTAGVLGDDLSLNAQQVSGVRANRELPVVWGVAKGSFINKVILVPLALLISAFIPWAITPLLMIGGAFLCFEGAEKVLHMFAARKEKDTPEMRQQRLEALAAQDPKTFERDKVKGAIRTDFILSAEIVAITLGIVSEAPLMNQVLILSGIAILVTIGVYGLVGLIVKLDDIGFWLEKKSSAIARGIGKSLLVVAPWLMKTLSVVGTLAMFLVGGGIIVHGVASLHHMIEHFASGQGAVVAAILPTLLNLVLGFIVGLIVVAVVKLVEKVRGKSH

SEQ ID NO: 8605 - protein, 335 aa, Enterobacter cloacae
FSYLSRLAQEGLQFKNLRPIIKNALWGKIPRKNRVENDVASLIYSFAQLEAFTAVAEHGSLMKAASKLGKDRTTLRDLIDFLEDGLGYALFLREGRSLRLTPEGEQLQRQAHLLMRQVKAFEAFARTVPDSATQDIALVYDPFTPRAFLQALIATLATKKTRLSLTSASRDEAEAMLANGQADLGICQARNRSVGNEMEWRALGAIEMDFYAATALFAEVASPVSLLDLSLVPQVVMHAASDEPVARRLQISGHTLFTNELEMLRGLLEQGCGWGFLPTHLHATQWKNVKRLPTEVGSQGISQTMVTIWKPGSDKRGLINDTLSQLPALWKRSAL

SEQ ID NO: 8606 - protein, 183 aa, Enterobacter cloacae
LNCWPHVSARPFSFVRVRPSMADVHNKATRSKNMRAIGTRDTAIEKRIAGLLTAVGFEFRVQDATLAGRPDFVIDAYQCIIFTHGCFWHHHDCYLFKVPATRTDFWLDKIGRNVERDKRDVSQLYAQGWRVLIVWECALRGRMKLNDVELTERLEEWICGGGQAAQIDTQGIHPITVSPPHTS

SEQ ID NO: 8607 - protein, 394 aa, Enterobacter cloacae
PLFYRCPDFFHSPDLARSCGTGRCLYLQPSVTIWKRLPVRWTDSFSSASIKCCFFATAGMMRWDTPLAFGALHDAVKRFAQLRTSPTWQIAVDKRRTLPINGVSDAFVEKTTLLNRDDEYLDNELSAALEVGYLLRLASSPSRNEERVIYVSRAGFFLETDTPGNSSDIVQRYYHLVTQPWFTQQSERENRARAVRWFISPPSSFVGKKPLITASVPVYYHHVWYGVVAMDFTFATLRRLLVEAVGDNPEGEYQLYDSRLTLLATSESPAVDVNHFDARELAQIAHAIESDSEGGIRLGSRFVSWERLDHFDGVILRVHTLDEGVRGDFGSISIVLALLWALFTAMLLISWLVIRRMVSNMYSMQNSLQWQAWHDPLTRLHNLHHEAGAIRNYN

SEQ ID NO: 8608 - protein, 313 aa, Enterobacter cloacae
ISSYPTMLKDPVSMPVNFDLNDLYAFRALLEYGNFRLAAESICLSQSALSRRIEKLEAALGTKLFDRTTRRVTLTLYGQTFADRCGQLLADVESMLSDIDKASEERTGLITVATVPSAACYFMPDVIRRFQSRYPRVRIKLIDSSAGNVIEAVTRGQADFGICFARSLQPDIEFVPLVEDVYVAACRRDSPLAKRKSLTWQAFYQQDYIGLDKTSGNRNLLDQRVGHIRPERPSICETRHVTTMLGMVEAGIGIAAVPAMSMPRAEHSLLTSVPLTEPEVRRTVGLIRRRGRIQSYIAAELETLITEQYREVH

SEQ ID NO: 8609 - protein, 934 aa, Enterobacter cloacae
FLKFGVSIMSTNERILSPFTLPNGTELKNRLLMAPMTTCTGYYDGTVTSELVEYYRARAGSIGTIIVECCFVDDLGLAFPGAIGIDNDEKIAGLAKIADVIKSKGSKALLQIYHGGRMVDPKLIGGRTPVGPSAVAAPRDGAATPVALTAEEVEGMIGKFGEAVRRAIQAGFDGVEIHGANTYLIQQFFSPNSNQRDDEWGGSRENRAKFPLAVLDITHKMVRQYADDAFIIGYRFSPEELEVPGIRFEDTLYLLEKLAARGVDYLHFSLGDALRPSIVDTQDPTPLIEKYCAMRSDTLAQVPVMGVGGVVNATDVNEALDHGYDLIAVGRATIAYPDWTDRIAAGESLELFMDSTRREELSIPEPLWRFSLVEAMIRDMSMGESKFKPGTFIEKVQDDANELVINVSLETDRIADIELASGPSEDVEFVTSFEEIRSRILDANTPHVDAITGATSQSEAVKKAVSKAMLKSSKALAAEEGADPNETKSVDVVVVGSGGAGLAAAIQAHDEGASVLIVEKMPTIGGNTIKASAGMNAAETRFQRVKGIQDSKELFYQESLKGGGNKNNPELLRRFVENAPQAIEWLATRGIMLNDITTTGGMSIDRTHRPKDGSAVGGYLISGLVRNVNKRNIEVMLDTSVSDIIFENGEVTGVRLTTEENETLTVATKSVIVATGGFSANSEMVVKYRPDLAGFVTTNHKGATGGGIALLERIGAGTVDMGEIQIHPTVEQKTSYLISESIRGGGAILVNQQGNRFYNEMSTRDKVSASIIALPEKYAYIVFDEHVRVKNKAADEYIAKGFVTSASSPKALAEALGMDHHQFLATLERYNGFVEKQHDDDFGRTTALRAPINEGPFYAIQIAPGVHHTMGGVTINTDTCVLDSNHNVLPGAFAAGEVVGGIHGGNRIGGNAVADIIIFGTLAGHQAAMRSKTR

SEQ ID NO: 8610 - protein, 256 aa, Enterobacter cloacae
FYLLKILIRMYYNSLSFEQQDGMMELAQWQHRYERWLDENHFTDDAAHDIAHFRRVWMTAQGIMADEDSDPLVVLTACYFHDIVSLPKNHPERSHSSRLAARKTREILSRDFPDFPPDRYAAVEHAIEAHSFSAGIAPQSLEAKIVQDADRLEALGAIGLARVFAVSGALGAALFDADDPFAGTRALDDKAFALDHFQTKLLRLPDTMQTARGRKLARHNADFLIQFMAKLSAELQGDYLGTDSQILTHFRRSVRS

SEQ ID NO: 8611 - protein, 70 aa, Enterobacter cloacae
KRFTLIQEAGMVFLISDEVKPKNGGPGMIVTGYSSGMVECRWHDGYGIKREAFREDELQPANKRQKRDKA

SEQ ID NO: 8612 - protein, 85 aa, Enterobacter cloacae
SHNARPCRAFLLAEDLSYRMVSDNQGVCVQHDTFVVKQSFLQWLHKRSNPSLIVNLCFIVVLIFSTLLTWREVVVLEDAYISSPA

SEQ ID NO: 8613 - protein, 172 aa, Enterobacter cloacae
APRSVLLVLWIVEIFFAQRLIPAPIDKNFRAIFVIARRQRTRHAVRIKRIDHAKPKAIAFGLMLFGIAIEVFPQHRGQNEFRIDGGLQQIGHRRAARRIQRRQITQRKIAFQVEIAAEAHQHNTFAVLWQEVFAVDNFRIVRPHILCIRHVVTQFIQRLHDNAEGFAAVMTL

SEQ ID NO: 8614 - protein, 215 aa, Enterobacter cloacae
ILDVLQHKNCRAAGINNPGNVKKQCALRITGKAVCASQRVLFRHASQRERLTRKACQQHIVRRNGIANVFGGLFIADASFVAQRDITNIRVELVRVGVAIPVGFIGTDGMFIPFTGEDTLPANSFKAMANAADTGKEIDKAKGIIRMRSRRTRQQVAQITELAVAQAVPCPVAYQQPLEYRRAPVTLAMGHQLVCQRFSIIHFQQLTQECLHGCR

SEQ ID NO: 8615 - protein, 392 aa, Enterobacter cloacae
REYIMKRKVLAILVPALLMAGAANAAEMYNKNGNKVDLYGKVDARHTFSDNPGDDGDETYVQVGFKGETQITNDLTGYGQWEYKTYANDTEGAGDTSFNRLAFAGLKYGEYGSFDYGRNYGVVYDVEAWTDMLPVFGGDSYTWTDNYMVGRTNGVATYRNNDFFGLVDGLNFALQYQGANEGANANENQEGTKNGHDDVRFQNGDGFGMSTTYDFDFGLTLGAAYSSSDRTNDQVAYGAGTYNRFSKYAGGERAEAWTIGAKYDANDVYLAMMYAETRNMTPYGNGGIANKTQNFEAVAQYQFDFGLRPSLAWVYSKGIDLGGNDYHPGNGYDYVDQDLVNYIDVGMTYSFNKNFSTYVDYKINLLDEDDAFYNDNGIATDDIVGIGMIYQF

SEQ ID NO: 8616 - protein, 547 aa, Enterobacter cloacae
PFLFHRGVLMSDLQPFPPTRKRPMKLNTLVTLMVCAIIGSVLLVVFALYSVQITRATRDDVKDTALGIARTLADSPEIKRGLMESPQAGIIQPIAEAVTKRNDLLFTVVTDLRGIRYSHPNEALLGLHFIGDDLTPALEGKENVSVNRGALAEALRVFTPVYDDQHDQIGVVVVGISLNKVEDQIARGRLNAVWTILFSVLMSSVAIWGLVRVLKRILFGLEPYEISALFEQRQAMLQSLREGVMAVDMHGRVTMINHTAREILLLSSGEHSESSGEPLLASLREVAKTGIARQDQEIGCNGRLLLCNMVPVKSQNQVIGAISTFRDKTEISQLMQRIDGMVNYVDALRSHTHEFMNKLHVILGLLHMKRYDKLEEYIIQTAQNYQTDIGAIQRKVKSPVIAGFLLGKINRAKEAGVTLTLAEESQLPDTANEEQVAVLITVLGNLIENALDAMEGQPEGEIGLLLHYQNGWLSGEVSDDGPGIDPERLEAIFTKGYSTKGENRGVGLFLARQQIQNLGGDITVESEPGVFTQFFVQIPWDSERNIA

SEQ ID NO: 8617 - protein, 484 aa, Enterobacter cloacae
VIVEYVNTGQRIVINAPHASVYALFALINFHFLIQFSETDEHNVAIKLEIIMVSSTSPATVRAKAGAIFRVTSGNFLEQFDFFLFGFYATYIAHTFFPASSEFASLMMTFAVFGAGFLMRPIGAIVLGAYIDKVGRRKGLIVTLSIMAAGTFLIVLIPSYQSIGLWAPLLVLTGRLLQGFSAGAELGGVSVYLAEIATPGRKGFYTSWQSGSQQVAIMIAAAMGFALNVVLEESAIREWGWRIPFLFGCLIVPFIFFLRRKLEETEEFSARRHHLAMRQVFTTLLANWPVVVAGMLMVAMTTTAFYLITVYAPTFGKKVLMLSASDSLLVTLLVAVSNFIWLPVGGALSDRFGRKPVLIAMTLLALATSYPALTMLAAAPSFSMMLTVLLWLSFLYGLYNGAMIPALTEIMPAEVRVAGFSLAYSLATAVFGGFTPVISTALIEYTGDKASPGYWMSFAAVCALLATLYLYRRRTLILQTAVKE

SEQ ID NO: 8618 - protein, 264 aa, Enterobacter cloacae
SLMLTFRTVIAALTFATLSAGALAQDVTVMISGGFKAALEKLTPQYEAQSGDRLIVISGPSMGKTPQAIPARLARGEKADVVIMVGDALAKLEQDRRTAAGSRVELADSPVGMVVKAGAPVPDISTVPALRQTLLKAHSMAYSDSASGRYVESQLFRKLGIDGQVHDKAHRVERIPVASEVAKGKYDLGFQQVSELLPVPGVTFVGKLPDDIQYITRFAGAVTQKADHPEQGKALLTFLASPQAASVITATGLTPVSAPRDTAR

SEQ ID NO: 8619 - protein, 278 aa, Enterobacter cloacae
PFHFVHVRVTSKAMIKWPWKTNDAGRNMALPWDEALAIPVLANLLPEEQSKLIQLAERFLQQKRLVPLQGFELDPLKNSRIALLFCLPVLELGIEWLDGFHEVLIYPAPFIVDDEWEDDIGLVHNQRMVQSGQSWQQGPIILNWLDIQDSFDASGFNLIIHEVAHKLDTRNGDRASGVPLIPLREVAGWEHDLHAAMENIQDEIDLVGESAASIDAYAATDPAECFAVLSEYFFSAPELFAPRFPALWQRFCQFYQQDPLQRLRQSEDAASTSSHPFH

SEQ ID NO: 8620 - protein, 583 aa, Enterobacter cloacae
GTTMRTLLRSAGTDVAAQCFLNALLRETKDWHYLPATRADELSLIHIPLSPTQAIRVPVRYFSPTQHHQYLFPATLIQADSDGGDTVTFHQLIDLIIEKETVKGALDADTLARFKQRVLESHTHTWQAIDLRHNWANLRDKPLTFAEAEQALLVGHAFHPAPKSHEPFNEAEARRYLPDFASRFPLRWFAVEHELITGDSLNVSLRERLLRFAAQSAPALLGHFTDTCWLLPMHPWQADYLLEQDWCQRLVEKGALRDLGEAGAPWLPTSSSRSLYSETNSDMIKFSLSVRLTNSVRTLSVKEVKRGMRLARLAKTARWQGLQARYPTMRVMQEDGWAGLRDEHGVIQEESLMALRVNLLFDTPETQTNVLVSLTQAAPDGGDSLLAAAVRRLSQRLDLPLAQAARCWLDAYCDRVLLPLFSAEADYGLVLLAHQQNILVEMQQDFPVGLIYRDCQGSAWTEGADAWLNEAGETEVENRFGESQLLRYFPYYLLLNSTLAVTAALAAAGFDSEENLMSRVRDALAELRTTAKQTRCLDYVLDSPTWNCKGNFFCYLHDRNENTIVDPAVIYFDFSNPFYKEKA

SEQ ID NO: 8621 - protein, 234 aa, Enterobacter cloacae
PSFSGLPGVSAMKTYDFIGIGIGPFNLSIAALAEGLDGFSSLFLERKPHFSWHPGMMVPDCHMQTSFLKDLVSAVEPTNRHSFLNYLVQRKKFYRFLTTEQRTVSREEFADYLCWAADNLTNLAFSQQVQQVSFDEQNGLFEIVTQRDRFLARHVCVGIGKQINLPDCVTAQDDTCFHASEMMLRTPDLAGKRVTVVGGGQSGADLFLNIFRGEWGQPLSLNWVSRRQQLQRVG

SEQ ID NO: 8622 - protein, 184 aa, Enterobacter cloacae
PPKGITTESLLGIYRAMYHRFEVLREKPWAHLMPSRSVTALTRQETGPRLSIQHHLDGGREQLESDVVIFATGYRAVQPAFLAPLSSRLRLDEDEAFCINNDFTLEWDGPQSNRLFAVNAGMHRLGIAEPQLSLMAWRAARILNRAHDDEPFELATTPGVIHWRSTTSPESSQVFKSLIKTTEY

SEQ ID NO: 8623 - protein, 306 aa, Enterobacter cloacae
GTMRFRHLLPLIGALFSLYIIWGSTYFVIRIGVESWPPLMMAGIRFLTAGVLLMAFLLLRGHRLPPLRPLLNAALIGLLLLAVGNGAVTVAEHQNVPSGIAAVVVATVPLFTLCFSRLFGIRTRKLEWLGIAIGLVGIILLNSGGNLSGNPWAAVLIMIGSMSWAFGSVYGSRIELPSGMMAGAIEMLAAGIVLLMASALTGEKLTAMPDLSGFLAVGYLALFGSIIAINAYMYLIRNVSPAVATSYAYVNPVVAVLLGTGFAGEVLSTIEWLALGVIVFAVVLVTLGKYLLPAKPIVTRCEVEKP

SEQ ID NO: 8624 - protein, 522 aa, Enterobacter cloacae
SNRICVFAVRRIFDNLRRETMKTKTAVTPPAANLASNGTAKRLLMMALPVIVAVLLLFVPVPDGLPPYAWHYFAIFVGVIVGLIFEPLPGAVIGLTGVVAIALCSQWVLFSPEQLADPKFKLAGASFKWAVSGFGNSTVWLIFGAFMFAAGYDKTRFGRRLALILVKYLGRRSLTLGYAITFADLLLAPFTPSNTARSGGTIYPIIANLPPLYGSKPNDPSARKIGSYLMWVAITAACITSSMFLSALAPNLLALALVKSTVGIDISWGTWFLAFLPLGILLILTMPLLAYWFYPPEVKVNNEVPLWATRELEKLGKLSRNEILLLVFVCCALLMWIFAAAWIEPAMAALLIVGLMLWTGVLEWNDITGNKAAWNTFVWFATLVALADGLSSTGFISWLGKEGGLLMSGISPGVATIVLLLAFYLLHYLFASTTAHTTALLPAMLTIASTIPGMNMEVFVLLMVTSLGVMGIITPYGTGPSPIYYGSGYLPTKDYWRLGTIFGAIFLAALLLIGYPWMSMMF

SEQ ID NO: 8625 - protein, 442 aa, Enterobacter cloacae
TEVLPEPNVINMKIKTNRTLLAALVISSLLSPAVMAACNGTDLTTCPAPFDARLPDAHTMLTWSQADRVVGFRNDYRNYAGDVFRHGNATPLLPAEKPLTDARYQVKGKIYNLQDYLKRQNVSGMLVLKNGKVAYKYLGEGNTDSTLWTSRSVGKSVVSALVGVAIKEGKIHSLDDLVTQYEPDLKGTAWEGVTLKQLITHTSGVAWTEDYTNAQSDFARLTECEAKPGTYDCVRTLVKGLHREHPAGENWSYSSGGAWLLGDVLERATGMTLAAYLEKSIWQPYGMASDGVWHAYSKGQHDVGAHGFNATLEDWGRFGEFILHNGTLPDGKQILPEGWVKQSSAWTQAKGSVSEAHPKGLYGYQWWNNEVPATATNVEPKVENSLKDSLWALGIFGQMIMVNHKENLVIVQWSTWPQAEPSFSAQPLEASLMFSAIANALR

SEQ ID NO: 8626 - protein, 635 aa, Enterobacter cloacae
TAHGAHCGGTALRQPASVPPSGVRRFRHGERVRLPAQTLPPHHERASSLLPRGGTVNALWQKVNREMVAKILAELEYERTLRAEPDSADYWRISMGNACWQFRATRGIWGWLHIDPDTLTTTSGAAVEAENALLQLATVLEMSDAQTAEHMEDLYATLRGDMQLLQARETLDADALIHLDPDELQCLMRGHPKFIFNKGRRGWGLDALRLYAPEYRGRFRLHWVAVQRDRLVWSSDADCDINALLSSAMDDAERERFDARWQELDLDDSWLPVPLHPWQWQQKIAIHFLAQLARGEMVELGEFGDEYLAQQSLRTLTNASRRTPYDIKLPLTIYNTSCYRGIPGKYIAAGPLASRWLQQQFASDATLIRSGAQVLGEPAAGYLSHPGYAALPEAPYRYQEMLGVIWRENPSCYLQDGEQAVLMAALMETDNQGRPLIDAWIKRSGLTADAWLEKLFEATVIPFYHLLCRYGVALIAHGQNVTLVMKDYVPQRILLKDFQGDMRLVDEDFPQAQSLPEQVKAVTARLSADYIIHDLQTGNFVTVLRFISRLTLQCGVNETRFYQILALVLHRYMAAHPDLAARFAKFDLFKPQIIRVILNPVKLTFSEHDGGSRMLPNYVCDLDNPLFLASRESAQ

SEQ ID NO: 8627 - protein, 93 aa, Enterobacter cloacae
NVMALPARPGEQTRYSAPAIHALSRHSDPSAPSVPPFCTGGYSFPARPSPAPGYIPPLPSQWQFVVRPIWCCLPPDQRAGCCTPVLSVPPDRW

SEQ ID NO: 8628 - protein, 244 aa, Enterobacter cloacae
REEYRVINVLIVDDDAMVADLNRLYVNRVEGFSCCGVASTLNQAEALIANPGQPIDLVLLDVYMQQDNGLDLLPIIRASGRPIDVIMISSASDAATIQTSMHYGVVDYLIKPFQFPRFEEALNGWKAKRSLMGSHQYYEQADVDRLIHGGAPELADSKKLPKGLTPQTLRTICQWIDSHPEIEFSTDDLANAVNISRVSCRKYLIWLAQINILFTSIHYGATGRPVYRYRLQPEQVGLLKQYCQ

SEQ ID NO: 8629 - protein, 564 aa, Enterobacter cloacae
PPDISSGGFIFVEQAMSNKPFIYQNPFPLAHDDTEYYLLTKEHVSVAEFDGQEVLKVEPEALTLLAQQAFHDAAFMLRPSHQKQVAAILNDPEASQNDKYVALQFLRNSEIAAKGVLPTCQDTGTAIIMGKKGQRVWTGGGDEAALSQGVYNTYIEDNLRYSQNAALDMYKEVNTGTNLPAQIDLYSVDGDEYKFLCMAKGGGSANKTYLYQETKALITPAKLKKYLVEKMRTLGTAACPPYHIAFVIGGTSAEATLKTVKLASARYYDGLPTEGNAHGQAFRDVQLEQELLQEAQNLGLGAQFGGKYFAHDIRVIRLPRHGASCPIGMGVSCSADRNIKAKINREGIWIEKLEHNPGQYIPESLRQQGEGDVVSIDLNKPMPDILAQLSAHPVSTRLSLNGTIIVARDIAHAKLKELLDNGEELPQYVKDHPIYYAGPAKTPEGYASGSLGPTTAGRMDSYVDLLQSNGASMIMLAKGNRSQQVTDACHKHGGFYLGSIGGPAAVLAQNSIKSLECVAYPELGMEAIWKIEVENFPAFILVDDKGNDFFQEIQNKQCKGCSQR

SEQ ID NO: 8630 - protein, 319 aa, Enterobacter cloacae
GEGVMANANIVHSGYGFRCTVTEQNLPLTLGLDGSAVMERLIGLPDGWLVDALDQLFVAAPALTGITLPWAAWQDEPQAQALFSLVHGDYLAREIFWQLPLWLKGERPQASGGMQFDESRQLYFPLRPHRPQGEVYRRYDPQIKRTLSFRVADVALDGERFTRWMNTPRVNAFWEMAGPQAEQENYLRRQLDSTYCYPVLGCFDDQPFGYFELYWAAEDRIGRHYRWQPFDRGLHMLVGEENWRGAQYIRSWLRGLSHYLYLDEPRTARIVAEPRFDNQRLFRHLASAGFDTVKEFDFPHKRSRLIMSERHRFFHEVEL

SEQ ID NO: 8631 - protein, 152 aa, Enterobacter cloacae
DCDPAGSLPGAARLRGDWEADQSARLRHRAGRYLLPRQRNDAAHAGFSGQARHRRRRRPERCGSVPEYLPWGMGPAAEPQLGVAPPTTTTRWMKPGLLTIIFTPEYVDSFSTFGDDAGSQMLQEQKMTSEGDHHRVLAGDIPRHVPPFRSAA

SEQ ID NO: 8632 - protein, 407 aa, Enterobacter cloacae
IINKDHRVLTHTFRINITMKRSHLWVLNPCLLAMLSTSAWAEEQKEEDIVVSASRAHRSVAEMAQTTWVIERAEIEQQVQGGKEIKDVLAQLIPGMDVSSQGRTNYGMNLRGRSMMVMVDGVRLNSSRSDSRQLDSIDPFNIDRIEVISGATSLYGGGSTGGLVNIVTKKGQPETEVEFQTGAKSGFNSHNDHDENVSAAVSGGNDNASGRLSVSYQRYGGWYDGNGDEVIIDNTQTGLQYSDRIDVMGTGTINIDDHQQLQLTTQYYKSESDGKHGLFLGENFAAVTGDAKAYNKDNLNSDRIPGTERHLINLQYSNTDFWGQDLVAQIYYRDESLTYYPFPTLSKGAVTSIGASQQKTDFYGGKLTLNSKPMDDLTLTWGVDADHETFDANQQFFDLSKAAASRG

SEQ ID NO: 8633 - protein, 237 aa, Enterobacter cloacae
ILRLYLSLEKVEKKSDTIESTVSFQVNAMSSDKPSHRGSPYAQELISHLQPHCTTHKTDPGEQLNLQVNGQSMCYLILDGTVAIYRRSDDMMLSTARSPALFGLANLTDIYFTDYLRTVTPCLIGVLTTDRVAEIIKEKALWGLLSNHLMFVYNRLYHNVMPKGAPTAYEMIRQQLVLLMQEDDSYRRSVTAERYIRDKTQLSRSGVMRILADLKTGGFIEMEEGRLIKINKLPARY

SEQ ID NO: 8634 - protein, 68 aa, Enterobacter cloacae
LLFINIMSPTDNSAATPTKTHTAPSPAPTDRRIDSKSLLGEEGRVIIEHDGQHYLLRQTNAGKLILTK

SEQ ID NO: 8635 - protein, 398 aa, Enterobacter cloacae
RSAAVQRHHHHPRAGERLRQSLLVTAGHPAGWPQRQDLRQLSMVIPFGATIQKDKIMGHYTRWLELKEEHPGKYARDIAGLMHISEAELAFARVGHDAWRLRGEIREILAALESVGETKCICRNEYAVHEQIGAFTNQHLGGHAGLVLNPRALDLRLFLNQWASAFHISETTSRGERQSIQFFDHQGDALLKVYTTDHTDVAAWGDVLTRFIIADNPALALKAVEAPAHSDGADAGSVEKEWRAMTDVHQFFSLLKRHNLSRQQAFRLVSDDLACKVDNSALAQLLETARQDRNEIMIFVGNRGCVQIFTGVVEKLTPMKGWLNIFNPTFTLHLLEETIAETWVTRKPTADGHVTSLELFAADGTQIAQLYGQRTEGEPEQSRWRRQIDALTPEGLAA

SEQ ID NO: 8636 - protein, 227 aa, Enterobacter cloacae
SHQSVRSQMNTRFAPESEIDKSTVLGAKPFKHIEKIIDNVLPHAERGIIARGEIIHYCSGDTRQCFLLLHGSVALHRRGDGIVLNSESAPFILGVSSQLSSEHLYVRALETSEVASVSLARFNHVVAQQNLWEHFSNLLIYTASRVYEHCAQISQMSAYDIIRFQLVELMQEPEAIIQNITAAAYIKSRTYLSRSGIMRILAELRTGKYITMERGVLVEIHHLPRKY

SEQ ID NO: 8637 - protein, 688 aa, Enterobacter cloacae
LNKPDNTFASHPGDPQAASAFQFLWRVAMPHLQSASLRPSLLALAIVSTLPGVTFAAADEITVTATGNARSAFEAPMMVSVIDATAPENQTASSAADLLRKVPGLTLDGTGRTNGQDVNLRGYDRRGVLVLVDGVRQGTDTGHLNSTFLDPALIKRIEVVRGPSALLYGSGALGGVISYDTVDASDLLDAGKNSGYRVFATGATGDHSIGMGASAYGRTDTLDGLVSWSSRDRGDIRQSDGARAPNDESINNMLAKGSWKIDPAQTLSGSLRYYNNDAQEPKNPQTTDASSSNPMTDRSTIQRDAQLGYRIAPAGNNWLNADAKIYWSEARINAQNIDASGEFLKQTTKGGKVENRTRLFSDSFASHLLTYGGEYYRQEQHPGGATTGFPDAKIDFSSGWLQDEITLRDLPVTLLGGTRYDNYRGSSSGYDDVDADKWSSRAGLTVSPADWLMLFGSYAQAFRAPTMGEMYNDSKHFSIGSFYTNYWVPNPNLRPETNETQEFGFGLRFDDLLLANDALEFKASYFDTKAKDYISTTVDFAAATTMSYNVPNAKIWGWDMMATYATSLFNLDVAYNRTRGKDTDTGEYISSINPDTVTSKLDIPVAQSGFSVGWIGTFVERSTHISSSYSEQPGYAVNDFYVSYKGQQQFKGITTTLVLGNAFDKAYWSPQGIPQDGRNGKIFVSYQW

SEQ ID NO: 8638 - protein, 356 aa, Enterobacter cloacae
HGPAGLQRPHAESHTTAACQSGATALMSRRITLSLWLLAGSLTVMTIMATGFGALRLPVNVLWSGSDETLRHIWLTIRLPRVLLALVIGGSLALAGCVMQGLFRNPLADPGLLGISSGAALAVALWVVLPLALPALVMLYAPMLAAFLGALAATGVIFLLSKQHDTSLSRLLLVGIAINALCGAAVGVLSWVSNDAQLRQLSLWGMGSLGQAQWSTLLAVTSLMVPAALAIWRCASTLNLLQLGEEEAHYLGVDVALVQRILLLCSALLVAAAVAVSGVIGFVGLVVPHLMRMWLGADHRATLPGTVLAGALLLLVADTVARTMVAPAEMPVGLLTSILGAPWFLWLIFRRGEQHG

SEQ ID NO: 8639 - protein, 391 aa, Enterobacter cloacae
RDAVYIPISLAGVHLRKVSFMVNLRQPRDVAQILLSVLFLAIMIIACLWIVRPFVLGFAWAATVVVATWPLLLRLQKLLFGRRGLAVLVMTLLLFLLFIIPIALLVNSLVDSSGPVIRAVTSGDMTLPDLAWLNSIPVVGAKLYSGWHSLLEMGGSALMAKVRPYIGTTTTWFVGQAAHIGRFMMHCTLMLVFSALLYWRGEQVALGVRHFATRLAGKRGDAAVLLAAHAVRAVALGVVVTALVQAVLGGIGLAISGVPYATIFTVVMLMTCLAQLGPLLVLVPCIIWLYWTGDTTWGTVLLVWSCVVGTMDNVIRPLLIRMGADLPLILILSGVIGGLIAFGMIGLFIGPVLLAVTWRLFSAWVHEVPPPGTDPDVILSELEELEDKNAQ

SEQ ID NO: 8640 - protein, 352 aa, Enterobacter cloacae
IFNFSDSFPALDNPMIPIDSGKNLRNKAANRKMKSTFQENQKHHFILNSDKFFAVKLTFLIYAFRQLRTLFRVDKMDNAVDRHVFYISDGTAITAEVLGHAVMSQFPVSINSITLPFVENESRAKAVKDQIDAIYQQTGVRPLVFYSIVIPEIRNIILQSEGFCQDIVQALVAPLQSELKLDPTPIAHRTHGLNPGNLTKYDARIAAIDYTLAHDDGISLRNLDQAQVILLGVSRCGKTPTSLYLAMQFGIRAANYPFIADDMDNLVLPAALKPLQHKLFGLTINPERLAAIREERRENSRYASMRQCRMEVSEVEALYRKNQIPWLNSTNYSVEEIATKILDIMGLNRRMY

SEQ ID NO: 8641 - protein, 356 aa, Enterobacter cloacae
SKKFLRHSMNKTDELRTARIDSLVTPAELARLHPVSAEVADHVTASRRRIEKILNGEDKRLLVVIGPCSIHDLDAAMDYAQRLQTLRGTYQDRLEIVMRTYFEKPRTVVGWKGLISDPDLNGSYRVNHGIALARKLLLQVNKLGVPTATEFLDMVTGQFIADLISWGAIGARTTESQIHREMASALSCPVGFKNGTDGNTRIAVDAIRASRASHMFLSPDKNGQMTIYQTSGNPFGHIIMRGGKKPNYHAEDIAAACETLAEFDLPEHLVVDFSHGNCQKQHRRQLDVCEEVCQQIRSGSTAIAGIMAESFIKEGTQKIVAGQQMVYGQSITDPCLSWEDSERLLEMLASAVDSRF

SEQ ID NO: 8642 - protein, 281 aa, Enterobacter cloacae
RPDAGRAGGMKNWFALLCALPLVAVAAPERIVALGGDVTEIVYALGAESSLVARDSTSQWPQATNALPDVGYLRQLNAEGILSVRPTLVLASDQAQPSLALKQVEQSHVRVVTVPGTPDLRAIDEKVRVIAQATHHEAQGETLRSSLRQALAALPSMPLNKRVLFILSHGGMTAMAAGQQTGADAAIRAAGLQNAMQGFTRYQPLSQEGVMASQPDLVVISQEGLNALGGEENLWKLPGLAQTPAGRSKQVLAIDDMALLGFSVRTPKAIQQLRARAEQLP

SEQ ID NO: 8643 - protein, 323 aa, Enterobacter cloacae
CACGWAPITGQPSPARYSRALYCCWWRIRSRAPWSPRQKCRSACSPVSLALPGSYGSFFVVENSMAERYTAENLTFTRSGRTLTDNVSLSLSQGELVTLIGPNGAGKSTLLRLLTGYLKPDSGGCSLAGKALDEWHPQVLSRYRAVMRQQSQPEFDWQVEEIVGMGRAPWTRHPEPSIVREVLQLTGCLPLAGRRYHALSGGEQQRVQLARALAQLWRDGTPRGWLFLDEPTSALDLYHQQHLLRLLKSLTRQGHLHACVVLHDLNLAALWSDRILLLHNGRIVSQGIPETVLQADALARWYGAQVHVGRHPAHAAPQVFLAP

SEQ ID NO: 8644 - protein, 356 aa, Enterobacter cloacae
ASRWRLFLCLKLREYVQQFGVCTDIMRKTMSHLAELVASATAAINQASDVAALDNVRVEYLGKKGHLTLQMTTLRELPAEERPAAGAVINEAKEQVQQALNARKAELESAVLNARLAAETIDVSLPGRRIENGGLHPVTRTIDRIESFFGELGFTVATGPEIEDDYHNFDALNIPGHHPARADHDTFWFDATRLLRTQTSGVQIRTMKEQEPPIRIIAPGRVYRNDYDQTHTPMFHQMEGLIVDKNISFTNLKGTLHDFLNNFFEEDLQVRFRPSYFPFTEPSAEVDVMGKNGKWLEVLGCGMVHPNVLRNVGIDPEVYSGFAFGMGMERLTMLRYGVTDLRAFFENDLRFLKQFK

SEQ ID NO: 8645 - protein, 357 aa, Enterobacter cloacae
LKRPLTRPFFFALFAKPAVKSMISQPDNLSFMLDLARLQHRSDLRRLCLLGVLLIVSTTVSLCAGDRWLGPESWFTPEGQLFVWQIRLPRTLAVLLVGAALALCGTIMQALFENPLAEPGLLGVSNGAGVGLIAAVMLGGGELSGWGISLSAILGALLITLILLRFARRHLSTSRLLLAGVALGIICSALMTWAVYFSTSFDLRQLMYWMMGGFGGVDWRQGWLMVLLIPVILWMVFQAQPLNILALGETSARQLGMPIGFWRNVLVIAIGWMVGVSVALAGAIGFIGLVIPHMLRLCGITDHRTLLPASAVAGAATLLVADIIARLALTAAELPIGVVTATLGAPVFIWLLLKAGR

SEQ ID NO: 8646 - protein, 186 aa, Enterobacter cloacae
GNAMQSDILNTEVTTIDGEKTTLVGYKGKVLLIVNVASKCGLTPQYEQLENIHKAWEKDGFTVLGFPCNQFLGQEPGSEEEIKTFCSTTYGVTFPMFSKIDVNGENRHPLYAKLVAAAPTAVAPEESGFYERMASKGRAPLYPDDILWNFEKFLIGRDGQVVQRFSPDMTPEDPIVMESIKLALAK

SEQ ID NO: 8647 - protein, 810 aa, Enterobacter cloacae
IRSQVFLTPIKYHKRIVSMSNNGSSPLVLWYNQLGMNDVDRVGGKNASLGEMITNLSGMGVSVPNGFATTADAFNLFLDQSGVNQRIYDLLDKTDIDDVTELAKAGAQIRQWIIDTPFQPELEKAIHDAYNQLSADDAQASFAVRSSATAEDMPDASFAGQQETFLNVQGYEAVLVAVKHVFASLFNDRAISYRVHQGYDHRGVALSAGVQRMVRSDVGSSGVMFSIDTESGFDQVVFITSAWGLGEMVVQGAVNPDEFYVHKPTLAANRPAVVRRTMGSKKIRMIYAPTQEHGKQVTIEDVPQEQRDRFSLTDAEVEELAKQAVQIEKHYGRPMDIEWAKDGHTGKLFIVQARPETVRSRGQVMERYTLHAQGKIVAEGRAIGHRIGAGPVKVIHDISEMNRIQPGDVLVTDMTDPDWEPIMKKAAAIVTNRGGRTCHAAIIARELGIPAVVGCGDATERMKDDQNVTVSCAEGDTGYVYADILDFSVKSSSVDTMPDLPLKIMMNVGNPDRAFDFACLPNEGVGLARLEFIINRMIGVHPRALLEFDDQDAKLQNEIREMMKGYDSPREFYVGRLTEGIATLGAAFYPKRVIVRLSDFKSNEYANLVGGERYEPEEENPMLGFRGAGRYVSESFRDCFALECEAVKRVRNDMGLTNVEIMIPFVRTVDQAKAVVDELARQGLKRGENGLKIIMMCEIPSNALLAEQFLEHFDGFSIGSNDMTQLALGLDRDSGVVSELFDERNEAVKALLSMAIRAAKKQGKYVGICGQGPSDHEDFAAWLMDEGIDSLSLNPDTVVQTWLSLAELNK

SEQ ID NO: 8648 - protein, 494 aa, Enterobacter cloacae
YLSLTAYIRRDDARLVEIRFNLIKRQITMTISSVLRTKDKIGYGLGDMASALVWQTATLFLAYFYTDVFGLPAAIMGTMFLVVRVVDAFVDPCIGALVDRTQTRHGRFRPWLLWFAIPFGVSCLITFYVPDAGQTAKIVYACVTYAILSLIYSAINVPYCAMPGALTLDPRERHSLQSWRFGLSFIGGLIVTVIALPLVSLLGQGNVQKGYFYAMSLMGLLGIVLFFCCFFMTRERYSPRNDTSGSMLTDLKLLAANSQWRIVFLFNILLLTAVVTRGSATMYYVNYVLLRPELVFAFIVSGMVASLSGALLSERLLGKFDRVRAYQWTIISFVIFGALIFFIPPSQVWLIFGLNIVFSFIQNLTTPLQWTMFSDVVDYEEHRSGRRLDGLVFSTALFAIKFGLALGGAVVGWVLGMVDYAPGQANQAPHVLATINALFTLIPCVLFLCMVALLAIYKLNSRLVDSIARELASKRDSRNDAGQLSPATQSALQE

SEQ ID NO: 8649 - protein, 792 aa, Enterobacter cloacae
TMTAIYKDAGRPVHERVADLLARMTPEEKFAQMHAYWLILDEHGNHRERSDLSDEFAGVSEQASLNERLKLGVGQITRPLGTHIVNAKTGVCAANRLQRMMMEETRLGIPALFHEECLVGLLCKDATLFPSSLNYGSTWDPALVQRAAEQIGKEARSVGCQQGLAPVLDVSRDVRWGRTEETFGEDPWLVGVMATAYVKGLQGDKRDLLATLKHYVGHSFSEGARNHAPVHLGFSELNDTFLLPFEMAVKLANAGSVMPAYHDIDNQPGHSDHFLLTTVLREQWGFDGIIVADYGGVSLLHQHHGISHDPAESAALAFNAGLDVELPKDDCARHLAEAVERGLISMAKVDEIVARVLSEKFRLGLFEKPYAAEDGIDLQNEATRQVAREVATKSITLLENNGILPLGGKPRVAVVGPTADDPLALLSGYSFPVHLIISDMVEETSQVTTPRAALEQYLGASQVRYAKGCHIIEKRMAGAPVFPGDSGGKPMQQSPVSQRMDLIPDAVSAAKESDVVIACVGDLAGLFQSGTVGEGSDTDSLNLPGVQQQLLEALVATGKPVIVVMTGGRPYNLQGLEEKVAALMMVWAPGQEGGWAIADVLTGRAEPQGRLVVSVPKNAGAMPYYYNHKLKSGGTPFAFHFGALYPFGYGLGWTQFRWGAARLAESRVPIDGEVALSVDITNTGERSGSEVVQVYVRDKVATQVRPLQELKAFQRVTLSPGETATLTFTLPVEMFNFTRRDGKRIVEPGEFELQVGASSADIRAVVNVQVSGKTRVLAGDWRMLSRCDITLA

SEQ ID NO: 8650 - protein, 759 aa, Enterobacter cloacae
PVSGAFTGVVVGEVVECGQHPNADKLRVTKVNVGGDRLLDIVCGAPNCRQGLKVAVATVGAVLPGDFKIKAAKLRGEPSEGMLCSFSELGISDDHSGIIELPQDAPVGTDIREYLKLDDNTIEISVTPNRADCLGIIGVARDVAVLNQTELNVPEIAPVEATISDVLPIQVDAPEACPRYLGRVVKGINVKAPTPLWMKEKLRRCGIRSIDAVVDVTNYVLLELGQPMHAFDKDRIEGGIVVRMAKEGETLVLLDGSEAKLNADTLVIADHNKALAMGGIFGGEHSGVNDETQNVLLECAFFSPLSITGRARRHGLHTDASHRYERGVDPALQYKAMERATRLLIDICGGEAGPVIDVTNEATLPKRATITLRRSKLDRLIGHHVADAQVTDILTRLGCEVTEGQDEWKAVAPSWRFDMEIEEDLVEEVARVYGYNNIPDEPVQAGLVMGSHREADLSLKRVKTMLNDKGYQEVITYSFVDPKLQQLIHPGQEALILPSPISSEMSAMRLSLWTGLLGTIVYNQNRQQNRVRIFESGLRFVPDTQANLGIRQDLMLAGAISGNRYEEHWDLAKGTVDFYDMKGDLEAILDLTGKLSEIEFRAEAIPALHPGQSAAIYLDGKRVGFIGVVHPELERKLDLNGRTIVFELEWNPVADRVIPQAQDVSRFPANRRDIAVVVAENVPAADILAECKKVGVNQVVGVNLFDVYRGKGVAEGFKSLAISLILQDTSRTLEEEEIAATVAKCVEALKERFQASLRD

SEQ ID NO: 8651 - protein, 242 aa, Enterobacter cloacae
CRTSAMIITLDNAYQSELLLLPARDSAGLLKGLEILVNFTGVGADVRIPTELVIPHLSQEDELALFQEKLQLLDTCKLFFIQHQLIAWINITPAIVEFLLTNENAVSILERYPFLEFTVNENYPGLNNGKDDPCLARMAIHFPLVLANFGAGAASLKPVYDGLFKRVVLDKNFIQQRVSALSFEPFMRAILWQIAPHCQSVMVSGIDDHGILQRVLTFNFGAMQGSLWPAVPAERVTTLVQQ

SEQ ID NO: 8652 - protein, 150 aa, Enterobacter cloacae
RRPPSIAGFTGDYRMIWKRAVTLEALNAMGAENMVGLLDIQFTRIGDNELEATMPVDCRTHQPFGLLHGGASVVLAETLGSVAGYLCTEGEQKVVGLEVNANHIRSVRSGRVRGVCRALHAGSRHQVWQIDILDEQDRLCCSSRLTTAVV

SEQ ID NO: 8653 - protein, 103 aa, Enterobacter cloacae
GIEPMALTKAEMSEYLFDKLGLSKRDAKELVELFFEEIRRALENGEQVKLSGFGNFDLRDKNQRPGRNPKTGEDIPITARRVVTFRPGQKLKSRVENATPKAE

SEQ ID NO: 8654 - protein, 270 aa, Enterobacter cloacae
HDAGRSYRDGINQAGAGEIMTLLMQLTDVAGKGRLEPVTAAVNAGEILHLVGPNGAGKSTLLARMAGLTTGEGEITFLGQSLVDWLPATLASRRGYLVQQQVPPFAMPVWHYLTLHLSDKNQVGLLNEVAAALGLDDKLTRQANQLSGGEWQRVRLAAVILQIHPAGNPHGRMLLLDEPMSGLDVAQQAALDTLLSALCRKGIAIVMSSHDLNHTLRHAHRVWLLARGKLIASGTRDNVLTAANLASAYHMSFRRLDIEGHKMLISTAQE

SEQ ID NO: 8655 - protein, 167 aa, Enterobacter cloacae
ITERTKKAEDSSEMRFWFLLVAALFLAGCSSHHAPPPNPRLSDSITVIASLNDQLSNWRGTPYRYGGMSRGGVDCSGFVLMTFRDKFDLQLPRETRMQAKIGTEIDKDELLPGDLVFFKTGSGESGLHVGIYDTDNQFIHASTSRGVMRSSLDNVYWRKNFWQARRI

SEQ ID NO: 8656 - protein, 527 aa, Enterobacter cloacae
HSILVQCREACGLPSRQSGSRLSYSNNPFLRPCLRPGKPSTLKAGGLMTLSFTAHWHDELPGFYTALKPTPLQNARLIWHNDALADSLGIPSTLFQPEKGAGVWGGETLLPGMKPLAQVYSGHQFGVWAGQLGDGRGILLGEQVLPNGETLDWHLKGAGLTPYSRMGDGRAVLRSTIREGLASEAMHALGIPTSRALSIVTSDTPVARETMEQGAMLVRVAESHLRFGHFEHFYYRREPDKVRQLADYALRRHWPHLQNEPDRYVLWFRDIAARTAAMIARWQAVGFAHGVMNTDNMSLLGLTFDYGPYGFLDDYQPGYICNHSDYQGRYRFDNQPAVGLWNLQRLAQSLSPFIDVDALNDALDSYQEVLLREYGVLMRTRLGLMTQQKGDNALLNGLFAIMAREGSDYTRTFRMLSQTAQQSAASPLRDEFVDRQAFDDWFAAYRARLQQEQIDDDTRQARMKAVNPAMVLRNWLAQRAIEQAEQGDYTELHRLHIALRTPFADREDDYVSRPPDWGKRLEVSCSS

SEQ ID NO: 8657 - protein, 1042 aa, Enterobacter cloacae
EKNVIKLSRHNANDFTLFSLGSTAMIPQISQAPGVVQLVLNFLQALEQQGFTGDTATDYADRLTMATDNSIYQLLPDAVVFPRSTADVALIARLASQERFSSLVFTPRGGGTGTNGQALNQGIIIDMSRYMNRIIEINPEEGWVRVEAGVIKDQLNQFLKPYGYFFAPELSTSNRATIGGMINTDASGQGSLVYGKTSDHVMGVRAVLLGGDILDTQPMPIELAETLAAESTTSGRIYRTVLERCRENRELILDKFPKLNRFLTGYDLRHVFNDDMSQFDLTRVLTGSEGTLAFITEARLDITRLPKVRRLVNVKYNSFDSALRNAPFMVEARALSVETVDSKVLNLAREDIVWHSVSELITDVPDKEMLGLNIVEFAGDDAELIESQVNTLCQRLDELIAQGEGGVIGWQLCNDLSGIERIYAMRKKAVGLLGNAKGAAKPIPFAEDTCVPPEHLADYIVEFRALLDSHGLSYGMFGHVDAGVLHVRPALDMCDPQQEILMKAISDEVVALTAKYGGLLWGEHGKGFRAEYSPAFFGEQLYAELRKVKAAFDPDNRLNPGKICPPEGVDAPMLQVDAVKRGTYDRQIPIAIRASWRGAMECNGNGLCFNFDVKSPMCPSMKITSNRIHSPKGRATLVREWLRLLADRGVDPLKLEQELPEKRASLRGLIERTRNSWHANKGEYDFSHEVKEAMSGCLACKACSTQCPIKIDVPEFRSRFLQLYHTRYLRPMRDHLVATVESYAPLMARAPKTFNFFINQPLVRKLSEKHIGMVDLPLLSVPSLQRRLVGHRSANMTLEQLEALSPEQKAKVVLVVQDPFTSYYDAQVVADFVRLAEKIGYQPVVLPFSPNGKAQHIKGFLTRFAKTAQKTSDFLNRVAQLGMPMVGVDPALVLCYRDEYKQTLGDKRGDFQVLLVHEWLPAVLTQTPPQEVSGESWYLFGHCTEVTALPTAPAQWASIFSRFGAKLESVNVGCCGMAGTYGHEVKNHANSLGIYELSWHQAMQRLPRNRCLATGYSCRSQVKRVEGNGVRHPLQALLEIIG

SEQ ID NO: 8658 - protein, 76 aa, Enterobacter cloacae
YTGHVLNISEDIMDTEITPIQLAIEYLRRDKSNLSPAQYLKKLKQLELEFTDLLALSSNELKEEIYFAWRLGVHVH

SEQ ID NO: 8659 - protein, 182 aa, Enterobacter cloacae
SNTGYKIMNKKLMMAMLAAGSVLTMTNALAAAGTVNFNGNILDSACDVDVASQNQVVVLGDYYKTEFPTTGARTAATQFNIILKNCPVTVTNAKVRFDGTPDLTNASLLAIDTSVAGAATGVAINLMTADKADLPLHGSNSYTYALSSTADNTLSFYAQYISTAASVTAGPANSVANFSVVY

SEQ ID NO: 8660 - protein, 627 aa, Enterobacter cloacae
SFIGMGILQGMHQNSAIPAIRSRQEPGNSMLKRCLSPLTLVNQLALIVLLSTAIGVTGMAISGWLVQGVQGNAHAINEAGSLRMQSYRLLASVPLTQADQPLIDEMERTAFSPELERAAIRDGQQSQLKALQGYWHTQLEPGLKRAEDRETVAQDVAGFVSRIDHLVSSFDRTTELRIDRVVMVHRAMALFMGLLLIFTVIWLRARLLNPWKQLLAMARAVTQRDFTQRTHISGRNEMAMLGEALNTMSAELSESYAVLEQRVQEKTAGLEQKNEILSFLWQANRRLHMQVPLCERLSPVLNGLQNLTLLRDLELRVYDVEDEENHQEFTCQSDISCDDKGCHLCPRGLPPLTTSGTTLKWRLMDSHTQYGILLATLPAGRHLSHDQQQLVDTLVEQLTATLALDRHQEKQQQLIVMEERATIARELHDSIAQSLSCMKMQVSCLQMQDEGMPESSKQLLSQIRNELNTSWVQLRELLTTFRLQLTEPGLRPALESSCQEFSARLGFPVKLDYQLPPRFVPSHQAIHLLQIAREALSNVLKHAEATAVTVTVSCQDNQVKLRVQDNGRGVPENAERTNHYGLIIMRDRAQSLRGDCQVRRGESGGTEVVVTFIPEKPLITAQGENHD

SEQ ID NO: 8661 - protein, 225 aa, Enterobacter cloacae
RCNAARFSSTRALLALHSGAYNLPCEQSQTFDAPRSHCSICTSRLMPFTSAPSCASLPSCSSRNILARWNHSVAPGELPATIVIVSLPDTYSSVREAIFVPFQRTGVNMQKIVIVANGAAYGSESLFNSLRLAIALRDKESELELRLFLMSDAVTAGLKGQKPAEGYNIQQMLEILTAQNVPVKLCKTCTDGRGITGLPLIDGVEIGTLVELAEWTLSADKVLTF

SEQ ID NO: 8662 - protein, 376 aa, Enterobacter cloacae
LQAPALLEKHMTATHEAVKTRHKETSLIFPVLALAVLLFWGSSQSLPVVVGINILALVGILTSAFSVVRHADVLAHRLGEPYGSLILSLSVVILEVSLISALMATGDAAPTLMRDTLYSIIMIVTGGLVGFSLLLGGRKFATQYMNLFGIKQYLIALFPLAIIVLVFPMALPGANFTTGQALLVALISAAMYGVFLLIQTKTHQSLFVYEHEDDGDDDDPHHGKPSAHSSAWHTVWLIVHLIAVIAVTKMNANPLEALLTELNAPVAFTGFLVALLILSPEGLGALKAVLNNQVQRAMNLFFGSVLATISLTVPVVTLIAFMTGNELQFALGAPEMIVMVASLLLCQISFSTGRTNVLNGAAHMALFIAYLMTIFA

SEQ ID NO: 8663 - protein, 289 aa, Enterobacter cloacae
MMTHWPFPAKLNLFLYITGQRADGYHTLQTLFQFVDYGDTISIEPRQDGQIHLLTPVDGVAHEDNLIVRAARLLMKTASSSGRLPAGSGADIRIDKRLPMGGGLGGGSSNAATVLVALNHLWDCGLTTDELAALGLTLGADVPVFVRGHAAFAEGVGEILTPVDPPEKWYLIVHPGVSIPTPVIFKDPDLKRNTPVRSIKTLLNCEFSNDCEDIARKRFREVDAVLSWLLEYAPSRLTGTGACVFAEFDTETAARQVLEQAPVWLHGFVARGMNISPLQQTILAQTEFR

SEQ ID NO: 8664 - protein, 561 aa, Enterobacter cloacae
IIVKKVTSSHVLPFRALIDACWKEKYTSSRFVRDLIAGITVGIIAIPLAMALAIGSGVAPQYGLYTSAVAGIVIALTGGSRFSVSGPTAAFVVILYPVSQQFGLAGLLVATLMSGIFLILFGLARFGRLIEYIPLSVTLGFTSGIGITIGTMQIKDFLGLQMAHVPEHYLQKVGALFMALPTANLGDAAIGIVTLGTLIVWPRLGIRLPGHLPALLLGCAVMGVVNLLGGQVATIGSQFHYVLADGSQGSGIPQLLPQLVLPWDMPGSSFTLSWDSLRALLPAAFSMAMLGAIESLLCAVVLDGMTGTKHKANSELVGQGLGNIVVPFFGGITATAAIARSAANVRAGATSPVSAVIHSLLVIMALLILAPLLSWLPLSAMAALLLMVAWNMSEAHKVVNLLRRAPKDDIIVMLICMSLTVLFDMVIAISVGIVLASLLFMRRIAQMTRLSPVNVEVPDDVLVLRVIGPLFFAAAEGLFSDLEYRIAGKRIVVLKWDAVPVLDAGGLDAFQRFVARLPEGCELRISNLEFQPLRTMARAGVQPIPGRLSFYPNREAALADL

SEQ ID NO: 8665 - protein, 222 aa, Enterobacter cloacae
LLKEKTMTNQEPASILLIDDHPMLRTGVKQLVSMAPDITVVGEASNGEQGIELAESLDPDLILLDLNMPGMNGLETLDKLREKSLSGRVVVFSVSNHEEDVVTALKRGADGYLLKDMEPEDLLKALQQAAAGEMVLSEALTPVLAASLRANRATSDRDVSQLTPRERDILKLIAQGLPNKMIARRLDITESTVKVHVKHMLKKMKLKSRVEAAVWVHQERIF

SEQ ID NO: 8666 - protein, 81 aa, Enterobacter cloacae
STSPVWPRPAQAETRAGGRYGVQNWSPCRFSRPSPGRENGYGQTGWCPSPASPQIPRPAGRPPEPGTPRGCREATRQGWCP

SEQ ID NO: 8667 - protein, 632 aa, Enterobacter cloacae
LFNNNPLKILFSYGRGFSIKFTCTVADRHGNNTAGITLMFRSIRARIIAATTGCLVVALLLNTIINFQVTRQDNQQSQRDILTSTSASHNMAIADWVNSKITVITSAQSVALSDDPVPVFKQLALAGGFTNVYVGYASKTAKFSDPTGVPADYDPTLRPWYQQVVSADGPVVTAPYVDAGTGKLVVTFAVPVKEQGALKAVVAGDVAMDSVVANVRGIHPTPASSGLLLDSNGTVIAGSDPALTLKPFTETIKGTDFATLKSGNLVDGTSNGREKTFLATAVPGTHWLLVVALDNGDATAGMRSLLKASALSLAILALLSGALMHLLIARLLKRLFGIRDAMNNIANGTNDLSQRLPDKGGDEVAQIAQAFNAFSDKLSVVMVQLRDASASVKNAAHEIAAGNQDLSGRTEQAASSLRETASAVEEITASVTQSNESAAEANEQASKASAAASRGGDVVAQAISTMQSIELASAKIGDITSVIDGIAFQTNILALNASVEAARAGEQGRGFAVVAGEVRNLASRSAQAAKEIKSLIDSTTESVATGSRFVHLAGDSMDEIRASVGSVSGIMREISIATREQMKGIHEINHAVTHLDRMVQQNAELVVQSAAAASALQSQAGDLAETAGHFRI

SEQ ID NO: 8668 - protein, 173 aa, Enterobacter cloacae
TVAPFNASINSYNCNVSQGFVIIMTRMIRLLPLAALVLTACSVHQPKGPGKSPDSPQWRQHQQDVLKLSQYQTRGAFAYLSDEQKVYARFFWQQTGQDNYRLLLLNPLGSTELELNAKPGEAQITDNKGQHYTATDAEEMIGKLNGMPIPLNSLHQWILGLPGDATDYTLDDQ

SEQ ID NO: 8669 - protein, 195 aa, Enterobacter cloacae
IVTIKLIVGLANPGAEYAATRHNAGAWYVDLLAERLRAPLREEPKFYGYTSRINLAGADVRLLVPTTFMNLSGKAVAAMATFYRINPDEILVAHDELDLPPGVAKFKLGGGHGGHNGLKDIISKLGNNPNFHRLRVGIGHPGDKNKVVGFVLGKPPVSEQKLIDEAVDEAARCTEIWLQDGLTKATNRLHAFKAQ

SEQ ID NO: 8670 - protein, 368 aa, Enterobacter cloacae
GDLEMGFKCGIVGLPNVGKSTLFNALTKAGIEAANFPFCTIEPNTGVVPMPDPRLDQLAEIVKPQRILPTTMEFVDIAGLVKGASKGEGLGNQFLTNIRETEAIGHVVRCFENDNIIHVNNKVDPADDIDVINTELALSDLDTCERAIHRVQKKAKGGDKDAKAELAALEKCLPQLENAGMLRALKNLTDEDKAAIKYLSFLTLKPTMYIANVNEDGFENNPYLDKVREIAAAEGSVVVAVCAAVESDIAELDDADREEFMAELGLEEPGLNRVIRAGYELLNLQTYFTAGVKEVRAWTIPVGATAPQAAGKIHTDFEKGFIRAQTIAFEDFITYKGEQGAKEAGKMRAEGKDYIVKDGDVMNFLFNV

SEQ ID NO: 8671 - protein, 338 aa, Enterobacter cloacae
RLLRPRSLRRTLSTTGRMPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVNNLRNSVIDEVVVCDTIPLSDEIKALPNVRTLTLSGMLAEAIRRISNEESISAMFEH

SEQ ID NO: 8672 - protein, 92 aa, Enterobacter cloacae
HMKRKNASMLGNVLMGLGLFVMVAGVGYSILNQLPQLDLPQYFAHGAVLSIFLGAVLWLAGARVSGHEEVCDKYWWVRHYDKRCRRDQRKHS

SEQ ID NO: 8673 - protein, 371 aa, Enterobacter cloacae
PSRNVRLQSNDTGRTKGAVMLIQVGELAKRAGITVRTLHHYEQTGLLLPSARSAAGYRLYNLADVQRLHMIQTLAKAGLELAEIRDFLKQRSLSLAELLDGQITLLDKQLRSIHTLRNRLVELRTGLTDDATPDLESWLQTLELMNMYDRWFSKEELQQLPFAVEKEALADIWSGLVREVKHLLEQNVSVTDARATDLASRWMERLEQDTAGKPEFLTRLNEMHSVEPQMQEQTGITPEITDYITRAFAESKLSIWEKYLTAEEMAFTRAHYFDRMMEWPPLVAKLHQAQRDNLSPASDDAQKLAEKWLVLFQSYAGTNPQTQQKFRLAMQQEPHLMKGTWMTPAVLEWLQQAIGVMMQRRVSASDDSQIR

SEQ ID NO: 8674 - protein, 295 aa, Enterobacter cloacae
AYRAGIPGRPAGGTVRAGLMDFQRWLRHAASELSASESPKRDAEILLEHVTGKARTYLLAFGETALTAEQQSQLETLLARRKTGEPVAHLVGEREFWSLPLYVSAATLIPRPDTECLVEQALARLPAQPCQILDLGTGTGAIALALASERPDCTVTAVDVMPDAVALARRNVERLGLNNVSVLQSSWFAALESRMFEMIVSNPPYIDEDDPHLAQGDVRFEPLTALVAANQGLADLDHIVTTSRQHLLPGGWLLVEHGWTQGEAVRALFTHAGYAAVETCRDYGGNERLTLGQRS

SEQ ID NO: 8675 - protein, 280 aa, Enterobacter cloacae
HFRRLTCRCIASGPRIAYRCSTAVKMNSTECQEGELQMSQGSMQWRRWNVLTRDFLMKADCKTAFGAIEESLLWSAEQRAASLAATLACRPDDGPVWIFGYGSLMWNPALEFVESATGTLPGWHRAFCLRLTAGRGSACQPGRMLALKEGGRTTGVAYRLPDTTLEDELTLLWKREMITGCYMPSWCKLELDDGRTVNALVFIMDPRHPLYEADTRTQVIAPLIAAASGPLGTNAQYLFSLDQELTRLGMQDDCLSELVVKVKALLEGNPLSNTLRPGFA

SEQ ID NO: 8676 - protein, 454 aa, Enterobacter cloacae
QINHFRRCANGGACVFRIKASSGASAPSGAFFCLFSGAIMADLSRRRLLQASMLASGAMLLPGVMQAAWAAGSDKPEQDTVRIGFIPLTDCAPVVIAALKGFDKKHGITIVPTKEASWAAVRDKLVAGELDAAHILYGLLYGLELGIAGKPQQMANLMTLNQNGQAITLSSDLAEKGVRHLDGLKKLIAQQAPGTYTFAHTFPTGTHAMWLYYWLASAGINPFDDVRTVVVPPPQMVMNMRIGNMVGFCVGEPWNARAINDRIGFTAATSQSIWADHPEKILGTRRDWVAKNPHTARALVSAVMEAARWIEASAENKRETAQILSRRAWLNCKEQYLTGRMLGEYDNGVGQRWQDAHPIRFFNEGAVSYPYLSDGMWFLTQFRRWGLLNAAPDYAGIAQRINQTAVWQDAATAVGGMSTPSSPYRSSTLMDGTVWNGTDPEGYANRFAIHRKGA

SEQ ID NO: 8677 - protein, 479 aa, Enterobacter cloacae
SPNVCSIIRESEVSMSHSSAPERETGAVITDWRPEDPAFWQQRGHRVASRNLWISVPCLLLAFCVWMLFSAVAVNLPKVGFTFTTDQLFMLTALPSLSGALLRVPYAFMVPVFGGRRWTAFSTGIMIIPCVWLGFAVQDTSTPFSVFVIISLLCGFAGANFASSMANISFFFPKAKQGGALGINGGLGNMGVSVMQLIAPLAISVSIFAAFGGGGVTQPDGSVLFLQNASWIWVPFLVVFTLAACFFMNDLSASKASLSEQLPVLKRGHLWVMALLYLATFGSFIGFSAGFAMLSKTQFPDVQILQFAFFGPFIGALARSLGGMISDRLGGTRVTLVNFVVMAIFCALLFLTLPAGGEGGNFFAFFGVFMVLFLTAGLGSASTFQMISVIFRKLTMDRVKAQGGSDEQAMREAATDTAAALGFISAIGAIGGFFIPKAFGISLDLTGSPAGAMKVFLVFYIACVVITWLVYGRNTKKNK

SEQ ID NO: 8678 - protein, 387 aa, Enterobacter cloacae
TPDNSAQQPRAGIAPYTHFLRQGAFTPMKPSIVAKLEALHERHEEVQALLGDAGTIADQERFRALSREYAQLSDVSKCFTDWRQVQEDIETAQMMLDDPEMREMAQEELQDAKARSEEMEQQLQVLLLPKDPDDERNAFVEVRAGTGGDEAALFAGDLFRMYSRYAESRRWRVEIMSANEGEHGGYKEVIAKISGDGVYGRLKFESGGHRVQRVPATESQGRIHTSACTVAVMPELPEAELPDINPADLRIDTFRSSGAGGQHVYTTDSAIRITHLPTGIVVECQDERSQHKNKAKALSVLGARIHAAEMAKRQQAEASTRRNLLGSGDRSDRNRTYNFPQGRVTDHRINLTLYRLDEAMEGKLDMLIEPIVQEYQADQLAALSEQD

SEQ ID NO: 8679 - protein, 82 aa, Enterobacter cloacae
PKERLTMPYKSKSELPDNVQNVLPAHAQDIYKEAFNSAWDQYKDKKDRRDDASREETAHKVAWAAVKNDYEKGDDDKWHKKK

SEQ ID NO: 8680 - protein, 408 aa, Enterobacter cloacae
KGTNIASRTEEYVSGRETMTIVAGSSPGATEWFQRARMLREEQLGRLAQLGALVNGISRLVHMLQCERGASNVWLCSQGKLYAPECKASRALVDENLAALHLQFNEPLPGSALCERIASALHGLETLTALRDGVTGQCVTAPQAMEHYSRILRHLLSIVPQLSDSIDDPHIAGRFVALYSLMQGKELVGQERALGAIGFTQGFFDDETRQRLVDRIDGQQACFEVFISHCTPDVQESFTLNCLPGLETEKLRREACTRQPPADNGDTALKWFALQTARLEHLRTLEEVAIADLMTAVEERRYSENLHADDEHDDILARFPDKPLLPLVRQQAREIEQLSRQLASLRDTLEERKTIDKAKSVLMTHQNMSEEQAWTALRKMAMDKNQRMVDIARALLTVKNLWKIPPGE

SEQ ID NO: 8681 - protein, 834 aa, Enterobacter cloacae
RAGDACGGLMTETRTTCPYCGVGCGVVASADGEKVSIRGDETHPANFGRLCVKGSALGETTGLQGRLLRPVVDGREVAWPQALGEAGERLRNIINEWGPQAVAFYASGQLLTEDYYAANKLMKGFIGAANIDTNSRLCMSSAVVGYKRAFGEDVVPCSYEDVENSDLVVLVGSNAAWTHPVLYQRLVQAKHNNPQMKVVVIDPRKTATCDIADLHLALRPGSDAGLFVGLLNLIQGRGEWPIPRVAAFCDLPSDEISTFYDWFITAPRAITLYTMGINQSSTGSDKCNAIINVHLASGKFNRPGCGPFSLTGQPNAMGGREVGGLANQLAAHMNFEPDDLSRVARFWGTERLAQTPGLMAVELFDAIARGEVKAVWIMGTNPAVSLPDSHAVCQALAACPLVVVSEVMQETDTSRFAHIRFPALGWGEKNGTVTNSERRISRQRAFLPAPGEARPDWWIIARMADQLGYGDAFAWKHPQEIFCEHAALTAFENNGERALNLRELASLSREAWDALAPYQWHAGDFPQRNLVPVDPSSHGAGVDELYPLILNTGRIRDQWHTMTRTGYVPRLMQHIDEPFVEMNATDAARAGLTDGQLARVSSPRGVMVARVRISTAQRAGELFTPMHWNAQFARQGKVNALVEGRVDAGSGQPESKQTAVKILPWLPAWQGELYARDLPALPPSVCWWRKASRLTVAGEQPLLSWVMAYASGRGWQLQVAQTGERNSVLAWHHGELMLGYWEGHTLPALAHAFIEEAFAAAPVQLAERHALLHGQRPGEDADHGRIICSCFSVGENTIRKAIAGGCDSAVALGVKLRCGTNCGSCVPELKALLG

SEQ ID NO: 8682 - protein, 472 aa, Enterobacter cloacae
LTTLKAVSSRIRFLLLLPLFTAGAVHGAPKSFVQQAQNPFDNNGDSLPDLGMAQPTTEGEKHLAEMAKAFGEASMTDNGLTAGQQARQFAFGKVRDAVSGEVNEQIESWLSPWGNASVNVLVDDDGNFNGSSGSWFIPWNDNTRYLSWSQLGLTQQTDGLVSNVGIGQRWVAGNWLLGYNTFYDNLLEDNLQRAGLGAEAWGENLRLSANYYQPFAGWQPRSDIREQRMARGYDVTAKAWLPWFHHLNTSVSFEQYFGDNVDLFNSGTGYHNPVAVNLGLNYTPVPLVTLTAAHKQGESGVSQNNLGLKLNYRFGVPLAKQLSAGEVAATRSLRGSRYDSPDRDNLPVMEFRQRKTLSVYLATPPWDLKPGETVMLKLQIRSTHGIRQIHWLGDTQALSLTSPANGNSSDGWSVIMPAWDDSEGAKNTWRLTAVVEDKDGQRVSSNEITLSVVQPLVAMPADDPRWKLLPDE

SEQ ID NO: 8683 - protein, 433 aa, Enterobacter cloacae
CVLLTLLTLVLLPLNMTLLALGINHKTAPVSLRERVTFSPDTLDLALDSLLAQPMVQGGVVLSTCNRTELYLSVEEQDNLHEALIRWLCDYHNLNEEELRNSLYWHQDNDAVSHLMRVASGLDSLVLGEPQILGQVKKAFADSQKGHLKASELERMFQKSFSVAKRVRTETDIGASAVSVAFAACTLARQIFESLSTVTVLLVGAGETIELVARHLREHKVKKMIIANRTRERAQVLADEVGAEVIALSDIDERLKEADIIISSTASPLPIIGKGMVERALKSRRNQPMLLVDIAVPRDVEPEVGKLANAYLYSVDDLQSIISHNLAQRKAAAVQAETIVEQETSEFMAWLRAQSVSETIREYRGQAEQVRDDLTAKALAALEQGGDAQAIMQDLAWKLTNRLIHAPTKSLQQAARDGDDERLTILRNSLGLE

SEQ ID NO: 8684 - protein, 138 aa, Enterobacter cloacae
TSDAGAAVMSLFTLLISVHLVSVALTIGFFIARYWWRYNNNPLINARWVRIAPHCIDTVLFLSGAGLMWKTGYLPFTDKGAWLTEKLFGVIIYIVLGFIALGRHRPRSQQTGFIAFLLGLVVLYIIIKLATTRIPLLG

SEQ ID NO: 8685 - protein, 270 aa, Enterobacter cloacae
VMRSLADFEFNKVPLCDGMILISEMIRDDFTSQYVYAELENLVSLAREEINQARPQDWQLEKLIELFYGEWGFCDTRGVYRLSDALWLDQVLKNRQGSAVALGAILLWVAHELEIPLVPVIFPTQMILRAEWLDGEMWLINPFNGDTLDEHTLDVWLKGNISPIAELFNEDLDEADNAEVIRKLLDTLKSALMEERQMELALRASEVLLQFNPEDPYEIRDRGLIYAQLDCEHVALNDLNYFVEQCPEDPISEMIRAQINAIAHKHITLH

SEQ ID NO: 8686 - protein, 287 aa, Enterobacter cloacae
GDPMKQKVVSIGDINVANDLPFVLFGGMNVLESRDLAMRICEHYVTVTQKLGIPYVFKASFDKANRSSIHSYRGPGLEEGMKIFQELKQTFGVKVITDVHEASQAQPVADVVDVIQLPAFLARQTDLVEAMAKTGAVINVKKPQFVSPGQMGNIVDKFIEGGNDQVILCDRGSNFGYDNLVVDMLGFSVMKNVSNQSPVIFDVTHSLQCRDPFGAASGGRRAQVTELARAGMATGLAGLFIEAHPDPANAKCDGPSALPLDKLEPFLKQIKAIDDLVKSFDELDTSN

SEQ ID NO: 8687 - protein, 296 aa, Enterobacter cloacae
RGLSMQHLQNTKPQETSESGEVIVLPPLQVRRRAPAFTRRMNDFLQRVIPALLGLGLLVVLWQLAAINSKGFPTPLSTLDSAMTLFADPFYRDGPNDMGIGWNVLASLQRVAIGFGLAALAGIPLGFLIGRFTFFSRMFNPLIALLRPVSPLAWLPIGLLLFQKAEPASSWTIFICSIWPMVINTAEGVRCIPQDYLNVARVLQLSEWTIMRRILFPAVLPAVLTGVRLSIGIAWLVIVAAEMLTGGLGIGFWIWNEWNNLNVENILIAIVIIGVVGLLLEQGLMLIARRFSWQEK

SEQ ID NO: 8688 - protein, 265 aa, Enterobacter cloacae
GVKMKPLIQVQAVSQRFSTASGEFLALQNVSFDIHEGETVSLIGHSGCGKSTLLNLIAGITLPTEGGLICDNREIAGPGPERAVVFQNHSLLPWLTCFDNVALAVDQVFRHTMSKAERKAWIEHNLDRVQMGHALHKHPGEISGGMKQRVGIARALAMKPKVLLMDEPFGALDALTRAHLQDSVMQIQQALNTTIVLITHDVDEAVLLSDRVLMMTNGPAATVGEILRVDLPRPRNRVQLADDSRYHHMRQQILHFLYEKQPKAA

SEQ ID NO: 8689 - protein, 1331 aa, Enterobacter cloacae
GGTMRLVIIGNGMAATRLIASLTGRVPGRFAVTVIGDEPEQAYNRIQLSPVLGGEKQAEHICLHDEDWYTARGVTVLRGETALAVDVNAREVHTSACTLGWDALVFATGSTPVVPPIPGGDAPHVFTFRTLAETRAIQNISGPAVVLGGGVLGVEAAAALARKGDNVTLVHRGPWLMEQQLDQQAGLLLEEALAARGVSCELASGITAIADDAVTSLDGRRIAATRVVLATGVQPNVALANASGIRCARGIVVDQQMQTSVPGIYAIGECCEIDGQTFGLVAPCLAQADILAARLAGEVTAPFTLTDNGVRLKVTGVELFSLGRATAQADDVVWSSWDPLTRHYRRLLIHQGALAGVLLLGDCRSAATFTDLLATAAPAHADWLFDRFTTQPQVAGQNAMTKPTLVVVGHGMVGHHFLEDCVNRNLHQQYQIIVFGEERYAAYDRVHLSEYFGGRSADSLSLVAGEFFADNGIELRLSQQIVAIDRDAHVVRTASGHETHWDKLVLATGSYPFVPPVPGNDLPGCFVYRTLDDLDNITAHAAGSRRGVVIGGGLLGLEAANALKQLGLETHVVEFAPNLMAVQLDSDGAAMLRKKIEALGVGVHTSKSTTEIATADDGLVLRFADGEQLETDMVVFSAGIRPQDALARSSGLVIGERGGICIDDGCRTSDPDVLAIGECALWEGKIFGLVAPGYQMARVAAAVLAGEEKRFTGADMSTKLKLLGVDVASFGDAHGRTPGALSYQWTHGPQQIYKKIVVSHDSKTLLGGVLVGDASEYATLVQMMLNGISLPKEPETLILPVSSGSAPKALGVAALPESAQICSCHNVSKGDICQAVSAGATDIGAIKQCTKAATGCGGCSALVKQVMEFQLAEQGVEVKKDICEHFPYSRQEIYHLVRVNHIRTFDQLISRYGQGHGCEICKPLVGSVLASCWNEYLLKPAHLPLQDTNDRFFANIQKDGTYSIVPRMPAGEVTADGLIAIGQIAKRYSLYSKITGGQRIDLFGATLEQLPEIWQALVEAGFETGHAYGKSLRTVKSCVGSTWCRYGVQDSTGLAVRLEHRYKGLRAPHKIKMAVSGCTRECAEAQSKDVGVIATDKGWNLYLCGNGGMKPRHADLFASDLDDETLIRTIDRFLMFYIRTADRLQRTSTWMDNLEGGLDYLREVILNDSLGIAHELEQEMARVMETYQCEWQTTLNDPDRLALFRTAVNVPAAEENKRWQEICNIDEIPEQAGIGAHLGRKPIALFRFGKNVYALDDREPGSRANVLSRGILGDAAGEPVVISPLYKQRIRLRDGCQVENGEPVVRAWPVKIENGKVWVGNEELVMRAEAS

SEQ ID NO: 8690 - protein, 193 aa, Enterobacter cloacae
EIMRYLSKDERREEILQAAMRVALTEGFAAMTVRRIATEAGVATGQLHHHFASAGELKSLAFVRLIRDLLDAEIVGENAGWRERLHAMLGSDDGGFEPYIRLWREAQILASRDSDIKGAYVLTMEMWHQETVAIIRAGAEANAFTLADQPENIAWRLIGLVCGLDGIYVLNMPEMDDAAFNKHLDKLISLELF

SEQ ID NO: 8691 - protein, 305 aa, Enterobacter cloacae
RDVPLSGDCQLRRPLRDPHQPPRNGTRRFPGEKRLRLHLRRRLSRLRHKIQPLQQQPHRRDQHHRSARSRGGRVMQILKIIALLIEYPDELLWENRDEALSLVEQDAPMLLPFAQQHLSAPLLDKQAEWCEVFERGRATSLLLFEHVHAESRDRGQAMVDLMSQYEKAGLELDCRELPDYLPLYLEYLSIVSDDEAREGLQNVAPILALIGGRLKQREVAHYQLFDALLSLAETRLSSDSVAKQVSGEKRDDTRQALDAVWEEEQVKFIEDNATSCDSSPMQQYQRRFSQDVAPQYVDVSAGGPK

SEQ ID NO: 8692 - protein, 254 aa, Enterobacter cloacae
MQPPQGIDINLYGLLPARAGKISTQKWGHDLLQEVISPVYKLFSLLHMRKSAFSSYSSCTRGDPMSHFRPVELRHASRLLNHGPTVLITSRDETIDRRNVMAAAWSMPVEFEPPRIAIVVDKSAWSRELIERSGKFGIVIPGVAAANWTWAVGSVSGRDEDKFNCYGIPVIYGPELDLPVIEEKCLAWMECRLLPVTSAAEKYDTLFGEVVSAAADERAFVAGRWQFDGDKLNTLHHMGAGTFVASGKMVKALE

SEQ ID NO: 8693 - protein, 94 aa, Enterobacter cloacae; identical to SEQ ID NO: 7141

SEQ ID NO: 8694 - protein, 72 aa, Enterobacter cloacae
FRGLLAAAGRDICSYGDQDLVEYVDVGASYYFNKNMSTYVDYKINLVDDSQFTKDAKVATDNIVAVGLTYQF

SEQ ID NO: 8695 - protein, 490 aa, Enterobacter cloacae
HPIIPTSHRKVSFCFYLIFSLHLGKQEGDMSHQSEKSNQHLLSNWKPENAQFWENKGKHIARRNLWISVACLLLAFCVWMLFSAIAVNLNKVGFNFSTDQLFMLTALPSLSGAILRVPYSFMVPIFGGRYWTVLSTVILVVPCVWLGIAIQNTATPYWVFIIIALLCGFAGANFASSMGNISFFFPKARQGSALGINGGLGNLGVSVMQLVAPLVIFLPMFTFLGVHGVPQEDGSTMWLANAAWIWAPLLILATLAAFFGMNDIASSKASIASQLPVLKRFHLWLLSLLYLATFGSFIGFSAGFAMLSKTQFPDVNILHLAFFGPLIGALARSAGGMISDRLGGVRVTLINFVFMAIFSALIFLTLPGSGSGSFIAFYLVFMGLFLTAGLGSGSTFQMIAIIFRQITLDRVKKQGGSDEQAQHEAVTETAAALGFISAIGAVGGFFIPKAFGTSLAMTGSPVGAMKVFLVFYIVCVLVTWLVYGRKSSQK

SEQ ID NO: 8696 - protein, 529 aa, Enterobacter cloacae
LAGRRRSGSGTGGEKMKIRSQVGMVLNLDKCIGCHTCSVTCKNVWTGREGMEYAWFNNVETKPGIGYPKNWEDQDEWQGGWIRGIHGKLTPRLGGKMGVLSKIFANPVLPQIDDYYEPFTFDYQDLHRAPEGDHLPTARPRSLIDGKRMDKIVWGPNWEELLGGEFEKRARDRNFQKIQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEHETDLYERQCDVFLNPNDPAVIEEALKQGIPQNVIDAAQRSPVYKMAMDWKLALPLHPEYRTLPMVWYVPPLSPIQSYADAGGLPQSDGVLPAVESLRIPVQYLANMLSAGDTGPVLRALKRMMAMRHYKRSQTVEGVTDTRAIEEVGLTEAQVEEMYRYLAIANYEDRFVIPTSHREMARDAFPEKNGCGFTFGDGCHGSDTKFNLFNSSRIDAINITEVRDHGEGE

SEQ ID NO: 8697 - protein, 77 aa, Enterobacter cloacae; identical to SEQ ID NO: 7143

SEQ ID NO: 8698 - protein, 114 aa, Enterobacter cloacae
PIVDIAQSHARRRKTMIPNHPEPEQIVLENVLFALGNPLRLAIIRRLADGSELSCNALRPEEVVKSTMTHHWRVLRDSGVIWQRPQGRENMISLRREDLDTRFPGLLAILLQAK

SEQ ID NO: 8699 - protein, 298 aa, Enterobacter cloacae
AAMLKDNFNDLLSFMVVARERSFTRAAAQLGVSQSALSHAMRNLEARLEVRLLTRTTRSVAPTEAGEQLFMRLSPHLLEIEQELTALRDTRDRPAGNIRLNAGEHAMSTVLWPVLKPFMAQYPDINVEVTVDNGLTDIVDGRFDAGVRLGEQVAKDMIAVRIAPDMRMAVVGSAEYLQRFGIPKTPEQLDQHRCINMRLPTRGGLYAWEFERDGRELRVRVDGQLILNSLPQRIDAAENGLGLAYVPQDAVQDALAKGRLVGVLEAWCPAFTGYHLYYPSRRQHTTAFALLIAALRHT

SEQ ID NO: 8700 - protein, 532 aa, Enterobacter cloacae
LERQHVSAQKQSFVSASARQDYHVNGSDRQTGNSMKTSNKSAADHHAAKRRWLNSHEEGYHKAMGNRQVQMIAIGGAIGTGLFLGAGARLQMAGPALALVYLVCGIFSFFILRALGELVLHRPSSGSFVSYAREFLGEKAAYVAGWMYFVNWAMTGIVDITAVALYMHYWGAFGDVPQWVFALGALAIVGTMNMIGVKWFAEMEFWFALVKVLAIVIFLVVGTVFLGTGKPLDGNATGFHLITDNGGFFPHGLLPALVLVQGVVFAFASIELVGTAAGECKDPQTMVPKAINSVIWRIGLFYVGSVVLLVLLLPWNAYQAGQSPFVTFFSKLGVPYVGSIMNIVVLTAALSSLNSGLYSTGRILRSMSMGGSAPKFMSKMSKQQVPYAGILATLVVYIFGVFLNYLVPSQVFEIVLNVAALGIIASWAFIVVCQMRLRKAIKEGKAADVSFKLPGAPVTSWLTLLFLLSVLVLMAFDYPNGTYTIATIPLLAVLLIAGWFGVRKRVNEIHSTAPVHPGDDKQDGPLVEETSR

SEQ ID NO: 8701 - protein, 331 aa, Enterobacter cloacae
PVYSMKIITARKASLPLLFAPVIFGPLSAMAADEQTLIVSATPQTVSELDTPAAVSVVSGEDMRHATPRINLSESLGSVPGLQIQNRQNYAQDLQLSVRGFGARSTFGVRGIRMYVDGIPATMPDGQGQTSNIDLNSIESVDVLRGPFSALYGNASGGVININTQTGQQPATIEASSYYGSYGTWRYGMKATGAVGDGTQAGDVDYAVSTTRFTTHGYRDHSGARKNLANAKLGVRIDDVSKLTLIFNSVDMKANDPGGLSYQEWQNNPRQSPRGDQYNTRKTIKQTQAGIRYDCQLSEQDDLSVMMYAGEREMTQYQSIPDTAQTENPAH

SEQ ID NO: 8702 - protein, 1260 aa, Enterobacter cloacae
CLTLRPCYRSRRNVMSKLLDRFRYFKTKGDSFADGHGQVYHTNRDWEDSYRQRWQFDKIVRSTHGVNCTGSCSWKIYVKNGLVTWETQQTDYPRTRPDLPNHEPRGCPRGASYSWYLYSANRLKYPLVRRRLIELWREALAQHTDPVLAWDAIQNDKQKAQSYRKARGKGGFIRSNWKELNQLIAAANVWTIKNYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTVAITPDFSEVAKLSDQWLAPKQGTDSALAMAMGHVILKEFHLDNPSDYFLNYCRRYTDMPMLVLLDEQADGRVVPGRMLRASDLADGLGETNNPEWKTIAFDVAGNLVAPNGSIGFRWGEKGKWNLESLAAGQETELTLSLLITHDSVADVAFPYYGGNENPHFRSVKQEPVLTRRVPSKTLTLADGSQRRVVSVYDLVLANYGLDRGLEDSNAATNYAEIKAYTPAWGEQITGVPAYLIEKIAREFADTAHKTHGRSMIILGAGVNHWYHMDMNYRGMINMLVFCGCVGQSGGGWSHYVGQEKLRPQTGWLPLAFALDWNRPPRQMNSTSYFYNHASQWRYEKLTARELLSPLADASKFTGHLIDFNVRAERMGWLPSAPQLNLNPLHVKARANAAGMSPQDYTVQALKSGDIRFACEQPDNGKNHPRNLFVWRSNLLGSSGKGHEYMLKYLLGTESGIQGEDLGSTDDVKPEEVEWQTAAIEGKLDLLVTLDFRMSSTCLFSDIVLPTATWYEKDDMNTSDMHPFIHPLSAAVDPAWESRSDWEIYKGIAKVFSEVCVGHLGTETDVVLQPLQHDSPGELSQPFDILDWRKGECDLIPGKTAPNIAVVERNYPETYERFTALGPLLDTLGNGGKGISWNTQNEVDFLGKLNYVKLDGPAKGRPRIETAIDASEVILALAPETNGQVAVKAWEALGELTGRDHTHLALNKEDEKIRFRDIQAQPRKIISSPTWSGLESEHVSYNAGYTNVHELIPWRTISGRQQLYQDHAWMRAFGESLVAYRPPIDTRSVTHMREIPPNGYPEKALNFLTPHQKWGIHSTYSENLLMQTLSRGGPIVWISETDARELGIEDNDWIEAFNANGALTARAVVSQRVPPGMTMMYHAQERILNIPGSEVTGRRGGIHNSVTRVCPKPTHMIGGYAQLAYSFNYYGTVGSNRDEFIMIRKMKNINWLDGEGRDQVQEAKK

SEQ ID NO: 8703 - protein, 242 aa, Enterobacter cloacae
PGRRAAVRGRQRRRPKMTHYLNVFFYDIYPYICATVFFLGSWLRYDYGQYTWRASSSQMLSKRGMNWASNLFHIGILGIFFGHLFGMLTPHWMYAWFLPIAVKQQLAMIAGGICGVLTLIGGSMLLIRRLFNQRVRATSTTPDIIIMSILLLQCILGLSTIPFSAQYPDGSEMMKLVGWAQGIVTFKGGSSEMLSGVAPIFRVHLVLGMTIFLIFPFTRLVHVWSAPFEYFTRRYQVVRSRR

SEQ ID NO: 8704 - protein, 174 aa, Enterobacter cloacae; identical to SEQ ID NO: 7138

SEQ ID NO: 8705 - protein, 178 aa, Enterobacter cloacae
LTLHTLRNDLFRHIPRSFRKMMEFHRIRRAPLGHRAQRGGITKHLSQRDVSANNLAAVLLCHPLHQAATGGEIAHNVPGILFRRFHLNVHDRLKNNRVRPPCALFEAEDRRHAEGHLRGVNVMVRTKRQGRFHIHHRIARQHTRIHGFSQPFFHRRDVLPRHHPAFGGIFKHKTTPGC

SEQ ID NO: 8706 - protein, 89 aa, Enterobacter cloacae
RLKAQDHMTVLPFPAGLSDKFTFYIFHRFTQGFTVGDLRTTNVRLNAKLALHAVDDDLQMQLAHPGDNRLTGLFVRVQAERRIFRRQAL

SEQ ID NO: 8707 - protein, 317 aa, Enterobacter cloacae
SDPHFLLIGLGFRLNRQRNNRIRELHPFKGDHRIRVGQRVTGGDVFQPDTGCDIPCAQLVHLMAIVGMHQHDAPDTLFLALHRVVHRVAFTQYAGIDADEGQLADVRIAHQLEGQRRERFIIAWVALGVLSVFVYPINSGHVQWRRHQFNHRVEHALHALVLESAAAQHGLYFTGDSPDPQSFDDFRFIQFARLKVLIHKLIAGFCRRRDHFFSPRLGGTQQIVRHRRVAKCHALRRIVPQNGAHLDEIHHAGEVFFCPHGDHNRDRIGFQPLLHHPHHAEEICARAVHFVDECQTRNMVFIRLTPDGFRLRLHATD

SEQ ID NO: 8708 - protein, 133 aa, Enterobacter cloacae
IMKIIRSGSLPSVQGPEAWFTGSVRIDAPFQATEPAKVGGATVTFEPGARTAWHTHPLGQTLIVTQGRGWLQEWGKEAEPLNQGDIAWIPPGVKHWHGASAQTAMTHIAIAEAVEGSPVAWLEKVTDEQYPNE

SEQ ID NO: 8709 - protein, 339 aa, Enterobacter cloacae
VKRERNMSWRISILDKSPVAEHETAADALARTLALAQQAETLGYHRFWIAEHHNTPQLASPSPELLIAWILGQTKRIRVGSGGVMLQHYSPYKVAENFNVLAAIAPGRVDLGVGKAPGGLPLSTRALQYGLNPQEKGSFADQLTQLDRWIRPENQSAEEDVRATPLPPAPARGFLLGASTESVLLAASLDWHFVFAAHLNGDPELLRDVVTAWRQHSVREVIVAVQAIVAPTQAEADALAQKVEVWGVELANGQRVTVASEEQAYAFARQAGSEPVRIARRAQSLLAGTAASVHEQLNALHQQWGIDEFIIDTPVADGATRVQSLRLLAEARLNREVTV

SEQ ID NO: 8710 - protein, 442 aa, Enterobacter cloacae
FEVNMTAHRQLRLGTILHGASGNMSAWRHPAAVADASINFDFVKETALKAEEGKLDFIFVADGLYINEKSIPHFLNRFEPLTVLSALASITSRLGLVGTLSTSYSEPFTVARQFASLDHLSNGRAGWNVVTSPLEGSARNFSREKHPEHALRYRIADEYLDVVKGLWDSWEGDAFIRNKESGQFFDASKLHTLDHHGDFFQVSGPLNIGRTPQGRPIVFQAGASDDGKKLAAKHADAIFTHHDTREEAQAFYRDVKQQLESHGRRAGDLHIFQGVSVIVGNDADDVENQYQTTAALVSINDALNYLGRYFEHHDFSQYPLDAPFPDIGDLGKNSFRSTTDEIKRNARERNLTLRQVALEAASPRPRFSGTPEQVADGLQAWFEEKAADGFIIQGGTPDTFPRFVDQVVPVLQARGLFRTDYPGTTLRESLGLDEPKNQFTQQ

SEQ ID NO: 8711 - protein, 278 aa, Enterobacter cloacae
TRTGRRVARVRSPLRQHRSLFMQASPEGHISITGVSKFFGRHKALDNVTLEIPPGSVTVILGPSGSGKSTLLRAINHLERVDEGFIQIDGDYIGYRRQGDKLYELKEREILKQRVNVGYVFQNFNLFPHLTVLENLIEAPIAHKKFSKKEAVENAYSLLDVVGLRDKADAWSRHLSGGQQQRIAIARALALRPRVMLFDEPTSALDPELVGEVLDVIKKLARSGTTLVVVTHEIGFAREVADQVVFMVDGKIVEQGSSDDVLNRPSHPRTRQFLSKVL

SEQ ID NO: 8712 - protein, 298 aa, Enterobacter cloacae
GAQMKYGLLAGLVFTTASHASIDLKANEQPLPVTVDQQAVAKIPANYKFVEPGTLTVAISALNSPPLALLASDNRTRIGSDPDIARLLAGSLGLKLKLVPTAWEDWPLGITSGRYDVALVNIAVTEQRKEKFDFATYRVDSLAFSVKSTSNVQSITSAKDLAGKKVIVGSGTNQERILLGWNEENKKAGREPALPVYLTDDASGNLYIQSGRADVFFGPQSVSAYKAALTGKTRVVGLGPKKAYVATTTKKGNGLVYALQAALDGAIKRGEYQKVLARWGEAGEAVTSSDVNPPGITY

SEQ ID NO: 8713 - protein, 90 aa, Enterobacter cloacae
SDNVERSPIKGALPMPHVDIKCFPRDLTDEQKTALAADIAEAIARHLNSKDRSISVALQEVQEADWKAQVWDTEIGPKLDELIKKPGYSM

SEQ ID NO: 8714 - protein, 338 aa, Enterobacter cloacae
KDNFSMTKLPQFSLAFIHPRYWLSWAGIAALWCTVQLPYPLLLKTGHRLGRLAMRLLPRRVEIARRNLELCFPDMKEDERERLLERNFESVGMGVIETGIAWFWPNWRVRRHFSVTGYEHMEQARAQGRGVVLIGMHFLTLELGARIFGMLNAGIGVYRPNNNALLDWLQTRGRLRSNKTMLDRYDLKGMIRALKQNEILWYAPDHDYGKTNSVFVPFFAVPDAATTAGSYMLVKSARPAVIPFVPRRKADGTGYELLILEDISDTLQGGDKASVATQMNRAIERAVMMAPEQYMWLHRRFKTRPEGQPDRYKRKKQVASTARTLSASDISDRSSIQQ

SEQ ID NO: 8715 - protein, 293 aa, Enterobacter cloacae
FINRGYHLLEQIMSPFLSAYFARTGWQQPVQVNIDTLRGLHLHHNCAIPFENIDVVLPREIHLDDGCLVDKLVTARRGGYCFEQNGLFERVLREVGFTVRSVLGRVVLANPSQMPPRTHRLLLVELNGERWIADVGFGGQTLTAPIRLIANEEQETPHGRYRLLSEGNDWILQFRHHDHWQSMYHFDLATQYFNDYVMGNFWSAHWPQSHFRHHLLMCRHLPDGGKLTLTNFNFTHWQNGHVEEQIHLPDAEALYQLMQARFGLGVDDPKHGFTLAELTAVMAGFDTHPQAGE

SEQ ID NO: 8716 - protein, 703 aa, Enterobacter cloacae
GNIMPRPIPLERYRNIGISAHIDAGKTTTTERILFYTGMSHKLGEVHDGAATTDWMAQEQERGITITSAAVSCFWPGMDRGFEPHRINIIDTPGHVDFTIEVERSMRVLDGAVMVYDSVGGVQPQSETVWRQANKYHVPRLAFVNKMDRPGADFFRVVRMMQERLKANPVPIVIPVGAEEHFTGVVDLIKMRTILWDDATQGMAFSYAPVPDDLLSTAQTWREKMVSSAAEASDELMDKYLETGELDEAEIIKGLRIRTISGEIQPMLCGSAFKNKGVQRMLDAVIELMPSPLDVPAIDGVDEDGQHAERHPSDDEPFSALAFKLMSDPYVGQLTFIRVYSGILRKGDAVYNPVKGKKERIGRIVLMHANDRHEVDELRAGDIAACVGLKDVTTGDTLTDPNAVITLERMEFPDPVISLAIEPKTKADQEKMGIALQRLAAEDPSFRLHTDEESGQTIISGMGELHLEIIVDRMKREFGVEANIGRPQVTYRETLRKAVKDIEGKFVRQSGGKGQYGHVVLSLEPLAAGSGFVFEDATKGGVVPREYIPSVEKGLREAMNTGVLAGYPVVDVKATLTFGSYHDVDSSEMAFRMAAILGFKEGARRADPVILEPVMHVEVETPEEYAGNIMGDLSSRRGLVQGMAEQYGSQIIRADVPLAEMFGYATTLRSMSQGRATYTMEFHHFAEAPRNVAEEIIAKRVKS

SEQ ID NO: 8717 - protein, 357 aa, Enterobacter cloacae
KGIVMSLRHLCSPRLRGSLLLGSLLFAGTFQVHAAEEMLRKAVGKGAYEMAVSQQENALWVATSQSRKTDKGGVVYRLDPVTLEVTQAIHNDLKPFGATIDNATQTLWFGNTVNSAVTAIDAKTSEVKGRLVLDDRKRSDTVKPLQPRQLVADDTTNTVYITGIGKESVIWVVDGATLKLKDTITNTGTFSTGLALDAKAKRLYTTNADGELVTIDTATNKILSRKKVQDDGKEHFYLNLSLDTVGQRAFVTDSKQPEVLVVNLKDGSVMQKIAAPESLAVLFNPARNEAYVTHREAGKVSVIDAKTYKVTKTYDTPVYPNSLALSADGKTLYVTVKQKSTRQQEATQPDDVIRIAL

SEQ ID NO: 8718 - protein, 191 aa, Enterobacter cloacae
FDPFSSAFAGGTVKINIIGTSGSGKSTFGRRIAEALAIPYIEMDRLYWRANWQGTPDDEFLATLEKALAASPDWVLDGNYNRTRDVKWRDVDLVVWIDRGFIRTLWQAVTRASRRAWHKQELWPGTGNRESFRRSFLSKDSIIIWTIKTWRSNRKRYQADMQNPQYKHIRFLRITRRQDAERLIASLKSRR

SEQ ID NO: 8719 - protein, 378 aa, Enterobacter cloacae
QGGYRMSFSEQLIAWRRELHQNPELSGQEVETTARLREWLTAAGIAPLPYDLQTGLVAEIGTGNALVALRADIDALPIDERSGVPFSSRRAGVMHACGHDIHTSVILGAALKLKEREASLNGRVRILFQPAEENFGGAKSMVRAGALRDVRAIFGMHNEPSLPVGEFATRGGPFYANVDRFVIHVTGKGAHAARPHEGNDAIVLASQLVTALQSVASRNVNTLDSVVLSVTRIAGGNTWNVLPESVELEGTLRTHRTEVQQNVKARVGEIAAGFASAFSAQINITWYAGPTALVNDEHWAVFATSVAREAGYETRHAELHMGGEDFAVYLQNIPGAFVSIGSNSPFGLHHPAFNPDEALIEPAARYFAQLAEKALQHF

SEQ ID NO: 8720 - protein, 353 aa, Enterobacter cloacae
PGGARFTGAWPVPHRLSRHHAARKSGLRRAQKSVHTTIKEKNAMQKSSLILALALAFTPAVWAENVNINGTGVSIEANKTPINTAKNSDAIAQLPKDYRFAVPGKFTVAVAGLNQPPLTVFSDDNKTLLGSEVDIARLVADSLGLELNVVPTSWEDWPLGVASGKYDAAISNITVTKARKEKFDFATYRKDSLGFYVKSTSPINSLVKAEDIAGLRIIVGSGTNQEAILLAWNEENLKKGLKPFTPIYTKDDAAQTLALQSGRADAYFGPNVIGAWKAALNGKTKLVGSVDGGWPKAAHIAVTLKKGSGLAEPVQTALNGAIKNGDYDKVLNRWGEGVERIPSSEVNPAGLGD

SEQ ID NO: 8721 - protein, 172 aa, Enterobacter cloacae
GGAMREQFRDVSPEDTDLQPIIEGLFGEYAARYGDYFSKDAEVELTEWYLAPQGLFIVLERDGEIIATGAYKPFDEHTAEIKRIWTNKTLRQQGLAARVVQELERRAVLAGYSHIYLTTGFRQPEAVRLYLSQGYQPQFDLNRDPEEYSQPPFDGRLRFTKTLIREALSKTA

SEQ ID NO: 8722 - protein, 311 aa, Enterobacter cloacae
GATMSNVETIKVVPARYPLRAAGAVVALFVLAVVIQSVAFNPRWEWAVFARWFFDPVILEGVGQTLLLTLISTVLSVVIGGMLALARLSSSWLLSSLAWGYIWLFRSLPLIVVLIILYNFSYLYDTLSLGVPFTGITWGSFETINVLGQFSTAIVGLTLVQSAYTAEIIRGGFLGVDHGQYEAAAALGLPAWRRTVRIILPQALRTILPSGFNEIISLAKGTAMVYVLAMPELFYTIQMIYNRTQDVIPLLMVGAVWYLVITTVLSAIQHVIERGLARSERRSAVNQNRAASRSRSVTTSPAQEPVHASLS

SEQ ID NO: 8723 - protein, 208 aa, Enterobacter cloacae
GGNMIKLYGVPGWGSAISEVMLTLADIPYQFVNVDGFDQPGPQRELLLKLNPLCQVPTLELENGAIVTETAAIALMVLDRRPDLAPPVGQAERQQFQRLLIWFVANVYPTFTYADYPERWVPDAPEQLKKNCIEYRKSLYLWFDSQLSASPFAFGKQLTLLDVYIAVARTWGPRHEWFATNTPNFTAVADAVCALPELHKVLKANDII

SEQ ID NO: 8724 - protein, 98 aa, Enterobacter cloacae; identical to SEQ ID NO: 7150

SEQ ID NO: 8725 - protein, 464 aa, Enterobacter cloacae
SMTLGASGKELLWIIDIYSLVMAGMVLPMGAMGDRIGFKRLLMIGSVLFGLSSLAAAFAPSAGWLIAARASLAIGAAMIIPATLAGIRTLFIDARHRNIALGVWAAVGSGGAAFGPLIGGMLLEHFYWGSVFLINVPIVLMVVSLAARFVPAQQGRPEQPLNISHAIMLIVAILLLVYSAKTALKGVLSPWMVTITLLTGAVMLFIFVRIQLRARVPMIDMRLFCHRIILSGVVMAMTAMIALVGFELLMAQELQFVHGFTPFEAGIFMLPVMVASGFSGPIAGVLVGRLGLRIVAAGGMGLSAVSFIGLSMLDFSTQQWQAWSLMVLLGFSAASALLTSTSAIMAAAPKEKAAAAGAIETMSYELGAGLGIAIFGLLLTRSFSASIVLPQGLSASLTDKASSSIGEAMKVAQELTPSLAEPVMTAAKTAFITSHSVALGSAGGMLLILAVGIWFSLAKVGGQQ

SEQ ID NO: 8726 - protein, 71 aa, Enterobacter cloacae
QILELVGQTYSHDVVGSHFGIFGELAVIHEVDFVINVGGHVFVEVVARANVNVFNQILVAIRTDVSTSRCQ

SEQ ID NO: 8727 - protein, 261 aa, Enterobacter cloacae
QRQSIIKISKLVNNARHVNCVEGNTTLYALPRAEIVERWREQTTDDFRFCFKFPATISHNAALRNCDDLTHEFFTRMSPLANRIGQYWLQLPAAFGPRDLPALWQFLEALPLDFTYGVEVRHPEFFAKGDAEKALNRGLHERSVNRVILDSRPVHSAIPHSEAVVDAQRKKPKVPVHAIVTAQNPMVRFIGSDNMQQNEEMFAVWLQTLAKWEHTTTPYLFLHTPDIAQAPELVDALWQALQQAVPSVGPAPSIPQQSSLF

SEQ ID NO: 8728 - protein, 142 aa, Enterobacter cloacae
RRAICQKQGVSMVSALYAVLGALLLIKFSFDVVRLRMQYRVSYGDGGFSELQSAIRIHGNAVEYIPVALILLLLMEMDGAETWMVHVCGLLLIAGRLMHYYGFHHRLIRWRRSGMSATWCSLLLMVLANLWYMPWELVFSFH

SEQ ID NO: 8729 - protein, 336 aa, Enterobacter cloacae
LWFSGGAESRRRSMIEFGNFYQLIAKNHLSHWLETLPAQIATWQRDQQHGLLKQWSNAVEFLPELTPHRLDLLHSVTAESEEPLPAGQINRIETLMRNLMPWRKGPFSLYGVNINTEWRSDWKWDRVLPHLSDLTGRTILDVGCGSGYHMWRMIGAGAHLVVGIDPMQLFLCQFEAVRKLLGNDQRAHLLPLGIEQLPALKAFDTVFSMGVLYHRRSPLEHLWQLKDQLVSGGELVLETLVIEGDEHAVLVPGDRYAQMRNVYFIPSALALKNWLEKCGFVDVRIADVCVTSIEEQRRTDWMITESLEQFLDPDDHSKTIEGYPAPMRAVLIATKP

SEQ ID NO: 8730 - protein, 580 aa, Enterobacter cloacae
GIQVNIQALLSEKVSQALIAAGAPADCEPQVRQSAKVQFGDYQANGVMAVAKKLGMPPRQLAEQVLTHLDLTGIASKTEIAGPGFINIFLEPAFLASHVDAALKSDRLGVAQPEAQTVVVDYSAPNVAKEMHVGHLRSTIIGDAAVRTLEFLGHKVIRANHVGDWGTQFGMLIAYLEKQQQENAGEMALADLEGFYREAKKHYDEDEAFAERARSYVVKLQGGDPYFLEMWRKLVDITMSQNQLTYNRLNVTLTRDDVMGESLYNPMLPGIVADLKAKNLAVESEGATVVFLDEYKNKEGEPMGVIVQKKDGGYLYTTTDIACAKYRYETLHADRVLYYIDSRQHQHLMQAWTIVRKAGYVPDSVPLEHHMFGMMLGKDGKPFKTRAGGTVKLSDLLDEALERARRLVAEKNPDMPADELEKLANAVGIGAVKYADLSKNRTTDYIFDWDNMLAFEGNTAPYMQYAYTRVLSVFRKANIDESVLANATVSITEDREAQLAARLLQFEETLSVVARDGTPHVMCAYLYDLAGLFSGFYEHCPILSAESEAVRHSRLKLAQLTAKTLKLGLDTLGIETVERM

SEQ ID NO: 8731 - protein, 448 aa, Enterobacter cloacae
SHIALGRLEESMDRVTYPTGVENHGGTLRIWFNFKGKRVRESLGVPDTAKNRKIAGELRTSVCFAIRTGTFEYAAQFPDSPNLKTFGVGKKEITVSELAEKWLDLKRMEICANALNRYESVTRNMVPRIGGNRLVSAVTKEELLYIRKDLLTGHQMPMKGKVPAKGISVVTVNYYMTTIAGMFQFAADHGYLEANPFDGIKPLKKARAEPDPLTRDEFIRLIDACRHQQTKNLWSLAVYTGVRHGELTSLAWEDIDLEAGTITIRRNYTKLGEFTLPKTEASTNRVIHLIQPAISVLRNQAEMTRFGKKHQIDVQLREYGRTESHECTFVFNPQLVRRCQQVGIIYKVDSIGDLWDAAMKRAGIRHRKAYQSRHTYACWSLSAGANPSFIASQMGHASAQMVFNVYGAWMADSSSEQIAMLNQRLADFAPQMPQSIHSSARALLKSVS

SEQ ID NO: 8732 - protein, 279 aa, Enterobacter cloacae
WCWLTFGICRGSWFSPSISAQYAPLFFPDFYVMSDRDTLFSAPIASLGDWTFDERVAEVFPDMIQRSVPGYSNIISMIGMLAERFVQPGTQVYDLGCSLGAATLSIRRNVHHEGCKIVAVDNSPAMVERCRRHIDAYKAPTPVEVVEGDIRDIDIQNASMVVLNFTLQFLVPDDRQRLLDKIYQGLNPGGALVLSEKFSFEDASVGELLFNMHHDFKRANGYSELEISQKRSMLENVMLTDSVETHKARLRKAGFEHSELWFQCFNFGSLVALKAGDAA

SEQ ID NO: 8733 - protein, 438 aa, Enterobacter cloacae
IKILYASTQETLLAHRGFFVASANKLTLFIVIFMLAGILSGAAIHEYASSDAIQAWSENITLLTDIFLRLIKMVIAPLVFSTLTVGIMKLGETSTIGRVGGKAMVWFISSSVLSILVGLFIVTLEQPGSGLNLSIPTETVDTGLAVSGMSLKAFLSHTIPTSIAGAMANNEILQIVVFSMFFGIGGASLGQKFNAPLVAALDVVSHIMLKVTGYVMYVAPLAIFAAISSVIATQGLGILLNYASFIGGYYVAILLTCLVLLAVGYMVLKKEIFRLVAMLKDPVLVAFTTSSSEAAYPKTLEQLARFGCSRNIASFVLPIGYSFNLVGSMVYCSFASMFIAQAYNIHLSFTEVTVLMLTLMLASKGIAGVPRSSLVVLAATIPSFNIPVAGILLLMGIDHFLDMGRSAINVLGNGIATAMLSQNEGAREAEAELVEQEA

SEQ ID NO: 8734 - protein, 146 aa, Enterobacter cloacae
KECVMSYSHLLVSVAVSPESHQLVARAVSIARPNNARISLITLAAEPEMYNQLAAPMLEDIREVLQEETQQFLRELVERANYPVHQTVIATGELSEHILDICRKQNIDLVICGNHNQSFFSRAACSAKSIVSSSQVDVLLVPLGGN

SEQ ID NO: 8735 - protein, 311 aa, Enterobacter cloacae
GRMKNQSHPIVIVKKRKHKAHGHGSHGSWKIAYADFMTAMMAFFLVMWLISISSPKELIQIAEYFRTPLATAVTGGPRISNSDSPIPGGGDDYTQQQGEVKKQPNIDELKKRMEQARLKKLRGDLDQLIEADPKLRALRPHLKIDLVQEGLRIQIIDSQNRPMFKTGSADVEPYMRDILRAIAPVLNGIPNRISLSGHTDDFPYATGEKGYSNWELSADRANASRRELVAGGLDDGKVLRVVGMAATMRLTDRGPDDAINRRISLLVLNQQAEQAILHENAESQNESLDDLKQPGAVPSAAVPTSPPANPR

SEQ ID NO: 8736 - protein, 263 aa, Enterobacter cloacae
PCHGRKGRTSMKPFFRRSGLVGLLGATALAAGQAQAAATILLWPIDPWLSAEARATELWIQNQGNSATTMQIRIVRWKQEGGYERYTAQQDVVASPPIVTIAKGSKQLIRLIKQGTIPSGVEQAYRIIVDEIPQPDAKAEPSMGLKLQMRYSIPLFVYGQGIPTLNEGAHHALANTQQLSWRVVQEGGKPALQVRNQGDVHVRLSQVAVEQGGQKRTVAEGLLGYVLPGSTRSWPLPAGIYQPNRMSAQINARDTQWQSTPVN

SEQ ID NO: 8737 - protein, 154 aa, Enterobacter cloacae
PGKPADAGENQCRTGNTYLTQEYYFMADKELKFLVVDDFSTMRRIVRNLLKELGFNNVEEAEDGVDALNKLQAGGFGFVISDWNMPNMDGLELLKTIRADAGMASLPVLMVTAEAKKENIIAAAQAGASGYVVKPFTAATLEEKLGKIFEKLGM

SEQ ID NO: 8738 - protein, 476 aa, Enterobacter cloacae
KAIGHLLVVSNRIAPPDDKKASAGGLAVGVLGALKAAGGLWFGWSGEISNEEKPLKKVSRGNITWASFALSEKDYDEYYSEFSNAVLWPAFHYRLDLVKFQRESYEGYMRVNALLADKLLPLIEEDDILWIHDYHLLPFARELRKRGVNNRIGFFLHIPFPTPEIFTALPQHEEILEALSDYDLLGFQTENDRLAFLDSVSGKTRLVTHGGKSHTAWGRNFHTEVYPIGIEPDEIAEQASGPLPPKLAQLKDELKHVKNIFSVERLDYSKGLPERFLAYETLLDKFPQHHGKIRYTQIAPTSRGEVQAYQDIRHQLETEAGRINGRYGQLGWTPLFYLNQHFERKILMKVFRYADVGLVTPLRDGMNLVAKEYVAAQDPADPGVLVLSQFAGAANELTSALVVNPYDRDDVANALNRALTMPLAERISRHSEMMETIVKNDINRWQARFIDDLRAIQPQSQEGDLQKKIATFPKLA

SEQ ID NO: 8739 - protein, 201 aa, Enterobacter cloacae
RSPEEKGLTMSEKSIVQEARDIQLAMELITLGARLQMLESETQLSRGRLIKLYKELRGSPPPKGMLPFSTDWFMTWEQNIHASMFCNAWQYLLKTGLCSGVDAVIKAYKLYLEQCPQHEEGPLLALTRAWTLVRFVESGMLELSRCNCCDGNFITHAHQPAGSFACSLCQPPSRAVKRRKLSRDAADIIPQLLDEQIEHAV

SEQ ID NO: 8740 - protein, 300 aa, Enterobacter cloacae
RKDDVVLILLGYLVVLGTVFGGYMMTGGHLGALYQPAELVIIGGAGVGAFIVGNNGKSIKGTLKAIPLLFRRSKYTKSMYMDLLALLYRLMAKSRQQGMFSLERDIENPKESEIFASYPRILADAMMLDFIVDYLRLIISGNMNTFEIEALMDEEIETHESESEVPANSLALVGDSLPAFGIVAAVMGVVHALASADRPAAELGALIAHAMVGTFLGILLAYGFISPLASVLRQKSAETTKMMQCVKITLLSNLNGYAPPIAVEFGRKTLYSSERPSFIELEEHVRAVKNPNQQTTTEDA

SEQ ID NO: 8741 - protein, 691 aa, Enterobacter cloacae
NSLGPSLRLPFQHRHQPIRGDSVSMDITDFYQTFFDEADELLADMEQHLLDLVPEAPDSEQLNAIFRAAHSIKGGAGTFGFTILQETTHLMENLLDEARRGEMQLNTDIINLFLETKDIMQEQLDAYKSSAEPDAASFEYICNALRQLALEAKGEASAPAVPAAKLSVVDAVAEPATAPDAPAGKLRVVLSRLKENEVNLLEEELGNLATLSNVVKGKDSLAATLDGGIGQDDIVAVLCFVIEADQIAFETEAGAVEAPAPAENTPAVVAAAPALKAVPKETAAPARGEKPAARSSESTSIRVAVEKVDQLINLVGELVITQSMLAQRSNELDPVTHGDLITSMGQLQRNARDLQESVMSIRMMPMEYVFSRFPRLVRDLAGKLNKQIELTLMGSSTELDKSLIERIIDPLTHLVRNSLDHGIELPENRVAAGKSPVGNLILSAEHQGGNICIEVTDDGAGLNRERILAKAISQGMAVNENMTDEEVGMLIFAPGFSTAEQVTDVSGRGVGMDVVKRNIQEMGGHVEIQSKQGAGTTIRILLPLTLAILDGMSVKVADEVFILPLNAVMESLQPREEDLHPLAGGERVLEVRGEYLPLVELWKVFEVDGAKTEATQGIVVILQSAGRRYALLVDQLIGQHQVVVKNLESNYRKVPGISAATILGDGSVALIVDVSALQGLNREQRVANTAA

SEQ ID NO: 8742 - protein, 190 aa, Enterobacter cloacae
MKRKLLFICAGTVLTAATVGQALAVTSSGTIGATLTLTNGCLINGSPTQNGINFGTLDFGTHPATFSTLTTQLTGASGGNTFTIQCTTASYTVAITGNTNATAPGTVVGTPGTPARYLVNTANAAQGVAYSLYSDSGYNNVIANNAALPVASTAGGVNSYTLYGRITGGGNSVTVVPGTYTDTINVSVTY

SEQ ID NO: 8743 - protein, 544 aa, Enterobacter cloacae
TAAACRLMGAWMLNRIRISTTLFLILILCGVLQVGSNGLSFWAFRDGYQNLQEVETSNQQRSALAQTRAVLLQASTALNKAGTLTALSYPPEDIKALMVVARSSLKQADAQFKAFTAQEAVSEKEKALKVAMKKTFDVWYGDLDHQATWLENNQLSDFLTAPVQASQAAFDDSFNAWQQDINQFVARAGADSRTSYRMSGVIFLTMVILAALLTGGSLWWSRKMIVQPLAIVSSHFDSIAKGDLARPVAVYGRNEISAIFASLKAMQSSLRETVSNVRQGSYAMHTGISEIAAGNNDLSSRTEQQAASLAQTAASMEQLTATVSQNADNARQASDLSKQAAMTAKRGGDQASHVASTMQEIAASSQKIGDIISVIDGIAFQTNILALNAAVEAARAGEQGRGFAVVAGEVRNLASRSANAAKEIKGLIEESVSRVQQGSALVDTAAQTMHEIVTSVTRVNDIMGEIASASDEQRRGIEQVAQAVTQMDQVTQQNASLVEEAAAATDQLANQADHLTGLVAVFNVKEHVEAVTEVGRSQAVPVVS

SEQ ID NO: 8744 - protein, 352 aa, Enterobacter cloacae
GKSMSKIRVLSVDDSALMRQIMTEIINSHSDMEMVATAPDPLVARDLIKKYNPDVLTLDVEMPRMDGIDFLEKLMRLRPMPVVMVSSLTGKGSEITLRALELGAVDFVTKPQLGIREGMLAYSEMIAEKIRTASRAKLAAHKPTAAPATLKAGPLLSSEKLLVIGASTGGTEAIRHVLQPLPLSSPGILITQHMPPGFTRSFAERLNKLCQISVKEAEDGERVLPGHAYIAPGDKHMELARSGANYQIKIHDGPPVNRHRPSVDVLFHSVAKHAGRNAVGVILTGMGNDGAAGMLAMHQAGAWTIAQNEASCVVFGMPREAINMSGVSEVVDLSQVSQQMLAKISAGQAIRI

SEQ ID NO: 8745 - protein, 239 aa, Enterobacter cloacae
SHSPRRLWKRSSGRSSRNSACEVMDMLQPAMKPVEEHSPSDIIARIGSLTRMLRDSLRELGLDQAIAEAAEAIPDARDRLDYVVQMTAQAAERALNSVEASQPHQDAMEKGAKALSKRWDEWFENPIELADARELVTDTRQYLGDVPGHTSFTNAQLLDIMMAQDFQDLTGQVIKRMMDVIQEIERQLLMVLLENIPEPAARPKRENESLLNGPQLDTSKAGVVASQDQVDDLLDSLGF

SEQ ID NO: 8746 - protein, 390 aa, Enterobacter cloacae
INGLRAGTVAEENDDKTEAPTPHRLEKAREDGQIPRSRELTSLLILVVGVCIIWWGGEMLARRLAGMLSAGLRFDHSMVNDPNLILIQIINLVKSAMIALLPLIAGVVIVALVSPVMLGGLVFSGKSLQPKFSKLNPLPGIAKMFSAQTGAELLKAILKSLLMGSTAGFFLWHHWPEMMRLISESPMTAMKNALNLVGLCSLLVVLSIIPMVAFDVIFQIYSHIKKLRMSRQDIRDEYKQMEGDPHVKGRIRQMQRAAARRRMMEDVPKADVIVTNPTHYSVALQYDENKMSAPKVVAKGAGLIALRIREIATENRVPILEAPPLARALYRHAEIGQQIPGQLYAAVAEVLAWVWQLKRWRLAGGQRPVKPENLPVPEALDFLNEKDTDG

SEQ ID NO: 8747 - protein, 143 aa, Enterobacter cloacae
PQYSHDGDHRREIMRKWLWILLFPLAAQAAGEGAWQASSIGLTLNHRGESISSRPLSASEPVSGQMTLVAWNYTLTGPTPAGLRVRLCSLTRCAEIEGQSGTTQAFNGVSAQEPLRFIWEVPGGGRLIPALKVQRNEVLVNYR

SEQ ID NO: 8748 - protein, 532 aa, Enterobacter cloacae
LGLTAMKTRKIGLANYLAYGSGDFLGAGTTALTAAWLLYFYTTFCGLTPIEATFIFAAARVLDAVVSPLMGFLTDNFGTTWLGKRFGRRKFFILLGIPCVFSYSLMWVGDMSFWYYLLTYLIFDIVYTMILVPYETLVPEMTDDFKQKTKFSGARISMAQMSAILASFLPGILLTHFGKDNAISFFYASLVFSVLCALMLTFVWFFTWERPREEWSEAALRAEEEKKKLTLGQSLNRLFVELSSTLRIKIFRQHLGMYLGGYIAQDVFNAVFTYYVVFVLMQEASMASNLLGTMAIFQFLAVIGMIPLCIRFGPAPSYRMVVVLFGLASLSYAVLYYAGLSDVYALLLLISAVAGLGRGGINYVPWNTYTYIADVDEVITGQRREGIFAGIMTLTRKASQAGAVMLVGIVMQMSGFVSGQKVQPAEVSHTILMILSVGTILVLFCGFLVSLRFKLNLQTHSTLREETAKMRESGHAMPEAVTPQARATVEMLAGMPYESLWGNNNIGYLNRNKPAAPSLKDRAVLNSTYNRG

SEQ ID NO: 8749 - protein, 187 aa, Enterobacter cloacae
PMANWHTIDELHDISADLPRFTQAFTELATRLGLDIAPLEADHISLRCHQNATAERWRRGFEQCGELLSENIINGRPICLFKLHAPVTVAHWQFTVVELPWPGEKRYPHEGWEHIEIVLPGEPETLNARALTLLSDEGLSQPGIFVKTSSPKGERERLPNPTLAVTDGNVTVKFHPWTIEQIVASEA

SEQ ID NO: 8750 - protein, 254 aa, Enterobacter cloacae
VKFKEDDMALLEICCYSVECAVTAQRHGADRIELCAAPKEGGLTPSSGVLKSARQAITIPVHPIIRPRGGDFCYTAGEFSAMLEDIALVRDLGFPGLVIGVLDEDGNIDLPRMRQVMRAARGMAVTFHRAFDMCQDPIQAFDTLAELGVARVLTSGQQSSAEKGLKLITELKAHSGVPIIMAGAGVRASNLELFLNAGVEELHSSAGKWIPSPMRYRNTGLSMSTDAEADEYSRYGVDGESVAVMKSLIERHHV

SEQ ID NO: 8751 - protein, 153 aa, Enterobacter cloacae
IQLCIWPFLFIPGDFPATSRGAVFPHKNNSWLFGMGKMHTSELLKHIYDINLSYLLLAQRLISQDKPSAMFRLGVNEEMATMLGGLTLPQMVKLAETNQLVCQFRFDNPQTITRLTQESRVDDLQQIHTGILLSTRLLNEISQPDDVARKKRA

SEQ ID NO: 8752 - protein, 172 aa, Enterobacter cloacae
VKGNNMTGMSNVTKLAGEPSGQEFLVFTLGDEEYGIDILKVQEIRGYDQVTRIANTPAFIKGVTNLRGVIVPIVDLRVKFSQGDVEYNDNTVVIVLNLGQRVVGIVVDGVSDVLSLTADQIRPAPEFAVTLSTEYLTGLGALGERMLILVNIEKLLNSEEMALLDIAANHVA

SEQ ID NO: 8753 - protein, 202 aa, Enterobacter cloacae
RLYREPIPTRLTSASPTDSAMKALCLCLRESAEGVVHPFLALIVGLMMICDARAVTSQSFRVSATVVPGCSVSTGTGGRFGTLDFGTRNGVDNTPVSTSFVADGALSIACTPGVALSMSINGGQNYSSVRRMTRSGGTEVVGYRLYSSSSLAANSEIGVNQAIPITYTNSNNIALPLFGVALLTGFSLPGTYSDQLTVTLSW

SEQ ID NO: 8754 - protein, 799 aa, Enterobacter cloacae
CQGYAMAIDARQLKPAMMILLCVSTSAFAETGDDSLPPPPDARTMNGEAVFQLALVLNHYDTGLVVPVTQREGAWFISGADLLRAGLPPAHVPAGEVNLSTLTSVRAEYDSTAQRLLLTVPRDWVAARITPFSEQNTHSKPHYGRGALLNYDVYTNHSEHTGGQASVWHEFRYFNEDYSFSSTGYARQNFTGNSGQQEGYVRYDSTFLITNEEDATTWTVGDVISDALSWSTNVRMGGISYGRDFSLRPDLVTWPLPAFSGEAAVPTSVDLFINGYRSGSTRLQPGPFTLTNLPYINGAGDAVLVTTDALGRQVSTTLPFYVSSDLLKQGLSDGAVTLGSLRRNYGIENFDYGPAAGSGSYRYGVTDWLTLEGHAEGAESLALGGAGTVLKLGRFGVVNTSWTQSRMRGDSGGQINWGYQYNTSEFSVATQHTRRDRGFGNLALYDQPTVYDENDNPVASLSRNTDQYSLTFNLGGYGNIGAAWIGVESFDSKKTELLNLSWSRNLWGSSSIYLAASRDQQRGDWTVALSLQVPLGERDSAAVTFENTPDAGSTQRINYNHSMPSDGGFSWNMAWANQSRSSNYQQATLGWRNNNVELQGGGYGEKGMMTWWGEAMGSVVLMDGELFAANKINDAFVVISTDGHPDVPVSYENQPVGKTNNKGYLLVSGVSAYYPASYRIDTLNLPADTRLKETERRVAIRRHNGYLVDFPMEQERVASVILHDAQGNAIPVGSQVRRASRSSAVVGYDGLAWLENLNDVNPLEVITPEGKRCTATLTVGANPEHKLQTYGPLTCREAP

SEQ ID NO: 8755 - protein, 590 aa, Enterobacter cloacae
LSTSHSDSRAFPFRKCKVPVACADNTVNKSMRRCCMLNRIRVVTMLMMVLVIFALLQLTSGGLFFSSLKQNQDSFAASNDLRMQQSELTTTWDLMLQTRINLSRSSARMMMDPNNQQSSAKTELLKNARATLADAAKHYDAFKKIAPQPAMAQASANIDEKYQAYFAGLTELVQFLEKGNMDAYFAQPTQGMQNALGAALGEYAKASGELYHSAFTQSQNDYRFAKWQMAVLALALVIVLVAVWYGIRHILLNPLGRVIAHIRDIGRGDLTKTLSVSGRNEITELATSVDHMQRSLIDTVANVREGADAIYTGTSEIAMGNNDLSSRTEQQASALEETAASMEQLTATVKQNADNARQASQLAESASDTAQRGGRVVDGVVKTMHDIADSSKKIADIISVIDGIAFQTNILALNAAVEAARAGEQGRGFAVVAGEVRNLASRSANAAKEIKALIEDSVSRVDTGSVLVESAGETMNDIVNAVTRVTDIMGEIASASDEQSRGIDQVALAVSEMDRVTQQNAALVQESAAAAAALEDQASRLKMAVSAFRLTSKTTNTVSSRSVYGEAAPAPVTARTRAAVTGQDENWETF

SEQ ID NO: 8756 - protein, 291 aa, Enterobacter cloacae
EGAMTSPMPSGQTSLLLQMTQRLALSDAHFRRICQLIYQRAGIVLADHKRDMVYNRLVRRLRTLGLYDFGRYLSMLEANQNSAEWQAFINSLTTNLTAFFREAHHFPVLAEHARRRGGEYRVWSAAASTGEEPYSLAITLADTLGMAPGRWKVYASDIDTEVLEKARNGVYRQDELKTLSPQQLQRYFMRGTGPHEGLVRVRQELANCVEFAPVNLLDKQYNVPGPFDAIFCRNVMIYFDKTTQQDILRRFVPLLKPDGLLFAGHSENFSNLVREFSLRGQTVYALSKEKA

SEQ ID NO: 8757 - protein, 697 aa, Enterobacter cloacae
TRRTLMANLVAMLRLPGNLKSTQWQILAGPILILLILSMMVLPLPAFILDLLFTFNIALSIMVLLVAMFTQRTLEFAAFPTILLFTTLLRLALNVASTRIILMEGHTGAAAAGKVVEAFGHFLVGGNFAIGIVVFVILVIINFMVITKGAGRIAEVGARFVLDGMPGKQMAIDADLNAGLIAEDEAKKRRAEVTQEADFYGSMDGASKFVRGDAIAGILIMVINVVGGLLVGVLQHGMDMGHAAESYTLLTIGDGLVAQIPALVISTAAGVIVTRVSTDQDVGEQMVGQLFSNPRVMLLSAAVLGLLGMVPGMPNLVFLLFTAALLGLAWWMRGRETQPKAEPAPVKMPENTQAVEATWNDVQLEDSLGMEVGYRLIPMVDFQQDGELLGRIRSIRKKFAQDMGFLPPVVHIRDNMDLPPARYRILMKGVEIGSGDAYPGRWLAINPGTAAGTLPGEQTTDPAFGLAAIWIESALKEQAQIQGYTVVEASTVVATHLNHLIGQFSAELFGRQEAQQLLDRVTQEMPKLTEDLVPGVLTLTTLHKVLQNLLDEKVPIRDMRTILETLAEHAPLQSDPHELTAVVRVALGRAITQQWFPGTGEVQVIGLDTPLERLLLQALQGGGGLEPGLADRLLAQTQEALARQEMLGAPPVLLVNHALRPLLSRFLRRSLNQLVVLSNMELSDNRNIRMTATIGGK

SEQ ID NO: 8758 - protein, 388 aa, Enterobacter cloacae
IRHTTEVKMMKVWPVKHSPLLRQPERFIARDELKSLIQKVTHNLVNIHDKTGEFLLRLDDGRVIDTKGWAGWEWTHGVGLYGIWQYYCQTGDEGMREVIDSWFTDRFAEGATTKNVNTMSPFLTLAYRYEETKNPAWLPWLESWAEWAMNDMPRTEHGGMQHITLAEENHQQMWDDTLMMTVLPLAKIGKLLNKPEYVEEAIYQFLLHVQNLMDRETGLWFHGWNYDGNHNFVRARWARGNSWLTIVIPDFLELVDLPENNAVRRYLVQVLNAQTAALAKFQDESGLWHTLLDDPESYLEASATAGFAYGILKAVRKRYVGAEYAEVAEKAIRGIVKNISPEGELLQTSFGTGMGSDLAFYRQIPLTSMPYGQAMAILCLTEYLRKYF

SEQ ID NO: 8759 - protein, 110 aa, Enterobacter cloacae
QKYVQKNLFPLDDVIDNVQEETKDLDIGDLQVAQKVVMEKITQSVESVCEKTYSTKWETSDLITFDNKDKYARISKNNTGRKIRSEFNRINAGFIKELEEFIKETLKVSE

SEQ ID NO: 8760 - protein, 206 aa, Enterobacter cloacae
YLQENHMVLVTRPAPDFTAAAVLGNGEIVENFNFKQHTNGKATVLFFWPMDFTFVCPSELIAFDKRYEEFQKRGVEVVGVSFDSEFVHNAWRNTPVENGGIGAVKYAMVADIKREIQQAYGIEHPDAGVALRGSFLIDANGIVRHQVVNDLPLGRNIDEMLRMVDALQFHEEHGEVCPAQWEKGKEGMAASPDGVAKYLSENVSSL

SEQ ID NO: 8761 - protein, 1048 aa, Enterobacter cloacae
RGRKRMKILSLRLKNLNSLKGEWKIDFTAEPFASNGLFAITGATGAGKTTLLDAICLALYHETPRLNKVSQAQNDLMTRDTAECLAEVEFEVKGVAYRAFWSQNRARNQPDGNLQAPRVELARCEDGKILADKVTDKLEQTAALTGLDYGRFTRSMLLSQGQFAAFLNAKPSDRAELLEELTGTEIYGQISAMVFEKHKAARNALEMCEAQAAGVVLLSEEQQQHLQQSLQALTDEEKILLAQQQSQQKDFQWLTRNDELIREQQRAAASQQQAQQALTDAAPQLAKLQLAQPAAQLRPLWEHQQEQTARLSQTAERIVEVNTRLLDRAAQRACIRNGAQRNREQLQTEHTALTQWLTEHDRFRQWGQEIAGWRAHFTQLNRDKNQLVAKAARMAELRQKLAEMPESTLTLTAEDLATAMEQQAQSRALRQRLTALHARYQPLQKRLRQNAESVQKAQAEQGKLNETLILRRQQFKEKNQHYADLKALCEREATIKDLENYRAQLEAGKPCPLCGSREHPAVVQYQALELTDNQRRRDALEKEVAALKEEGLLVLGQVNALTQQIQRETEEAQALSQEEQALTKEWLEVCTSLNIALNIQDDIALWMSAQEQYERQLYQLSQRLTLQNQLIEQEGQARQYQQQLTATRQALAASLESLSLSVPDEGAESAWLSARESEYTLWQEKQAQHGTIQERINALMPILETLPVTDDTEADAVIPEKWRGIHDECVSLQSQLTTLQQQETLERERLQQSQAQFNAALTASCFADREAFLSALLDEASIRQLEQQKQTLENQLQQTTALSVQASQQLQAHQAQRPEGLETDAATLQAQLHQLAQQLRDNTTHQGEIRQQLKQDADNRLHQQALMQQIEEAARQADDWGYLNALIGSSTGDKFRKFAQGLTLDNLVWLANQQLNRLHGRYLLQRKASDALELEVVDTWQADAIRDTRTLSGGESFLVSLALALALSDLVSHKTRIDSLFLDEGFGTLDSETLDTALDALDALNATGKTIGVISHVEAMKERIPVQIKVKKINGLGYSRLDREFAVN

SEQ ID NO: 8762 - protein, 313 aa, Enterobacter cloacae
FNDKAVEIIMLWFKNLMVYRLSRDVSLHAEEMEKQLAAYSFTPCGSQDMAKTGWVPPMGSQSDALTHASSTGQIIVCARKEEKILPTPVVKQALEAKIFKLEAEQGRKLKKTEKDSLKDEVLHSLLPRAFSRFSQTMMWIDTVNGLIMVDCASAKKAEDTLALLRKSLGSLPVVPLALETPIELTLTEWVRSGTAAQGFQILDEAELKALLEDGGVIRAKKQELVSDEIAVHIEAGKVVTKLALDWQQRIQFVMCDDGSVKRLKFCDELRDQNEDIDREDYAQRFDADFILMTGELAALIQNLVEGLGGEAQR

SEQ ID NO: 8763 - protein, 273 aa, Enterobacter cloacae
RRDVMDKKIGFIGCGNMGKAILGGLIASGQVLPGQIWVYTPSPDKVAALRDEYGVNAAESAQEVAQVADIVFGAVKPNIMIKVLSEITSSLNKETLVVSIAAGVTLDQLARALGHDRKIVRAMPNTPSLVNAGMTSVTPNALVTSEDVADVLNIFRCFGEAEVIAEPMIHPVVGVSGSAPAYVFMFIEAMADAAVLGGMPRAQAYKFAAQAVMGSAKMVLETGKHPGELKDMVCSPGGTTIEAVRVLEDRGFRSAVIEAMEKCMEKSEKLSKS

SEQ ID NO: 8764 - protein, 299 aa, Enterobacter cloacae
TSGMIMKKTLLAAGAVLALSSSFTVNAAENDKPQYLSDWWHQSVNVVGSYHTRFGPQIRNDTYLEYEAFAKKDWFDFYGYMDAPVFFGGNTDAKGIWNHGSPLFMEIEPRFSIDKLTGTSLAFGPFKEWYFANNYIYDMGRNKSGRQSTWYMGLGTDIETGLPMSLSMNVYAKYQWQNYGAANENEWDGYRFKVKYFVPITQLWGGNLSYIGFTNFDWGSDLGDNDFRDLNGRKARTNDSIASSHILALNYDHWHYSVVARYWHNGGQWNDDASLNFGNGDFSVRSTGWGGYLVVGYNF

SEQ ID NO: 8765 - protein, 440 aa, Enterobacter cloacae
QIYEKHYHYKWQTVVLLQRLFSVPRKFIILLSYYCHGSFMRILHTSDWHLGQNFYSKSRAAEHEAFLNWLLETAQAHEVDAIIVAGDIFDTGSPPSYARELYNRFVVNLQQTGCHLVIVAGNHDSVATLNESRDILAFLNTTVVASAGHAPQILKKRDGTPGAVLCPIPFLHPRDIVQSQAGLSGSEKQQHLLQAITRYYHQQHTEACALRGDQAIPIIATGHLTTVGASKSDAVREIYIGTLDAFPAQNFPPADYIALGHIHRAQIIGGCEHIRYCGSPISLSFDETGKAKSVHLVSFTGGKLSAVETLEVPVTQPLAVLKGDLAAITAQLDQWRGTALNPPVWLDIEITTDDYLYDMQRKIQTLTEDLPVEVLLVRRSREQREKILLNAQRETLSELRVEEVFARRLAHEEVDEARRTRLNELFAQTLHSLHDEDENA

SEQ ID NO: 8766 - protein, 212 aa, Enterobacter cloacae
SSAHTLLLQQLAATGQRKRMNFLAHLHLAHLADSSLSGNLLADFVRGNPAEAYSPEVVDGIFMHRRIDVLTDNLPEVTEAKTWFRPETRRVAPITLDVMWDHFLSRHWPQLSPDMSLPEFVRYAHAQVSIILPDSPPRFVNLNNYLWSERWLERYREMDFIQNVLNGMASRRPRLDALRDSWHDLDEHYDALETRFWQFYPRMMTQAKNKEL

SEQ ID NO: 8767 - protein, 90 aa, Enterobacter cloacae
GNSTMKNLIAELLVKLAQKEEESKELVAQVEALEIVVTALLRQMAKPEQEALIDNVEGALEKARPDSQVPAEDAELLQQYVKKLLRHPRS

SEQ ID NO: 8768 - protein, 64 aa, Enterobacter cloacae
AMPTRPPYPREARIVTVEKGNGDQTVTWYQLRADHPKPDSLISEHETEQEALDAKRRYEDPEKS

SEQ ID NO: 8769 - protein, 368 aa, Enterobacter cloacae
LFFHLFCMQRNVAAETVNHQIFEPQHDNFHGLVVKSAGMITNCRIACIANREAGFYSVDNQNNEECLVRIGIDLGGTKTEVIALSEQGEQLFRHRLPTPRDDYHQTIETIARLVDMAEQATGETGTVGMGIPGSISPYTGVVKNANSTWLNGQPFDKDLSQRLNREVRLANDANCLAVSEAVDGAAAGAQTVFAVIIGTGCGAGVAFGGRSHIGGNGTAGEWGHNPLPWMDEDELKYRAEVPCYCGKQGCIETFISGTGFATDYHRLSGQPLKGNEIMRLVEEQDPVAELALSRYEMRLAKSLAHVINILDPDVIVLGGGMSNVDRLYATVPTLVKQWVFGGECETPIRKAVHGDSSGVRGAAWLWPE

SEQ ID NO: 8770 - protein, 238 aa, Enterobacter cloacae
LKYDKTGQSMARRILVVEDEAPIREMVCFVLEQNGFQPVEAEDYDSAVNQLNEPWPDLILLDWMLPGGSGLQFIKHIKREAMTRDIPVVMLTARGEEEDRVRGLETGADDYITKPFSPKELVARIKAVMRRISPMAVEEVIEMQGLSLDPTSHRVMTGENPLDMGPTEFKLLHFFMTHPERVYSREQLLNNVWGTNVYVEDRTVDVHIRRLRKALELSGHDRMVQTVRGTGYRFSTRF

SEQ ID NO: 8771 - protein, 432 aa, Enterobacter cloacae
RVLERLSWKRLVFELILCCIPALILGAIFGYLPWFLLVAVTGLLVWHFWNLLRLSWWLWVDRSMTPPPGSGSWEPLLYGLHQMQMRNKKRRRELGSLIKRFRSGAESLPDAVILTTEEGTIFWCNGLAQQLLGLRWPDDNGQNILNLLRYPEFTLYLKKRDFSRPHNLKLNNGRHLEIRVMPYSDRQWLMVARDVTQMHQLEGARRNFFANVSHELRTPLTVLQGYLEMMQEQTLEGAPREKALHTMREQTFRMEGLVKQLLTLSKIEAAPSLALNDIIDVPMMLRVVEREAQTLSHNQHTLSFDVDNTLKVLGSEDELRSAISNLIYNAVNHTPKGTHIAVRWQHTPAGAEFSVEDNGPGIGPEHLPRLTERFYRVDKARSRQTGGSGLGLAIVKHAVSHHESRLNIESTLGKGTRFSFVIPERLIAKKSA

SEQ ID NO: 8772 - protein, 441 aa, Enterobacter cloacae
GFMTHHLKSRDIIALGFMTFALFVGAGNIIFPPMVGLQAGEHVWTAAFGFLLTAVGLPVLTVIALAKVGGGVDSLSTPIGKVAGVLLATVCYLAVGPLFATPRTATVSFEVGIAPLTGDGAMPLFIYSLIYFAIVILVSLYPGKLLDTVGNFLAPLKIVALIVLAVAAIVWPAGPISSAMDAYQNAAFSNGFVNGYLTMDTLGAMVFGIVIVNAARSRGVTEARLLTRYTIWAGLMAGVGLTLLYLALFRLGSDSATLVDQSANGAAILHAYVQHTFGGAGSMLLAALIFLACLVTAVGLTCACAEFFAQYLPLSYRTLVFILGIFSMAVSNLGLSHLIQVSIPVLTAIYPPCIVLVVLSFTRPWWHNSTRIIAPAMFISLIFGILDGIKASAFAEILPAWTQRLPLSEQGLAWLMPSVVALVLAIIWDRAAGRQVTSNAH

SEQ ID NO: 8773 - protein, 484 aa, Enterobacter cloacae
STATNCLTTGLKAPWFFVFFVLNGKILMESTNKLKRGLSTRHIRFMALGSAIGTGLFYGSADAIKMAGPSVLLAYIIGGAAAYIIMRALGEMSVHNPSASSFSRYAQENLGPLAGFITGWTYCFEILIVAIADVTAFGIYMGVWFPAVPHWIWVLSVVLIICAVNLMSVKVFGELEFWFSFFKVATIIIMILAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTNGSPFVLTFQHMGIAFAASILNFVVLTASLSAINSDVFGVGRMLHGMAEQGSAPKVFAKTSRRGTPWVTVLVMTVALLFSVYLNYIMPENVFLVIASLATFATVWVWIMILLSQIAFRRRLSPEEAKALKFKVPGGVPTTIVGLIFLVFIIGLIGYHPDTRISLYVGFAWIVLLLVGWMFKCRRDRQLAEAQ

SEQ ID NO: 8774 - protein, 614 aa, Enterobacter cloacae
RQFHQRGFVMLNAWHLPVAPFVNQNKDNLVITLWLAGDNQPERVTLRAEVDNEETSLKMHKVRSQPQPGVTAWRANIDLRSGQPRRRYGFKLLWNNRQLWFTPQGFSRFPPARLEQFAVDHPDNGPQWVNDQVFYQIFPDRFARSEKRTVDQDKVYYHHAVGHDIILKKWDEPLTAQAGGSTFYGGDLDGISEKLPYLKKLGVTALYLNPVFKAPSVHKYDTQDYRHVDEQFGGDEALLRLRHNTQKEGMRLILDGVFNHSGDSHAWFDRHNQSMGGACHNPDSPQRDWYSFDENGRALDWLGYPSLPKLDFQSPSLVNEIYGGDDSIVRHWLKAPWNMDGWRLDVVHMLGEAGGARNNLQHVAAITRSAKAARSEAFVFGEHFGDARQWLQADAEDAAMNYRGFTFPLWGFLANTDISYDPQHIDAETCMAWMENYRAGLSHQQQLRMFNQLDSHDTARFKSLLGKDVARLPLAVTWLFTWPGVPCIYYGDEVGLDGNNDPFCRKTFPWEPEKQDQDLFSLYQRMATLRKQSQALRYGGCQVMYAHDNVVVFVRVYNQQRVLVAINRGEACEVVLEDSPLLAGKMWKSKEGKATFQGSVLTLPAISAAVWFGS

SEQ ID NO: 8775 - protein, 157 aa, Enterobacter cloacae
RDGVAGAGARQRDMGANGRRHFAEPPAYFRSAQSLLAGCGLAVAENRAAGQLGIAGRWVAVLVSGVAGRVAVVPEAGVIASGRRAGADGGVDLGMAAGCRSSGMVGAGCQQMAAVAGDAADGAVSGLAPADSGGRLGKSGLGYRAACRPDAAAARRR

SEQ ID NO: 8776 - protein, 368 aa, Enterobacter cloacae
TMPPVFKSRVYVMRVADFSFELPESLIAHYPMPERSSCRLLSLDGPTGALTHGTFTDLLDKLNPGDLLVFNNTRVIPARLFGRKASGGKIEVLVERMLDDKRILAHIRASKAPKPGAELLLGDDESIKATMTARHDALFEVEFNDERTVLDILNAIGHMPLPPYIERPDEEADRELYQTVYSQKPGAVAAPTAGLHFDEPLLEKLRAKGIEMAFVTLHVGAGTFQPVRVDSIEDHIMHSEYAEVPQEVVDAVLAAKARGSRVVAVGTTSVRSLESAAQAAKSELIEPFFGDTQIFIYPGYQYKVIDALVTNFHLPESTLIMLVSAFAGYQHTMNAYKSAVEQKYRFFSYGDAMFITYNPQALNERVGE

SEQ ID NO: 8777 - protein, 110 aa, Enterobacter cloacae
MSFFISDAVAATGAPAQGSPMSLILMLVVFGLIFYFMILRPQQKRTKEHKNLMNSIAKGDEVLTNGGLVGRVTKVAENGYIAIALNDTTEVVIKRDFVAAVLPKGTMKAL

SEQ ID NO: 8778 - protein, 624 aa, Enterobacter cloacae
SQLFPKGTAVLNRYPLWKYIMLVVVIIVGLLYALPNLYGEDPAVQITGARGVAASEQTLIQVQKTLQEEKITAKSVALEEGAILARFDTTDTQLRAREALMGVLGDKYVVALNLAPATPRWLAALNAEPMKLGLDLRGGVHFLMEVDMDTALGKLQEQNIDSLRSDLRDKGIPYTTVRKEDNYGMSITFRDSAARDQAVTYLSQRHRDLVITSQGSNQLRAVMTDARLSEAREYAVQQNINILRNRVNQLGVAEPLVQRQGADRIVVELPGIQDTARAKEILGATATLEFRLVNSSVDQAAAASGRVPGDSEVKQTREGQPVVLYKRVILTGDHITDSTSSQDEYNQPQVNISLDSAGGNIMSNFTKDNIGKPMATLFVEYKDSGKKDANGRAVLVKEEEVINIANIQSRLGNSFRITGISNPNEARQLSLLLRAGALIAPIQIVEERTIGPTLGMQNIKQGLEACLAGLAVSIIFMIFFYKKFGLIATSALIANLVLIIGIMSLLPGATLTMPGIAGIVLTLAVAVDANVLINERIKEELSNGRSVQQAIEEGYKGAFSSIFDANVTTLIKVLILYAVGTGAIKGFAITTGIGVATSMFTAIVGTRAIVNLLYGGKRVKKLSI

SEQ ID NO: 8779 - protein, 127 aa, Enterobacter cloacae
QQAGGRMKSVINWFEIPVADMDRAIKFYESVMQVALRREKMDVAELAVFPHEDPATGGALAKFDGVTPSSQGAIIYLHTDNLAATLDRIASAGGECVFGPLELPQGIGTIALFTDSEGNRVGLHQPV

SEQ ID NO: 8780 - protein, 156 aa, Enterobacter cloacae
WGETMAIWVDADACPNVIKEILFRAAERVQMPLTLVANQNIRVPPSRYIRSLRVPAGFDVADNEIVRLCDAGDLVITADIPLAADVLAKGAAALNPRGERYSPATIREKLTMRDFMDTLRSSGVQTGGPDSLSQRDRQQFAAELDKWLLEVKRRPA

SEQ ID NO: 8781 - protein, 222 aa, Enterobacter cloacae
PTSGRFCGTVWLPQACHSVPLCSKVSATSTAIISLQPSVIRQQGEHLVMNPPIFLVGPRGCGKTTVGLELARLCQSQFVDTDHWLQENAGKTIADIVEDEGWESFRARETATLEAVTAPSTVIATGGGIILASYNRQFMREKGVVIYLCAPVSTLVGRLEAFPEEGQRPALTAKPLSEEVSEVLAERDALYREAAHHVVDASASPEKVAIQIITALRLACAS

SEQ ID NO: 8782 - protein, 106 aa, Enterobacter cloacae
WIFLYKYKGQFMLQSNEYFSGKVKSIGFTSSSTGRASVGVMAEGEYTFGTAEAEEMTVVSGALNVLLPGETEWKVYSAGQVFNVPGHSEFHLQVAEPTSYLCRYLK

SEQ ID NO: 8783 - protein, 341 aa, Enterobacter cloacae
TCCTAASASKSCLSEECVVAQEYTVEQLNHGRKVWDFMRWDYWAFGISGFLLILSIVIMGVKGFNWGLDFTGGTVIEITLEKPVDMDQMRESLQKAGFEEPLLQNFGSSRDIMVRMPPVHDANGSQELGSKVVQVINETTSQDATVKRIEFVGPSVGADLAQTGAMALLVALISILIYVGFRFEWRLAAGVVIALAHDVVITMGILSLFHIEIDLTIVASLMSVIGYSLNDSIVVSDRIRENFRKIRRGTPYEIFNVSLTQTLHRTLITSGTTLMVILMLFLFGGPVLEGFSLTMLIGVSIGTASSIYVASALALKLGMKREHLIQQKVEKEGADQPSILP

SEQ ID NO: 8784 - protein, 247 aa, Enterobacter cloacae
PCLPTAKVIASASINRYESKPMTRRADRLFQIVQILRGRRLTTAAHLAERLGVSERTVYRDIRDLSLSGVPVEGEAGSGYRLMSGFDLPPLMLTNKESEALMVAIRLLKTWGGESLSRELESAQEKVLAILPEESRRKAEQTRIYAPDIALQPHSRSGFDVIHQAISALRVLALHYRDEAGQLTWREVQPLGLFFWGEHWLLAAWCERRDDYRCFRLDRCLHITLTERRFSESADRSLADFLRKVKQ

SEQ ID NO: 8785 - protein, 196 aa, Enterobacter cloacae
RYPGLMISLFVTTMVIQLCNGSVGPILALFIKSMAPDSSNIAFLSGMIAAVPGVSALMSAPRLGKLGDRIGTARILMATLIIAVILFFAMSFVTTPLQLGILRFLLGFADGAMLPAVQTLLVKYSSDQVTGRIFGYNQSFMYLGNVAGPLIGASVSAMAGFRWVFAATAVVVLLNIIQLAFALRRRRRIAEAKSAR

SEQ ID NO: 8786 - protein, 120 aa, Enterobacter cloacae
RTRLNVELHIKDGAMKTTILITLLSGLCLMASAHAEEKTLTPQQQRMTTCNQQATSQSLKGDARKTYMSDCLKNGATKPGEKSLTPQQQKMRECNAQATQQMLKGDDRSKFMSACLKKQA

SEQ ID NO: 8787 - protein, 399 aa, Enterobacter cloacae
RVSHGCGSPKISYFPRYPPLYNLGKCFRIFPKMMNDEFYDSHGNIREAWHQQLSQDDSYRSGLRFARRIRLARIVGLAALFVPLASVLVSQFLSGVWWLLLVGWVFVWPHLAWQLAFRSAEPHRSEIVNLKIDAILAGVWMGLTGFNALPTAALIMMIGMNMMGSGGCRLFLTGLALLALSALLTVQSTGTPVLLTSEPLALWLTLPVLVVYPMLFAWLSHRTAIRLAEHKRRLELMSTRDGMTGVFNRRHWETLLRYEFEACRRSHRHATILLIDIDHFKTINDTWGHDVGDEAIVAITRQLQLTLRSGDYIGRFGGDEFAVIMSGTPADSAIAAMSRVHERLVNMPLHGAPTARLCISVGVAPWGAQFTHYREWLKAADVALYKAKNAGRGRTEVAA

SEQ ID NO: 8788 - protein, 230 aa, Enterobacter cloacae
RKAIKMKATLAILTIGVVPVSEVLPLLTEHVSEQQITHLSLLGKLSREEVMEDYAVGEGEDPLATLLSDGKLAHVSRQKIERALQGVIEVLDNQDYDVILLMSTAPVKGLSARNAILLEPMRIIPPLVASIVDGHQVGVIVPVEELLDNQTVKWAALEHTPLYALANPFWDSEAKLIAAGQELIDRGADVLMLDCLGFHQRHRDLLQKALDVPVLLSNVLMARLASELLV

SEQ ID NO: 8789 - protein, 398 aa, Enterobacter cloacae
ACRGISPRHCVTTLDCFSDVGEKMKFELDTTDGRARRGRLVFDRGVVETPAFMPVGTYGTVKGMTPEEVEATGAQIILGNTFHLWLRPGQEIMKLHGDLHDFMQWKGPILTDSGGFQVFSLGDIRKITEQGVHFRNPINGDPIFLDPEKSMEIQYDLGSDIVMIFDECTPYPADWDYAKRSMEMSLRWAKRSRDRFDSLQNKNALFGIIQGSVYEDLRDISVKGLVEIGFDGYAVGGLAVGEPKEDMHRILEHVCPQIPADKPRYLMGVGKPEDLVEGVRRGIDMFDCVMPTRNARNGHLFVTDGVVKIRNAKHKSDTSPLDSECDCYTCRNYSRAYLHHLDRCNEILGARLNTIHNLRYYQRLMAGLRKAIEEGKLESFVTDFYQRQGRDVPPLNVD

SEQ ID NO: 8790 - protein, 472 aa, Enterobacter cloacae
EQVSLAMPHSYDYDAIVIGSGPGGEGAAMGLVKQGARVAVIERYHNVGGGCTHWGTIPSKALRHAVSRIIEFNQNPLYSDHSRLLRSSFADILNHADTVINQQTRMRQGFYERNHCEILQGNAHFVDEHTLALECHDGSVETLTAEKFVIACGSRPYHPADVDFSHPRIYDSDSILSLHHEPRHVIIYGAGVIGCEYASIFRGMEVKVDLINTRDRLLAFLDQEMSDSLSYHFWNSGVVIRHNEEYEKIEGCDDGVIMHLKSGKKLKADCLLYANGRTGNTDSLQLENIGLETDSRGQLKVNSMYQTALPHVYAVGDVIGYPSLASAAYDQGRIAAQALVKGEATAHLIEDIPTGIYTIPEISSVGKTEQQLTAMKVPYEVGRAQFKHLARAQIVGMSVGTLKILFHRETKEILGIHCFGERAAEIIHIGQAIMEQKGGGNTIEYFVNTTFNYPTMAEAYRVAALNGLNRLF

SEQ ID NO: 8791 - protein, 387 aa, Enterobacter cloacae
GVSTMKMNLPPFIEIYRALIATPSISATEEALDQSNESLINLLAGWFSDLGFNVEVQPVPGTRHKFNLLASTGHGAGGLLLAGHTDTVPFDDGRWTRDPFTLSEHDNKLYGLGTADMKGFFAFILDALRDVDVTKLKKPLYILATADEETSMAGARYFSENTSIRPDCAIIGEPTSLQPIRAHKGHISTAVRVLGQSGHSSDPARGVNAIELMHDAIGRIMTLRDDLKERYHYEAFTVPYPTLNLGSLHGGDASNRICACCELHMDIRPLPGMTLSDLDGLLNEALAPVSERWPGRLTVSELHPPIPGYECPPDHQLVQVVEKLLGEKTDVVNYCTEAPFIQTLCPTLVLGPGSINQAHQPDEYLETRFIKPTRELITQVVHHFCWH

SEQ ID NO: 8792 - protein, 840 aa, Enterobacter cloacae
GLISGVCMALVVEFTCELPNGVHARPASHVETLCNTFISQIEWHNLRTDRKGNAKSALAVIGTDTLAGDACRLVIQGEDEQNAYQQLEQWLREEFPHCDAPLAEAINNERDPLPESLARLNPTLFRALPVCSGSAQGVLTLLASLDLNALSDLAEAKDEEDEQLALDNGLTLLVKNIELRALDSDSTASAILEAHRSLATDTSLRQHLLSGVNRGLSCAQAIIATANHFCETFSRSSSTYLQERVLDVRDVCYQLLQHIYGEARFPSPGQLTQPSVCLADDLTPGQFLELDKTLLKGLLLKSGGTTSHTVILARSFNIPTLVGVDGESLLQWRNQSVFIDGNAGAVVVDASDAVARYYRQEARVQQALREQQGIWLDREARTADGLRVEIAANIAHAVEAQAAFENGAEGVGLFRTEMLYMDRSSAPGENELYNIFCQALESANGRSIIVRTMDIGGDKPVEYLKIPAENNPFLGYRAVRIYEEYAVLFTTQLRAILRASAHGSLKIMIPMISSMEEILWVKEKLAEAKQQLRAEHIPFDEKIPLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMGSPAIPATKARLAQLDSRACRQLLNQAMACRTSLEVEHLLAQFRMNQQDTPLVTPRCISLDNDWNSKEEVMKGMTDNLLLAGRCRYPRKLEADLWAREAVFSTGLGFSFAIPHSKSEHIEQSTISVARLKAPVMWGDEEAQFIIMLTLNKHAAGDQHMRIFSRLARRIMHEDFRNALVNASSGEAIASLLQHELEL

SEQ ID NO: 8793 - protein, 889 aa, Enterobacter cloacae
WGDWVFMNEQYSALRSNVSMLGKVLGDTIKDALGENILDRVETIRKLSKSSRAGNEANRQELLTTLQNLSNDELLPVARAFSQFLNLANTAEQYHSISPKGEAASNPEVIARTLRKLKDQPDLNEATIKKAVESLSLELVLTAHPTEITRRTLIHKMVEVNNCLKQLDNKDIADYERNQLMRRLRQLIAQSWHTDEIRKHRPSPVDEAKWGFAVVENSLWEGVPNYLRELNEQLEENLGYRLPVDFVPVRFTSWMGGDRDGNPNVTAEITRHVLLLSRWKATDLFLKDIQVLISELSMVEATPELRALAGEEGASEPYRFLMKKLRGQLMATQAWLEARLKGQRLPKPEGLLSQNEQLWEPLYACYKSLQACGMGIIANGELLDTLRRVKCFGVPLVRIDVRQESTRHTEALGELTRYLGIGDYESWSEADKQAFLIRELNSKRPLLPRNWEPSNDTREVLNTCKAIVDAPKGSVAAYVISMAKTPSDVLGVHLLLKEAGIDYALPVAPLFETLDDLNNANDVMTQLLNIDWYRGFIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEVTISSLSLYTSAILEANLLPPPEPKESWCRIMDELSDISCDLYRGYVRENKDFVPYFRSATPEQELGKLPLGSRPAKRRPTGGVESLRAIPWIFAWTQNRLMLPAWLGAGAALQKVVEDGKQSELETMCRDWPFFSTRLGMLEMVFSKADLWLAEYYDQRLVKPELWALGKELRELLEGDIKVVLDIANDSHLMEDLPWIAESIQLRNIYTDPLNVLQAELLHRSRLAEEEGKEPDPRVEQALMVTIAGVAAGMRNTG

SEQ ID NO: 8794 - protein, 303 aa, Enterobacter cloacae
NRLFVGPASTSAAGQYPGIHTMHHDITQILTNLINGTTPLRQVHFANSATSAPELALQVDFPRLEIAIEGSMKDQAGCVLQQGDVLYVPAGGWNNPQWQAPATTLSILFGKQQLGFSLLHWNGIDVRNLTKQHVARRGPRIGSLLLQTLHEMQMQPHEQQTARLIIASLLSHCVDLLGSQIQTASRSQALFEAIRVYIDEHYATPLTRESVAQAFYISPNYLSHLFQKTGAVGFNEYLTHTRLEHARQLLKGYDLKVKEVAHACGFVDSNYFCRLFRKNTERSPSEYRRQYHSQLTGKVISPE

SEQ ID NO: 8795 - protein, 392 aa, Enterobacter cloacae
LLAIKSGHPLHNPYNPRVILYHSGRIMTPEHLPTEQYDAQLAEKVVRLQSMMTPFNAPVPEVFRSPVSHYRMRAEFRIWHDGDDLYHIIFDQQTKSRIRVDSFPAASELINQLMTLMIDGVRNNPVLRNKLFQIDYLTTQSNQAIVSLLYHKALTDEWREQAEALRDALRAQNINVHLIGRATKTKIMLDQDYIDERLPVAGKEMVYRQVENSFTQPNAAMNVQMLEWALKATEGSKGDLLELYCGNGNFSLALARNFERVLATEIAKPSVAAAQYNIAANHIDNVQIIRMAAEEFTQAMNGVREFNRLQGIDLKSYQCETIFVDPPRSGLDSETEKMVQAYPRILYISCNPETLCKNLETLSQTHKVERLALFDQFPYTHHMECGVLLTAR

SEQ ID NO: 8796 - protein, 243 aa, Enterobacter cloacae
RQLRGGDCFPATTRIRTVKRGRVMELYLDTANVAEVERLARIFPIAGVTTNPSIIAASRESIWDVLPRLQKAIGPEGMLFAQTMSRDAEEMVAEAKRLNNALPDIVVKIPVTAQGLIAIKALKKEGITTLGTAVYSAAQGLLAALAGAKYVAPYVNRVDAQGGDGIGMVQELQSLLELHAPESMVLAASFKTPRQALDCLLAGCEAITLPLDVAQQMLDTPAVESAIEKFEQDWKNAFGNLNL

SEQ ID NO: 8797 - protein, 371 aa, Enterobacter cloacae
GRTVMDRIIQSPGKYIQGADVLTRLGDYLKPLANRWLVVGDKFVLGFAEETLRQSFKKAGLHAEIAPFGGECSQNEIDRLKKLADSADCLAVLGIGGGKTLDTAKALAHFMDVPVAIAPTIASTDAPCSALSVIYTDSGEFDRYLMLPHNPNMVIVDTKVVAGAPARLLAAGIGDALATWFEARACSRSGATTMAGGKCTQAALALAELCYNTLVEEGEKAMLAAEQHVVTPALERIIEANTYLSGVGFESGGLAAAHAIHNGMTAVPDAHHFYHGEKVAFGTLTQLVLENAPVEEIETVAALCHSVGLPITLAQLNIKEDIPAKMRLIAEASCAEGETIHNMPGGVTPDQVYAALLVADQYGQRFLQEWE

SEQ ID NO: 8798 - protein, 306 aa, Enterobacter cloacae
IMNIRDLEYLVALAEHRHFRRAADSCHVSQPTLSGQIRKLEDELGVMLLERTSRKVLFTQAGLLLVDQARTVLREVKVLKEMASQQGEAMSGPLHIGLIPTVGPYLLPQIIPMLHQTFPKLEMYLHEAQTHQLLAQLDSGKLDCAILALVKESEAFIEVPLFDEPMMLAIYEDHPWANRDRVPMADLAGEKLLMLEDGHCLRDQAMGFCFEAGADEDTHFRATSLETLRNMVAAGSGITLLPALAVPHERKRDGVVYLPCIKPEPRRTIGLVYRPGSPLRSRYEQLAEAIRGAMDGHFDSALKQAV

SEQ ID NO: 8799 - protein, 294 aa, Enterobacter cloacae
PTCSIKITRQFMATKLQDGNTPCLAATPSDPRPTVLLFDSGVGGLSVYDEIRQLLPDLHYIYAFDNVAFPYGEKSEDFIVERVVEIVTAVQKRYPLALAVIACNTASTVSLPALREKFPFPVVGVVPAIKPAARLTANGIVGLLATRGTVKRPYTRELIERFANECQIAMLGSAELVEMAEAKLHGETVSLEELRRILRPWLRMQEPPDTVVLGCTHFPLLQEELLKVLPEGTRLVDSGAAIARRTAWLLEHEAPDAKSADANIAFCMAITKETEQLLPVLRRYGFETLEKLAL

SEQ ID NO: 8800 - protein, 828 aa, Enterobacter cloacae
RFNCRSGKWLPGRSQGVIMSVIAQAGAKGRQLHKFGGSSLADVKCYLRVAGIMTEYSQPGDMMVVSAAGSTTNQLISWLKLSQTDRLSAHQVQQSLRRYQSELIAGLLPADVADGLISAFTHDLERLAALLDSGITDAVYAEVVGHGEVWSARLMAAVLQHLGVEAAWLDARDFLRAERAAQPQVDEGLSYPLLQQLLVQHPGKRIVVTGFISRSNAGETVLLGRNGSDYSATQIGALAGVSRVTIWSDVAGVYSADPRKVKDACLLPLLRLDEASELARLAAPVLHARTLQPVSGSDIDLQLRCSYTPDQGSTRIERVLASGTGARIVTSHDDICLIEFQVPAGQDFKLAHKDIDTILKRAQVRPLAVGVHNDRQLLQFCYTAEVVDSALKILDEAGLPGELRLRQGLALVAMVGAGVTRNPLHCHRFWQQLKGQPVEFTWQSEEGISLVAVLRKGPTESLIQGLHTSLFRAEKRIGLVLFGKGNIGSRWLELFAREQVTLSARTGFEFILAGVVDSRRSLLNYEGLDASRALAFFNDEAVEQDEESLFLWMRAHPYDDLVVLDVTASEQLADQYLDFASHGFHVISANKLAGASSTDKYRQIHDAFEKTGRHWLYNATVGAGLPVNHTVRDLIESGDSILALSGIFSGTLSWLFLQFDGTVPFTDLVDQAWQQGLTEPDPRVDLAGKDVMRKLVILAREAGYDIEPGQVRVESLVPAGCEEGSVDHFFENGDELNEQMVQRLEAANEMGLVLRYVARFEANGKARVGVEAVRPEHPLAALLPCDNVFAIESRWYRDNPLVIRGPGAGRDVTAGAIQSDINRLAKLL

SEQ ID NO: 8801 - protein, 112 aa, Enterobacter cloacae
LIEEKNMARIIAVTACPSGVAHTYMAAEALESAAKSKGWEVKVETQGSIGLENELTAEDVAAADMVILTKDIGIKFEERFAGKTIVRVNISDAVKRADAIMNKIDAHLAQIA

SEQ ID NO: 8802 - protein, 782 aa, Enterobacter cloacae
RSPALRGGFVFRYRSSLMTNRIQRLKDALFASPREISLERALLYTASHQQTEGEPVILRRAKATAYILDHVNIAIRDEELIAGNRTVKPRAGIMSPEMDPYWLLKELDQFSTRPQDRFEIGEADKQIYRDVLYPYWEKRSMKDFINSQMTDEVKAAVGTQIFSVNQTDKGQGHIIIDYPHLLNNGLGALVEQMREYCARDAQNTFYAAALILLEASQRHILRYAALAETLATVCDDASRREELRKIAEISRHNAEHKPQTFWQACQLFWYMNVILQYESNASSLSIGRFDQYMLPFYQASLTQGDDPAFLKELLESLWVKCNDVVLLRSTSSARYFAGFPTGYTALLGGLTESGRNAVNVLSFLCLDAYQSVQLPQPNLGVRVNELIDRPFLLKTAETIRLGTGIPQIFNDEVVVPAFLNRGVSLEDARDYAVVGCVELSIPGKTYGLHDIAMFNLLKVMEIAMLENEGNSTLSYEGLLDHIRAKINHYIALMVEGSNICDIGHRDWAPVPLLSSFISDCLESGKDITDGGARYNFSGVQGIGIANLSDSLHALKGLVFEQHRLSFDELLAVLKANFATPEGEKVRARLINRFEKYGNDIDDVDNISAELLRHYCKEVEKYRNPRGGQFTPGSYTVSAHVPLGAVVGATPDGRFAGEQLADGGLSPMLGQDMQGPTAVLKSVSKLDNYLLSNGTLLNVKFTPATLEGDAGLQKLADFLRAFTQLKLQHIQFNVVNAETLREAQQRPQDFAGLVVRVAGYSAFFVELSKEIQDDIIRRTAHQL

SEQ ID NO: 8803 - protein, 139 aa, Enterobacter cloacae
GVSDASTGRARRFQCYRGRLNMTVITGRHLVAVTACVSGVAHTYMAAERLEKLCQQEKWSVNIETQGALGVECELTEDDIRRADVVLLITDIELAGSERFEHARYVKCGISAFLRDPQKVMGAVRKMLAAPQHTQVILD

SEQ ID NO: 8804 - protein, 337 aa, Enterobacter cloacae
RNPMLNTLIVGASGYAGAELVSYVNRHPHMTITALTVSAQSNDAGKLISDLHPQLKGVVDLPLQPMSDISEFTDGVDVVFLATAHEVSHDLAPQFLAAGCVVFDLSGAFRVNDGAFYEKYYGFTHQHPDLLEKAVYGLAEWSADKLKEANLIAVPGCYPTAAQLSLKPLIDAGLLDLNQWPVINATSGVSGAGRKAAISNSFCEVSLQAYGVFNHRHHPEITTHLGADVIFTPHLGSFPRGILETITCRLKPGVTKEQVNEVFTQAYADKPLVRLYDKGVPALKNVVGLPFCDIGFAVQGEHLIVVAAEDNLLKGAAAQAMQCANIRFGFPETQALI

SEQ ID NO: 8805 - protein, 260 aa, Enterobacter cloacae
GVMMNPLIIKLGGVLLDSEEALERLFNALVNYRESHQRPLVIVHGGGCVVDELMKGLNLPVKKKNGLRVTPADQIDIITGALAGTANKTLLAWAKKHHIASVGLYLGDGDSVKVTQLDEELGHVGLAQPGSPKLINTLLEGGFLPVVSSIGVTEEGELMNVNADQAATALAATLGADLILLSDVSGILDGKGQRIAEMTAAKAEQLIDQGIITDGMIVKVNAALDAARTLGRPVDIASWRHAEQLPALFNGTPIGTRILA

SEQ ID NO: 8806 - protein, 472 aa, Enterobacter cloacae
AQRHRAKISSLRKFVMALWGGRFTQAADQRFKQFNDSLRFDYRLAEQDIVGSVAWSKALVTVGVLTADEQQQLEEALNNLLEEVRLDPQQILQSDAEDIHSWVEGKLIDKVGQLGKKLHTGRSRNDQVATDLKLWCKETVGELLAANRQLQGALVDTAQNNQDAVMPGYTHLQRAQPVTFAHWCLAYVEMLARDESRLQDTLKRLDVSPLGSGALAGTAYEIDREQLAGWLGFASATRNSLDSVSDRDHVLELLSNASIGMVHLSRFAEDLIFFNSGEAGFVELSDRVTSGSSLMPQKKNPDALELIRGKCGRVQGALTGMMMTLKGLPLAYNKDMQEDKEGLFDALDTWLDCLHMGALVLDGIQVKRPRCQEAAQQGYANSTELADYLVAKGVPFREAHHIVGEAVVEAIRQGKALEELALADLQKFSAVIGDDVYPILALQSCLDKRAAKGGVSPKQVAQAIADAKNRLV

SEQ ID NO: 8807 - protein, 268 aa, Enterobacter cloacae
KQQNHNIIARVTQLSLCFFRAVEHKPRVNNHSQSQVNRLILFSGIVPTGLWKDSTIVMGVRAQQKEKTRRSLVEAAFSQLSAERSFASLSLREVAREAGIAPTSFYRHFRDVDELGLTMVDESGLMLRQLMRQARQRIAKGGSVIRTSVSTFMEFIGNNPNAFRLLLRERSGTSAAFRAAVAREIQHFIAELADYLELENHMPRAFTEAQAEAMVTIVFSAGAEALDVSIEQRKQLEERLVLQLRMISKGAYYWYRREQEKLAHQNDE

SEQ ID NO: 8808 - protein, 125 aa, Enterobacter cloacae
VMKQSGQDKGTLLLALIAGLSINGTFAAVFSSIVPFSIFPIIALVLTVYCLHQRYLNRTMPVGLPGLAAACFILGVLLYSTVVRAEYPDIGSNFLPAVLSVALVFWIGSRMRSRKSELPEYRRVL

SEQ ID NO: 8809 - protein, 207 aa, Enterobacter cloacae
RGSLRSGEDADLVLHSCTKYLNGHSDVVAGVVIAKDPDVVTELAWWANNIGVTAGAFDSYLLLRGIRTLSPRMDVAQRNAQAIVDFLKTQPLVKKLYHPSLPENQGHEIAARQQKGFGAMLSFELDGDEQTLRRFLSGLSLFTLAESLGGVESLISHAATMTHAGMAPEARAAAGISETLLRISTGIEDSEDLIADLENGFRVAAKG

SEQ ID NO: 8810 - protein, 297 aa, Enterobacter cloacae
GMSFFHANQREALNQSLAEVNGQINVSFEFFPPRTSEMEQTLWSSIDRLSSLKPKFVSVTYGANSGERDRTHSIIKGIKDRTGLEAAPHLTCIDATRDELRAIAQDYWNNGIRHIVALRGDLPPGSGKPEMFAADLVGLLKDVADFDISVAAYPEVHPEAKSAQADLLNLKRKVEAGANRAITQFFFDVESYLRFRDRCVSAGIDVEIIPGILPVSNFKQAKKFADMTNVRIPLWMSKMYEGLDDDPETRKLVGANIAMDMVKILSREGVKDFHFYTLNRAEMSYAICHTLGVRPAL

SEQ ID NO: 8811 - protein, 733 aa, Enterobacter cloacae
HCKGSIAMSMSDETNNAASAGKCPFHQGGVDHSAGAGTGSKDWWPKQLRIDLLNQHSNRSNPLGEDFDYRKEFSKLDYSALKGDLKALLTDSQPWWPADWGSYAGLFIRMAWHGAGTYRSVDGRGGAGRGQQRFAPLNSWPDNVSLDKARRLLWPVKQKYGQKISWADLFILAGNVALENSGFRTFGFGAGREDVWEPDLDVNWGDEKAWLTHRDPEALAKRPLAATEMGLIYVNPEGPNASGEPLSAAAAIRATFGNMGMNDEETVALIAGGHTLGKTHGAGEATHVGTDPEASPIEAQGLGWASTHGTGIGADAITSGLEVIWSQTPTQWSNYFFENLFKYEWVQTRSPAGAIQFEAVDAPEIMPDPFDPSKKRKPTMLVTDLTLRFDPEFEKISRRFLNDPQAFNEAFARAWFKLTHRDMGPKARYIGPEVPKEDLIWQDPLPQPVFHPTQEDIESLKAEIAASGLSVSELVSVAWASASTFRGGDKRGGANGARLALAPQRDWDVNAAAVRALPALEAIQRTTNKASLADIIVLAGVVGVEQAAKAAGVYVNVPFTPGRVDARQDQTDIEMFNLLEPVADGFRNYRAQVDVSTTESLLIDKAQQLTLTAPELTVLIGGLRVLGANFDGSKNGVFTNREGVLSNDFFVNLLDMNTQWKATDDSNELFAGSDRASGEVKYTATRADLVFGSNAVLRALAEVYASSDAHEKFVRDFVAAWARVMDLDRFDVK

SEQ ID NO: 8812 - protein, 376 aa, Enterobacter cloacae
LPIVCHNIFMVLGQERHMKELVHILKNTRQHLMTGVSHMIPFVVSGGILLAVSVMLYGKGAVPDAATDPNLKKLFDIGVAGLTLMVPFLAAYIGYSIAERAALAPCAIAAWVGNSFGAGFFGAIIAGIFGGIVVWYLKKLPVPKVLRSVMPIFIIPIIGTFITAGIMMWGLGEPVGALTTGLTQWLQGMQQGSIVVLAIIIGLMLAFDMGGPVNKVAYAFMLICVAQGVYTVVAIAAVAICIPPLGLGLATLINRKSFTGEEREAGKAALVMGCVGVTEGAIPFAAADPLRVIPSIMLGSACGAVTAAVMGAQCYAGWGGLIVLPVVEGKLGYIVAVAVGAVVTAISVNVLKSFARKNAKQVEEKEDDLDLDFEIN

SEQ ID NO: 8813 - protein, 328 aa, Enterobacter cloacae
TRKHCVKRNSVHRILPGWWCALLATAPSLLSYRRRSRMTLSAAQRISCDVVETHAEVARIFNIQRYSLNDGRGIRTVVFFKGCPHRCPWCANPESISPKIETVRRESKCLHCAPCLRDVDECPSGAFEPIGRDVTLEELVSEVMKDDVFFRSSGGGVTLSGGEVLLHAPFATKFLQGLRRFGVHTAIETAGDAPLSRLMPLARQCDEVLFDLKIMDADLAQSIVAMNLPRVLDNFRQLVADGINVIPRVPLIPGYTLNETNMARVLAFLLPSGIRQLHLLPFHQYGEPKYRLLGQEWGMRQATPPTEDEVSAMRQLAEREGFNVTVGG

SEQ ID NO: 8814 - protein, 629 aa, Enterobacter cloacae
GLRHPSYIVDALTMIKKVSLLTVFSVTAFSGWAQESADSLVVTANRFEQPAKTVLAPTSVVTREDIERWQATSVVEIMSRLPGVDIAQSGGMGSTSSTFIRGTESRHVLVLIDGIPLNNAGISNVPDLSQIPTSLIQRIEYIRGPRSALYGSDAIGGVINIITGRDKPGAEISAGVGSKGYQNYNGAFQQVFDKTKITMAGDYTYTRGFDIAAKDAPRQPDRDGFMSKSLFGSVEQQFTDSVSGFVRGFGYDNRSAYDGYDHYGATGIDGRPDTRQVYSQNWDTGLRYNQGIFQSQLVAGYGRSKDQNYDPKKGRYADSATMDDVKQYTTQWLNTVEVGHGNIGAGLDWQKQKTQAGTGYLEKGYEQRNTGVFLSAMQQFNSVTLEAAARNDDNSNFGNHATWQTSAAWEFIDGYRIIGSYGTAYKAPTMSQIHSKDYGNPDLKPEESKQWEGGFEGLTGPVNWRVTGYRNDIDNLINSDPRTYRYYNVDEARIKGIEATAQFDTGPVGHQISYDYVDPRNAKTNEVLARRSKQQVKYQLDWQVWDLDWNLAYRYLGTRYDVAVDPNTYATERVKMGGVSLWDVAVSYPVTSHLTVRGKIANLFDKDYETVYGYQTAGREYTLSGSYTF

SEQ ID NO: 8815 - protein, 327 aa, Enterobacter cloacae
RQIFLSRVNLMTTQRLQRDWRLPTAGLAVLVLLMAGFALHEHWNAFIQWCLATQITLHRYLVMYLLQLNNHQYRGGLWLLTGAFLYGVLHAVGPGHGKFIVTTYLTTNKESQLAARVVPFIGSLMQGVSAIAFVFILAVGLNLASGDISTSRWYVEKISALLIAAFGAFIIYQALSSLRPRKMAISAIKPLHQHNEHCGCGHHGVGVDLAKSDWKTRLGVVLAIGARPCSGAIMILMFSNALGIISWGIAAVMTMSLGTALSIMGLSLAVRYARERTVAWFGGGTSLNWIMPMVKIAGGVVLILFATVLFLTVIPVSAGGDYIAAGC

SEQ ID NO: 8816 - protein, 333 aa, Enterobacter cloacae
GLMMNIKATIERIPGGMMLVPLVLGAILNTLAPNTGAYFGGFTKGMITGTVPILAVWFFCIGASINLRATGTVLRKSGTLVITKIAVAWVVAMICAMFIPENGIQTGFFAGLSVLAIVSAMDMTNGGLYASLMNQYGTKEESGAFVLMSLESGPLMTMLILGSAGLASFELHHFVGAILPFLIGFALGNLDHDLRDFFSKATPVLIPFFGFALGNTINLNVILETGLLGIVLGVAVIVITGIPLIIADRVIGGGNGTAGVAASSAAGAAVANPVIIAQINPAFEPVAASATALVAASVIVTAILVPIITALYARRFGHVPESRTEHEAVEMHH

SEQ ID NO: 8817 - protein, 176 aa, Enterobacter cloacae
VREKELIVPPGDASLTGRSGTTLNGLFLREVKIMPLSPYISFAGNCAEATAFYQQAVGAELLYKITFGEMPKDENSEEGCPSGMNFPDTAIAHSNVRIAGSDIMMSDGLPPGSSTQYAGFTLVLDTQDVDEGKRWFDNLSDGGNVEMAWQETFWAHGFGKVTDKYGVPWMINVVKS

SEQ ID NO: 8818 - protein, 342 aa, Enterobacter cloacae
RGMEMSYKTVAALAFTSMFSISTLLSPAHAEEQEKALNFGIISTESQQNLKPQWEPFLKDMETKLGIKVNAFFAPDYAGIIQGMRFNKVDIAWYGNLSAMEAVDRANGQVFAQTVAADGSPGYWSVLIVNKDSPINNLNDMLAKRKELTFGNGDPNSTSGFLVPGYYVFAKNNVSASDFKRTVNASHETNALAVANKQVDVATNNTENLDKLKTSAPDKLKEIKVIWKSPLIPGDPIVWRKNLSENTKDKVYDFFMNYGKTPEEKAVLARLGWAPFRASSDLQLVPIRQLALFKQMQGVKDNKGLKDEEKTSKVSEIQAQLDDLDRLTAALGAMTSVNKAVQ

SEQ ID NO: 8819 - protein, 222 aa, Enterobacter cloacae
PRRTPCRASGRSKYQPGRLLYARSRRQRMTLQPAFTLAVQDAQQSFRRLLKAMSEPGVIVSLHQLSQGWLPLNLASTSVLLTLADNDTPVWLSGALLNDIASQNLRFHTNAPLVEQPQQAVFAVADEQISHEQLNALSEGSAVAPETSATLILQVSSLSGGRMLRLTGAGIADERMVAPQLPECIIHELTERPHPFPLGIDLILTCGERLLAIPRTTHVEVC

SEQ ID NO: 8820 - protein, 289 aa, Enterobacter cloacae
NACNGSAPMANLSGYNFAYLDEQTKRMIRRAILKAVAIPGYQVPFGGREMPMPYGWGTGGIQITASVIGEADVLKVIDQGADDTTNAVSIRNFFKRVTGVNTTEKTEDATLIQTRHRIPETPLTEDQILIFQVPIPEPLRFIEPRETETRTMHALEEYGIMQVKLYEDIARFGHIATTYAYPVKVNGRYVMDPSPIPKFDNPKMDMMPALQLFGAGREKRIYAVPPYTRVESLDFDDHPFTVQEWDEPCAICGSKHSYLDEVVLDDTGKRMFVCSDTDYCRQQSEANSQ

SEQ ID NO: 8821 - protein, 215 aa, Enterobacter cloacae
DCRRQTGRPGAGAPQGRARSYRPRLASGKKGVLMGRLIWLMGPSGSGKDSLLSALRQREHSQLLVAHRYITRAANAGSENHIALSEQEFFTRTGQNLLALSWHANGYYYGVGIEIDLWLHAGFDVLVNGSRAHLPQARARYEAALLPVCLQVSPDVLRSRLQKRGRENAREIDQRLERAARYTPSGCHLLNNDGSLLQSVETFLSLIRQKEKQHA

SEQ ID NO: 8822 - protein, 359 aa, Enterobacter cloacae
TARARHLSGKHHDAGNRRERHTSSGGVIMTTPTHPQQVAKSASAKKMLMSDLMQTIGILPILILIVAVFGFIAPNFFTESNLLNITRQASINIVLAAGMTFIILTGGIDLSVGSILGTTAVAAMVVSLIPEFAMLSIPAALMLGMVLGLFNGALVAFAGLPPFIVTLGTYTALRGAAYLLADGTTVINSNINFEWIGNNYLGPIPWLVVIALAVIVVCWFILRRTTLGVHIYAVGGNMQAARLTGIKVWLVLLFVYGMSGLLSGLGGVMSASRLYSANGNLGTGYELDAIAAVILGGTSFVGGIGTITGTLVGALIIATLNNGMTLMGVSYFWQLVIKGAVIIIAVLIDKYRTRHHQSA

SEQ ID NO: 8823 - protein, 287 aa, Enterobacter cloacae
MMPLISLADGLAHAREHRYALGAFNVLDSHFLRALFAAAKQERSPFIINIAEVHFKYVSLESLVEAVKFEAARHDIPVVLNLDHGLHFEAVVRALRLGFSSVMFDGSTLSYEENIRQTREVVKMCHAVGVSVEAELGAVGGDEGGALYGHADEAFFTDPQLAREFVDLTGIDALAVAIGNAHGKYKGEPKLDFPRLDAIRQQTGLPLVLHGGSGISDTDFRRAIELGIHKINFYTGMSQAALAAVEQRMANRQPLYDEFAELLLGIEEAITDTVAEQMRIFGSAGQA

SEQ ID NO: 8824 - protein, 163 aa, Enterobacter cloacae
ESMKILFLMLLFLTAFAHADEIGSQYKKQAEAGDARAQYYLADTWFSSGDSAQAALWAEKAAKGGDVDAMALLSQIHFSQGDYAQAKALAQQANIAGSKRGAIMLARVLVNTQAGKTDYPQAIALLQSATEDIDSDSAVDAQQLLGLIYANGVEVPQDDVQAA

SEQ ID NO: 8825 - protein, 62 aa, Enterobacter cloacae
WFKRSSALSRTGYAEYWAGMLFRQGEKGFITPNKQKALYWLNLSCTEGFDTGCEEFDALSGE

SEQ ID NO: 8826 - protein, 163 aa, Enterobacter cloacae
QFVSSLAHLCAIFIKQYHRQKWGFALYSLPFSAHCRHLAGVFQRVNTFEDTHMQLPHCPKCNSEYTYEDNGMFVCPECAHEWNDAEPAQDSDALIVKDANGNLLANGDSVTVVKDLKVKGSSSMLKIGTKVKNIRLVEGDHNIDCKIDGFGPMKLKSEFVKKN

SEQ ID NO: 8827 - protein, 252 aa, Enterobacter cloacae
ALHLRSEALIGMHLSRHPTSYPTRWQEIAAKLEVELRTHYRCGDYLPAEQQLADRYEVNRHTLRRAIDQLVERGWVQRRQGVGVLVLMRPFDYPLNAQARFSQNLLDQGSHPTSEKLLSVLRPASRHVADALGIQEGDNVVHLRTLRRVNGVAVCQIDHYFADLTLWPVLQHFASGSLHDFLQDATGIVLKRTQTRISARRAQAKESKVLEIPNMAPLLCVRTLNHRDGDVNATEYSVSLTRADMIEFTMEH

SEQ ID NO: 8828 - protein, 150 aa, Enterobacter cloacae
MHFDTSTRQRWMRVLAHSQPAALAARMNALGLTPDYDTIRAPEIGLVQIQARMGGTGERFFAGDATLTRAVIRLKSGTLGYGYVLGRDKTHAERCAAIDALLQEQPHFQTLMETLIAPLEADRAARLAARQAEVNTSRVDFFTLVRGDNA

SEQ ID NO: 8829 - protein, 421 aa, Enterobacter cloacae
KQRSGDRTDRTGQSARRGDRRDLPRRRRTPSRGGQTAPDGDKRMIINNVRLVLENEVVNGSVEVRDGVIRAFAETQSRSPDAMDGEGGWLLPGLIELHTDNLDKFFTPRPKVDWPAHSAMSSHDALMVASGITTVLDAVAIGDVRDGGDRLENLEKMIKAVEETQKRGLNRAEHRLHLRCELPHHTTLPLFEKLVGREPVSLVSLMDHSPGQRQFANIEKYREYYQGKYSLSDAEMARYEEEQLALAAQWSQPNRLSIAAMCRDRNIALASHDDATHDHVRESHQLGSVIAEFPTTFEAAEASRKHGMNVLMGAPNIVRGGSHSGNVAASKLASLGLLDILSSDYYPASLLDAAFRVADDEGNSFTLPQAIRLVTKNPASALNLHDRGEIAEGKRADLVLAHRKGEHVHIDHVWRQGKRVF

SEQ ID NO: 8830 - protein, 257 aa, Enterobacter cloacae
AGMPTVTTMASASRSTSGCTRALTCWSTARGRISRRLAPGTKRRCSRSVCRFPRTFCVAGCKSGGAKTRARSTSGWNGRRVTPRRVAISSITTEVCYSQSRPFYPLSARRRNSMPDCQLRPATADDAPIVYALICELKQAEFDHQAFHAGYLANLQDHNMRYQLAELDGQIIGMIGLHMQFHLHHARWIGEIQELVVMPQARGLKVGSQLLAWAEDVARQAGAELTELSTSVKRVDAHRFYVREGYTQSHFRFTKPL

SEQ ID NO: 8831 - protein, 255 aa, Enterobacter cloacae
RGVMSLTITLTGTGGAQLVPVFGCDCAACRRARLQENYRRRPCSAAVKFNDAVTLLDAGIPHLMDDWPAGSFRQFLLTHYHMDHVQGLFPLRWGVGATIPVYGPPDDAGCDDLLKHPGLLDFSHTVEPFVTFELQGLRVTPLPLNHSKLTFGYLLESAHSRVAWLSDTAGLPDKTVTFLLNNQPQAMIVDCSHEPRPETPRNHCDLNTVVALNEVIGCPQVILTHISHQFDVWMMDNPLPSGIEAGYDGMVMVLD

SEQ ID NO: 8832 - protein, 515 aa, Enterobacter cloacae
SADIDIHRRSAMSRTPVLEMRHIAKTFGNFHALKGVDLTVFPGEIHALMGENGAGKSTLMKILAGAYTASSGDILIDGQPFHIKGPKDALAAGITLIYQEMQLAPNLTVAENIFLGSELSRGGLVQRKEMAAQAQAVIDRLGAQFSATDLVMKLTIAEQQQVEIARALHRNSRILVMDEPTAALSSRETHRLFELILRLRDEGMAIIYISHRMAEVYELSDRVSVLRDGQYVGSLTRDKLNASELVRMMVGRPLSDLFNKERDIPLGSPRLNVHHLTDGKKVQPCSLQVRSGEIVGLAGLVGAGRSELAQLIFGVRKATGGMIEVDGEPVVIHSPRAAIENGIGFLTENRKEQGLFLELAAQENITMATLERDATFGWLNRKKAQSISDDAIALLNIRVPHSQVRAGGLSGGNQQKLLISRWVAIGPRILILDEPTRGVDVGAKSEIYRIMNQMARKGVAILMISSELPEVVGMSDRVYVMREGSIAGELHGRDISQENIMTLATGVNDTHHQAV

SEQ ID NO: 8833 - protein, 335 aa, Enterobacter cloacae
STNTVPDTIKVHNNNTLREEYSMRLKPLVTALCAGALLAATPFAQAKDLKSIGVTVGDLANPFFVQITKGAELEARKLAGDNVKVTLVSSGYDLGQQVSQIDNFIAAKVDMIILNAADSKGIGPAVKRAKEAGIVVVAVDVAAEGADATITSDNTQAGEMACKYITDRLKGKGNVVIINGPPVSAVQNRVEGCQTEFRRHPDIKVLSDNQNAKGSREGGLEVMTSLLAANPKIDGVFAINDPTAIGADLAAKQAQRNEFFIVGVDGSPDGEEALKRENSLFVATPAQDPQVMAAKAVEIGYDILQGKPAPKEPVLIPVTMIDKKNVGTYKGWTVK

SEQ ID NO: 8834 - protein, 271 aa, Enterobacter cloacae
GHIYREAGHMQTVIRVEKLSKTFHHNKALHAVDLTVQQGEMVALLGPSGSGKSTLLRHLSGLITCDKTPESRVELLGNTVQHAGRLASDIRKSRAQTGYIFQQFNLVNRLTVLENVLIGALGSTPFWRTCLRWFSLSQKQEALQALTRVGMAHFAHQRVSTLSGGQQQRVAIARALMQKAKIILADEPIASLDPESARIVMETLRDINQNDGITVVVTLHQVDYALRYCERIVALRQGHVFFDGASHQFDNERFDHLYRSVNRVEERAQAA

SEQ ID NO: 8835 - protein, 281 aa, Enterobacter cloacae
SGAVTPFSLSLKGEGTKPKGANMQTITLPPPKRSWFSLISWAVLLAVLVISWKGAEMDPLLLFRDSGNMATFAADFFPPDFSQWQDYLVEMAITLQIAVWGTALSVILSIPFGLMSAENIVPWWVYQPMRRLMDACRAINEMVFAMLFVVAVGLGPFAGVMALFIHTTGVLSKLLSEAVEAIEPGPVEGIRATGANKIEEILYGVLPQVMPLLISYSLYRFESNVRSATVVGMVGAGGIGVTLWEAIRGFQFQQTCALMVLIIVTVSLLDFLSQRLRKHFI

SEQ ID NO: 8836 - protein, 389 aa, Enterobacter cloacae
ADRAPASVPARYRPDPDLRRAPAGDPENHSRGGVLMYVAVKGGEKAIAAAHALQEHRRRGDDALPELSVAQIEQQLNLAVDRVMTEGGIADRELAALALKQASGDNVEAIFLLRAYRTTLAKLAVSEPVKTAEMRLERRISAVYKDIPGGQLLGPTYDYTHRLLDFTLLANGETPQLSVSDAEQDASPHVFSLLANQGLAKAEEDTGSTPDDITRTPPVYPCSRSSRLQQLMRGDEGYLLALAYSTQRGYGRNHPFAAEIRSGYLDVEIVPEELGFAVNIGELLMTECEMVNGFVAPENEDPHFTRGYGLVYGLSERKAMAMALVDRALQAPDYGEHIAGPAQDEEFVLAHADNVEAAGFVSHLKLPHYVDFQAELELLKRLQRERANG

SEQ ID NO: 8837 - protein, 279 aa, Enterobacter cloacae
SGAGRHGQTDVCLLRHRLLPPTERGEQPMKPLLSVNNLTHLYAPGKGFSDVSFELWPGEVLGIVGESGSGKTTLLKSISARLTPQNGDILYEGVSLYGMSEAERRRLLRTEWGVVHQHPMDGLRRQVSAGGNIGERLMATGARHYGNIRATAQHWLEEVEIPASRIDDLPTTFSGGMQQRLQIARNLVTHPKLVFMDEPTGGLDVSVQARLLDLLRGLVVELNLAVVIVTHDLGVARLLADRLLVMKQGQVVESGLTDRVLDDPHHPYTQLLVSSVLQN

SEQ ID NO: 8838 - protein, 229 aa, Enterobacter cloacae
EANMIHVENVSKTFVLHQQNGVRLPVLQNASLEVSNGECVVLHGHSGSGKSTLLRSLYANYLPDEGHIHIRHNNEWVDLVQAPARKVLEVRRSTIGWVSQFLRVIPRISALDVVMQPLLDLGVPRETCAAKAASLLTRLNVPERLWHLAPSTFSGGEQQRVNIARGFIVDYPILLLDEPTASLDSKNSAAVIELIEQAKARGAAIVGIFHDDAVRHRVADRLHPMGTNV

SEQ ID NO: 8839 - protein, 360 aa, Enterobacter cloacae
RGHYRYGCGTDAHLRQRGAGIMERKGIIAAGNMLVDHVHQIVQWPERGWLAEITHSERSTGGAPLNVLLTLAKMHVGLPLQAVGLIGEDSDGDYILAMLDQYHVNRQRVQRTTFAPTSMSQVMTDPSGQRTFFHSPGANRLLDLPAFDRLDGSLKIFHLGYLLLLDSLDMPDEEFGTRSARLLAQMRDQGYETSLDLVSRKGDPRYQPLVLPALRHLDYLVINELEAGEFSGLEIRDGHDALNMAHIADAATQLLAAGVRQRVVIHCPEGAWGEAPGEKGQWVPSWKLTQDEIIGSVGAGDAFCAGFLYGCHESLPLTESIYLAHACARASLLAANAIDGAKTLAELQTFIQENGQAAFS

SEQ ID NO: 8840 - protein, 147 aa, Enterobacter cloacae
ELFNWSKVMKKVVTVCPYCASGCKIHLVVDNGKIVRAEAAQGKTNQGTLCLKGYYGWDFINDTQILTPRLKTPMIRRERGGKLEAVSWNEALDYVATRLSAIKAKYGPDAIQTTGSSRGTGNETNYVMQKFARAVIGTNNVDCCARV

SEQ ID NO: 8841 - protein, 575 aa, Enterobacter cloacae
HGPSVAGLHQSVGNGAMSNAINEIDNTDLVFIFGYNPADSHPIVANHVIRAKQNGAKIIVCDPRKIETARIADMHIALKNGSNIALLNAMGHVIIEENLYDQAFVASRTEGFEEYRKIVEGYTPESVEAITGVSAQEIRQAARMYAGAKTAAILWGMGVTQFYQGVETVRSLTSLAMLTGNLGKAHVGVNPVRGQNNVQGACDMGALPDTYPGYQYVKFPENREKFAKAWGVESLPAHTGYRISELPHRAAHGEVRAAYIMGEDPLQTDAELSAVRKGFEDLELVIVQDIFMTKTAAAADVILPSTSWGEHEGVYTAADRGFQRFFKAVEPKWDLKTDWQIISEIATRMGYPMHYNNTQEIWDELRHLCPDFYGATYEKMGELGYIQWPCRDESESDQGTSFLFKEKFDTPNGLAQFFTCDWVAPIDKLTDEYPMVLSTVREVGHYSCRSMTGNCAALAALADEPGYAQINTADAERLGIEDEALVWVNSRKGRIITRAQVSDRPNKGAVYMTYQWWIGACNELVTENLSPITKTPEYKYCAVNVEPIADQHAAEQYVIDEYNKLKARLRESAMG

SEQ ID NO: 8842 - protein, 62 aa, Enterobacter cloacae
DVLLSSRLVKTRILDMARTALNVVGNALAVLVIAKWEHKFDRKKALAYEREVLGRFDKTADQ

SEQ ID NO: 8843 - protein, 769 aa, Enterobacter cloacae
GHQTAEEPKPMPSRPPFFTSARGRLLIFNLLVVAVTLMVSGVAVLGFRHASQIQEQVQQQTLDDMTGSMNLARDTANVATAAVRLSQVVGALEYKGEAERLKQTQMALRHSLEQLADAPLAQQEPALVTRIIRRSNELQQSVTGMLERGQKRHLERNALLSALYQSQSYLRHLQDINRRYASNVPDARQLAEMDRLIVAAIDTPSPRATVQQLDAVTAMLPASALQPVVNLVLPDFNDELRKLAPLSKQLEESDLSISWYMFHIKALVAILNRDINQYVEQVAQASRLRTAQSHQELRSISVFISVFAVLALIITGCACWYIYRNLGSNLTAISRAMSRLAHGEQNVSVPALQRRDELGELARAFNVFARNTASLEHTTRLLKEKTSQMEVDRIERQGLEEALLHSQKMKAVGQLTGGLAHDFNNLLAVIIGSLELTDSASPDAPRITRALKAAERGAMLTQRLLAFSRKQSLQPHAVEMKPLLENLSELMRHSLPATLTLDIEAQTPAWPAWIDVSQLENAIINLVMNARDAMEGQNGVIKIRTWNQRVTRSDGRRQDMVALEVIDHGCGMSQEVKSQVFEPFFTTKQTGSGSGLGLSMVYGFVRQSGGRVEIESAPGQGTTVRLQLPRSTLPAFSNDAALATTAPTESELLVLVLEDEAGVRQTLCEQLHQLGYLTLEAENGEQALNMLDASPDIGMFISDLMLPGGLSGAEVIGHVRSHYPQLPVLLISGQDLRPAHNPQLPDVQLLRKPFTRAQLAQALRKVMVI

SEQ ID NO: 8844 - protein, 78 aa, Enterobacter cloacae
MMHSGSWGATIRSSAIPAPVRRSMRPPLRLETCKISVALVSGATALPSLRALSCSWLICSSATAKTACWGCSTSGALV

SEQ ID NO: 8845 - protein, 138 aa, Enterobacter cloacae
LISIPRYGSLCSLRALFDAVYAAVEMVKTFVIKLVACAIKEHMSLTQGDDALAVAQGVIHLMQRHHHGDAVVLIDVAQGFHHDAGGLRIQRGDRFIGQDNFGFLHQGAGNGDALLLSAGERGDALVGEMRHADAGQRL

SEQ ID NO: 8846 - protein, 302 aa, Enterobacter cloacae
YSNLIRGRATMTTQLLDGPGRTLECIHPKFMVDLVQGADAARHALLGPQQLQFRERLTQEIITQTRLRPWAMAGMLNENAALRLGLAEKLAGMLDPGHLALTRMSDRLVALRQQVNPRLPQPPGLLQQYEELSAHFNQRAAYKEKALAQRGLTVQAGEHSEQIFTRWRAGQYDGWSLAGRCFIVLEELRWGAFGDACRLANSDVAAMLKDNLRSMAANYLAQEINASPTTRHFYHQWLTTPASPGLIDYKDMLGWLGDWCQAEKHPVSWSVTQSWQTVALGMPRLCSAKRLVDGMVEEIFGT

SEQ ID NO: 8847 - protein, 528 aa, Enterobacter cloacae
GDSHGADLWFTACKMRCETDGAESTRKAMLRRKKVKPITLRDVTIIDDAKLRKAITAASLGNAMEWFDFGVYGFVAYALGKVFFPGADPSLQMIAALGTFSVPFLIRPLGGLFFGMLGDKYGRQKILAITIVIMSISTFCIGLIPSYATIGIWAPILLLICKMAQGFSVGGEYTGASIFVAEYSPDRKRGFMGSWLDFGSIAGFVMGAGVVVLISTVVGEENFLDWGWRIPFFLALPLGIIGLYLRHALEETPAFQQHVEKLEQGDREGLQDGPKVSFKEIATKHWRSLLTCIGLVISTNVTYYMLLTYMPSYLSHNLHYSEDHGVLIIIAIMVGMLFVQPIMGLLSDRFGRKPFIILGSVALFALAIPAFILINSNVLGLIFAGLLMLAVILNCFIGVMVSTLPAMFPTHIRYSALAAAFNISVLIAGLTPTLAASLVESTQNLMMPAYYLMVIAVVGLITGITMKETANRPLKGATPAASDIQEAKEILREHYDNVEQKIEDIDAEIEALQKKRSRLVDQHPRINE

SEQ ID NO: 8848 - protein, 247 aa, Enterobacter cloacae
RKHAMKPAILVVDDDVAVCELLQDVLSEHVFTVLTCHSGQDAVNRVQQDSGIALVLLDMILPDINGLQVLLQLQKQRPSLPVVMLTGLGSESDVVVGLEMGADDYIGKPFNPRVVVARVKAVLRRTGALDAEPAAPRVEGIAFNGWTLDTTRCELSDPQRNTVPLTQGEYGLLLALTQNARRVLSREQLLKLTHSESAEVFDRTIDVLIMRLRRKIEVNPHQPLLIKTIRGLGYVFATDVSHHEKAA

SEQ ID NO: 8849 - protein, 79 aa, Enterobacter cloacae
QVVTACVVRRTVNRNGRPHAPAQRKQPLNVIHMIMGKQKLPETPRGPVVHQVWNTRVQQGDRIVEFHRRATGATAIIFL

SEQ ID NO: 8850 - protein, 340 aa, Enterobacter cloacae
KRVDRCAALGVRFVAAKYVAVAQRAAFQADHRAGEGGIAGEEALAGAAHACLDLHQADLRRADRVVIRRQAERVHAGSQRSRLAVGQHAHPALTSGGVEVHSVLHGKFNHVGAGQADGVFRCVDVAVTVVEGAHAEQRGHVGDLQHLALFRLRAAGADARLGAFEHDTRRVLKKIMQGTAGEMLQNGPEGEVREVVVDLTDRHAVHPAQRAQVNDVVALLNPQRVRHVAGGRAQDRQQLFAGGVAALIEKVLAKTRLGIKRVVKRTHQHQHADALTTLDPAALHQLIDGTTQGVTIHFVAVGKLLLGRQVVSAAIVRAQLHFELCRNLLPAGGVTGRMSG

SEQ ID NO: 8851 - protein, 789 aa, Enterobacter cloacae
GKAFIMHTQTIFELSQEAERLLQLALNNLDSLKSMPIAKLDSTTAAMSGVNNNVLPLHFSARGVDAQQAMLNNELRKITRLEMVLAIVGTMKAGKSTTINAIVGTEVLPNRNRPMTALPTLIRHTPGQKEPVLHFLHVSPIDTLITQLQKKLCDKDRGKLARRLEIDKDMNTLLERIERGEAFEKHHLGAEPIFHCLKSLNDLVRLSQALGVEFPFSEYAAIEHIPVIEVEFVHLAGLDAHLGQLTLLDTPGPNEAGQPHLQKMLNEQLARASAVLAVMDYTQLKSISDAEVRQAISAAGKSVPLYALVNKFDQKDRNSDDEEQVRAMISGTLMKGNISPGQIYPVSSMWAYLANRARYEMNVHGRLPDHQDQRWVQDFAEAALGRRWRTADLDDIDHIRHAADLLWEDSLFEQPIRKLIYAAYANASLFALRSASHKLLNYAQNAREYLDFRHQGLTVAFDELELNIARLEEDMTMLRKRQSVVSDEVQHEVEEALNATDAFLLRQKDELHQALGDIFSRPSILDLAGREPSSLREDDADAIQQLVLDDEGQAQIVLSKIRSSCEQIMLNAQSRIGRELALRFDQLESTLARSLNEAMRPIETRIKEQLSHAGFRARISFPAFQANQLNFNTRGLFNDAIVQDTPPASQPAGAGSVRNTVSRWLNNPGWGWEEYVVTRTRYVIDIAQLHGKFTQHTDQFCDQIRKALAAQVDVSVTAGMATFFAEFSLCLTGLQESLRDSLAVRQQNEHSTRALSQLLKQSMTTAAWIQEDTRLLRDDIQTLFAAEQP

SEQ ID NO: 8852 - protein, 296 aa, Enterobacter cloacae
RIQHVNAGWFDGADDDLASAGSPADDPSTAEAETHTGERRAGMKPLLSVNGLMMRFGGLLAVNNVNLDLHKKEIVSLIGPNGAGKTTVFNCLTGFYKPTGGTIMLRDQHLEGLPGQQIARMGVVRTFQHVRLFREMTVIENLLVAQHQQLKTGLFSGLLKTPAFRRTQEEALDRAATWLDRIGLLQHANRQASNLAYGDQRRLEIVRCMVTQPEILMLDEPAAGLNPKETKELDELIAELRDHHDTTILLIEHDMKLVMGISDRIYVVNQGTPLANGTPEEIRNNPDVIRAYLGEA

SEQ ID NO: 8853 - protein, 449 aa, Enterobacter cloacae
YRASGTIREMTMTSLRHTALGLALGLAFATNAMAVTTIPFWHSMEGELGKEVDSLAQRFNDTHPDYKIVPVYKGNYEQSLSAGIAAFRTGNAPALLQVYEVGTATMMASKAIKPVYEVFKEAGINFDESQFVPTVAGYYTDSKSGHLLSQPFNSSTPVLYYNKDAFRKAGLDPEQPPKTWQDLAEYTAKLKAAGMKCGYASGWQGWIQIENFSAWHGLPVATKNNGFDGTDAVLEFNKPEQVKHIALLEELNKKGDFSYFGRKDESTEKFYNGDCAITTASSGSLADIRHYAKFNYGVGMMPYDADVKGAPQNAIIGGASLWVMQGKDNGTYKGVAEFLDFLAKPENAAEWHQKTGYLPITKAAYDLTREQGFYSKNPGADIATRQMLNKPPLPFTKGLRLGNMPQIRTIVDEELESVWTGKKTPQQALDSAVERGNQLLRRFEQSTKS

SEQ ID NO: 8854 - protein, 296 aa, Enterobacter cloacae
PMSSSRPVFRSRWLPYLLVAPQLVITVIFFIWPAGEALWYSVQSVDPFGLSSQFVGLDNFTALFHDSYYLDSFWTTIKFSALVTVSGLVASLFFAALVDYVVRGSRLYQTLMLLPYAVAPAVAAVLWIFLFNPGRGLITHFLGEFGYDWNHAQNSGQAMFLVVFASVWKQISYNFLFFFAALQSIPRSLVEAAAIDGAGPVRRFFRLSLPLIAPVSFFLLVVNLVYAFFDTFPVIDAATAGGPVQATTTLIYKIYREGFAGLDLSASAAQSVVLMFLVIILTVVQFRYVESKVRYQ

SEQ ID NO: 8855 - protein, 372 aa, Enterobacter cloacae
PCSARLSAAWSIARNKMAGLKLQAVTKSWDGKTQVIQPLTLDVADGEFIVMVGPSGCGKSTLLRMVAGLERVTSGDIWIDRQRVTEMEPKDRGIAMVFQNYALYPHMSVEENMAWGLKIRGMGKGHIEERVKEAARILELDGLLKRRPRELSGGQRQRVAMGRAIVRDPAVFLFDEPLSNLDAKLRVQMRLELQQLHRRLGTTSLYVTHDQVEAMTLAQRVMVMNKGIAEQIGTPVEVYEKPASRFVASFIGSPAMNLLDGRINAAGTHFELESGMALPINWYYRGYAGRKMTLGIRPEHIGLTSQADGGVPLVMDTLEMLGADNLAHGRWGEQKLVVRLPHQERPKAGSTLWLHMPENHLHLFDGETGQRV

SEQ ID NO: 8856 - protein, 360 aa, Enterobacter cloacae
FLNLPFKRGRLSFVRDKLSKSLTSRFLRTMKKKRPVLQDVADRVGVTKMTVSRFLRNPEQVSVALRGKIAAALDELGYIPNRAPDILSNATSRAVGVLLPSLTNQVFAEVLRGIESVTDAFGYQTMLAHYGYKPELEEERLESMLSWNIDGLILTERTHTPRTLKMIEVAGIPVVELMDSQSPCLDIAVGFDNFEAARQMTAAIIARGHRHVAYLGARLDERTIIKQKGYEQAMLDAGLTPYSVMVEQSSSYTSGIELMRQARREYPQLDGIFCTNDDLAVGAAFECQRLGLKIPDDMAIAGFHGHDIGQVMEPRLASVLTPRERMGRIGAERLLARIRGEAVTPKMLDLGFTLSPGGSI

SEQ ID NO: 8857 - protein, 182 aa, Enterobacter cloacae
QLTEGHPLSTTNHDHHVYVLMGVSGSGKSAVASEVAHQLQAAFLDGDFLHPRSNIMKMASGEPLNDDDRKPWLQALNDAAFAMQRTNKVSLIVCSALKKTYRDLLRDGNPNLSFIYLKGDFGVIESRLKARKGHFFKTQMLVTQFEALQEPGADEQDVLVVDIDQPLEGVVASTIEVINKRQ

SEQ ID NO: 8858 - protein, 447 aa, Enterobacter cloacae
VLSTLTLVLTAVGSVLLLLFLVMKARMHAFVALMVVSIGAGLFSGMPLDKIAATMEKGMGGTLGFLAIVVALGAMFGKILHETGAVDQIAVKMLKSFGHSRAHYAIGLAGLICALPLFFEVAVVLLISVAFSMARHTGTNLVKLVIPLFAGVAAAAAFLLPGPAPMLLASQMHADFGWMILIGLCAAIPGMIIAGPLWGNFISRYVELHIPDDITEPHLGEGKMPSFGFSLSLILLPLVLVGLKTIAARFVPVGSTAYEWFEFIGHPFTAILVACLVAIYGLAMRQGMPKDRVMEICGAALQPAGIILLVIGAGGVFKQVLVDSGVGPALGEALTGMGLPIAVTCFVLAAAVRIIQGSATVACLTAVGLVMPVIEQLNYSGAQMAALSICIAGGSIVVSHVNDAGFWLFGKFTGATEAQTLKTWTLMETILGTTGAVVGMIAFTLLS

SEQ ID NO: 8859 - protein, 682 aa, Enterobacter cloacae
KPWPSELPEPDAAAAWHNLAGAGGRMTQLTAGKPEPLGASFDGKGVNFTLFSAHAERVELCVFDGEGNEHRYDLPARTGDTWHGYLAGGRPGMHYGFRVHGPWEPSQGHWFNPAKLLIDPCAHRVDGEFKDDPLFHVGYGEPDHLDSAPVAPKSVVVHDLYDWEDDAPPRTPWGNTVIYEAHVKGLTYLHPSIPKEMRGTYKALGHPTMVAYLKHLGITALELLPVAHFASEPRLQRLGLSNYWGYNPLALFALDPRYAVNPEKARDEFRDAVKALHAAGIEVILDVVLNHSAESDLDGPTLSQRGIDNRSYYWIRDDGDYENWTGCGNTLNLSHPAVTHYAYECLKYWVETFHVDGFRFDLAPVMGRTPAFSQQAPLFEAIKNCPVLSKVKLIAEPWDIGEGGYQVGNFPPLFAEWNDHFRDAVRRFWLTRDLSLGEFAGRFAGSSDLFKRDGKRPSATINVVTAHDGFTLRDCVCFNQKHNEANGEENRDGTNNNHSFNHGIEGLGGSLDVIERRRASVHALLTTLLLSQGTPMLLAGDEHGHSQHGNNNAYCQDNTLTWLDWGEANSGLTHFTAALIHLRQRIPALTADRWWEEGDGNVRWLNKDAQPLSAQEWQHGIPCLQILLSDAWLVTLNATDDVAEIVLPDGEWRAIPPFAGADNPVVMAVWHGPAHGVCVFQR

SEQ ID NO: 8860 - protein, 308 aa, Enterobacter cloacae
YTLSADPSRPVVKTCDPKQAVAVANKIVNDGIQYVIGHLCSSSTQPASDIYEDEGILMITPGATNPELTQRGYQHIMRTAGLDSSQGPTAAKYILETVKPQRIAIIHDKQQYGEGLARSVQDGLKKGGANIVFFDGITAGEKDFSALIARLQKENIDFVYYGGYYPEMGQMLRQARATGLKTQFMGPEGVGNASLSNIAGDSAEGMLVTMPKRYDQDPANKAIVDALKAQKKDPSGPYVWITYAAVQSLATALDRTGSKEPLDLVKDLKAHGANTVIGPLNWDEKGDLKGFEFGVFKWHADGSSSVAR

SEQ ID NO: 8861 - protein, 453 aa, Enterobacter cloacae
RCGVVCPANSGSAGDAYRYSGPSGGRESMKPMHFAMALLSAAMFFVLAGVFMGVQLGLDGTKLVVDTAPDIRWQWVFIGTAVVFLFQLLRPLFQKTLKNVSGPKFVLPAIDGTTVKQKLFLVALLVAAVAWPFMVSRGTVDIATLTMIYVILGLGLNVVVGLSGLLVLGYGGFYAIGAYTFALLNHYYGLGFWTCLPLAGLVSAAAGFLLGFPVLRLRGDYLAIVTLGFGEIVRILLLNNTEVTGGPNGISQIPKPTFFGLEFSRTAREGGWDTFSNFFGIKYDPSDRVIWLYLVALLLVVITLFVINRLLRMPLGRAWEALREDEIACRSLGLNPTRIKLTAFTISAAFAGFAGTLFAARQGFVSPESFTFAESAFVLAIVVLGGMGSQFAVILAAILLVVSRELMRDFNEYSMLMLGGLMVLMMIWRPQGLLPMTRPQLKLKRTQAKGEQA

SEQ ID NO: 8862 - protein, 246 aa, Enterobacter cloacae
SAHTLVRHKMEKAMLTFDKVNAHYGKIQALHDVSLHINQGEIVTLIGANGAGKTTLLGTLCGDPRATSGRIVFDGKDITDWQTARIMREAVAIVPEGRRVFSRMTVEENLAMGGFFAHRDEYQTRIKWVYELFPRLWERRIQRAGTMSGGEQQMLAIGRALMSQPRLLLLDEPSLGLAPIIIQQIFDTIEQLRKEGMTIFLVEQNANQALKLADRGYVLENGRVVLSDTGDALLANEAVRSAYLGG

SEQ ID NO: 8863 - protein, 734 aa, Enterobacter cloacae
KNRMNTMSDRISRDVINALIAGHFADPFSVLGMHRTEAGLEVRALLPDATEVWVIEPKTGRKVGNLECLDSRGFFSGVMPRRKNPFRYQLAVIWHGQQNLIDDPYSFGPLLKEMDAWLLSEGTHLRPYETLGAHADTMDGITGTRFAVWAPNAQRVSVVGQFNYWDGRRHPMRLRRETGIWELFIPGAHNGQLYKFEMIDANGKLRIKSDPYAFEAELRPNTASLICGLPEKVVQTEERKQANRFDAPISVYEVHLGSWRRHTDNNFWLSYRELADQLVPYAKWMGFTHLELLPINEHPFDGSWGYQPTGLYAPTRRFGTRDDFRYFIDAAHAAGLNVILDWVPGHFPSDDFALAEFDGTKLYEHSDPREGYHQDWNTLIYNYGRREVSNYLVGNALYWIERFGIDALRVDAVASMIYRDYSRKEGEWIPNEYGGRENLEAIEFLRNTNRIIGEQVEGAVTMAEESTDFPGVSRPPSMGGLGFWYKWNLGWMHDTLDYMKLDPVYRQYHHDKLTFGLLYNYTENFMLPLSHDEVVHGKKSILDRMPGDAWQKFANLRAYYGWMFAFPGKKLLFMGNEFAQGREWNHDTSLDWHLLEGADNWHHGVQRLVRDLNLTYRHHKALHELDFDPYGFEWLVVDDHERSVFVFARRDKAGNEIIVASNFTPVPREHYRFGINQPGKWREILNTDSMHYHGSNAGNGGLVQSDAIESHGRPNSLSLTLPPLGTIWLVREGE

SEQ ID NO: 8864 - protein, 548 aa, Enterobacter cloacae
YRFGSPAAGCLGRALMSSASLRYRPCLRHSRRDGDWGKCGRRCASFLPFGRGDRVSNTGNVAEAANQTGAMMQVLHVCSEMFPLLKTGGLADVLGALPAAQIAGGVDTRVLLPAFPDIRRGIPDAKVVTRRETFAGRITLLFGHYNGTGIYLIDAPHLYDRPGSPYHDTNLYAYTDNVLRFALLGWVGAEMAVGLDPFWRPNVVHAHDWHAGLAPAYLAAKGHPAKSVFTVHNLAYQGMYYAHHMNDIDLPWSFFNMHGLEFNGQISFLKAGLYYADHITAVSPTYAREITQPEFGYGMEGLLQQRHREGRLSGILNGVDEQIWNPETDLLLAARYGRDSVEDKAENKRQLQIAMGLKVNDKVPLFAVVSRLTSQKGLDLVLEALPGLLEQGGQLALLGAGDPVLQEGFLAAAAEHPGQVGVQIGYHEAFSHRIMGGADVILVPSRFEPCGLTQLYGLKYGTLPLVRRTGGLADTVSDSSLENLADGIASGFVFEDSNAWSLLRAIRRAFVLWSRPSLWRYVQRQAMSMDFGWHVAAQSYRDLYQRLM

SEQ ID NO: 8865 - protein, 821 aa, Enterobacter cloacae
RGEVTDMNAPFSYSSPTLSVEALKHSIAYKLMFTIGKDPVIANKHEWLNATLFAVRDRMVERWLRSNRAQLSQETRQVYYLSMEFLIGRTLSNALLSLGIYDDVKNALEEMGLDLEELIDEENDPGLGNGGLGRLAACFLDSLATLALPGRGYGIRYDYGMFKQNIVDGRQKESPDYWLEYGNPWEFKRHNTRYKVRFGGRIQQEGKKSRWVETEEILAVAYDQIIPGYDTDATNTLRLWNAQASSEINLGKFNQGDYFAAVEDKNHSENVSRVLYPDDSTYSGRELRLRQEYFLVSATIQDILSRHYQLHKTYANLAEKTAIHLNDTHPVLSIPELMRLLIDEHKFSWDDAFEVTCQVFSYTNHTLMSEALETWPVDMLGKILPRHLQIIFEINDYFLKTLQEQYPNDTGLLSRASIIDESNGRRVRMAWLAVVISHKVNGVSELHSNLMVQSLFADFAKIFPTRFCNVTNGVTPRRWLALANQPLSDVLDENIGRTWRTDLSQLSELEQHIDFPTVNKAVREAKLLNKKRLAVWLAMHLNVVANPKALFDVQIKRIHEYKRQLMNVLHVITHYNRIKADPTAEWVPRVKIFAGKAASAYYMAKHIIHLINDVAKVVNHDPDIGDKLKVVFIPNYSVSLAQLIIPAADLSEQISTAGTEASGTSNMKFALNGALTIGTLDGANVEMLEHVGAENIFIFGNTAEEVEALRKQGYSPREYYEEDEELRQVLTQIATGVFNPEEPGRYRDLVDSLINFGDHYQVLADYRSYVDCQDKVDELYRQQEKWTSTAMHNIANMGYFSSDRTIKEYAENIWHIDPVRL

SEQ ID NO: 8866 - protein, 312 aa, Enterobacter cloacae
KGLHMSEQFLYFLQQMFNGVTLGSTYALIAIGYTMVYGIIGMINFAHGEVYMIGSYVSFMIIAALMMMGIDSSWLLVAAGFVGAIVIASAYGWSIERVAYRPVRSSKRLIALISAIGMSIFLQNYVSLTEGSRDVALPSLFNGQWIVGASENFSASVTTMQLVIWVVTFIAMLALTLFIRYSRMGRACRACAEDLKMASLLGINTDRVIALTFVIGAAMAAVAGVLLGQFYGVINPYIGFMAGMKAFTAAVLGGIGSIPGAMIGGLILGVAEALSSAYLSTEYKDVVSFALLILVLLVMPTGILGRPEVEKV

SEQ ID NO: 8867 - protein, 285 aa, Enterobacter cloacae
GALPMIENRRGLTIFSHTLLILGILVILFPLYVAFVAATLDTKAVFDTPMTLIPGTHLFENMKTIWTQGVGANSAPFWLMMLNSFIMAFGITVGKITVSMLSAFAIVWFRFPLRNLFFWMIFITLMLPVEVRIFPTVEVIANLKMLDSYAGLTLPLMASATATFLFRQFFMTLPDELIEAARIDGASPMRFFRDIVLPLSKTNLAALFVITFIYGWNQYLWPLLIVQDVNLGTAVAGIKGMIATGEGTTLWNQVMAAMLLTLIPPVVIVLAMQRAFVRGLVDSEK

SEQ ID NO: 8868 - protein, 251 aa, Enterobacter cloacae
NRTTSMSNWPYPHIVAHRGGGKLAPENTLAAIDVGARYGHTMIEFDAKLSKDGEIFLLHDDNLERTSNGWGVAGELPWRDLLKVDAGSWFSGEFKGEPLPLLAEVADRCRQHGMMANIEIKPTTGTGPLTGKVIAIAARELWEGMTAPLLSSFDIDALEAAQAAVPELPRGLLLDAWREDWRALTTRLGCVSIHLNHKLLDEARVTLLKEAGLHILVYTVNKPQRAAELLRWGVDSICTDAIDQIGPNFIY

SEQ ID NO: 8869 - protein, 593 aa, Enterobacter cloacae
AGNMGPFTWRTIMMKPTFLRWVAIAALMAGGTFTVAANPPAAPPVSYGVEEDVFHPVRATHGMVASVDALATQVGVDILKQGGNAVDAAVAVGYALAVTHPQAGNLGGGGFMMLRTKDGKTTAIDFREMAPNQASRDMFLDDQGNPDSKKSLTSHLASGTPGTVAGFSLALEKYGTLPLNKVVQPAIRLARDGFVVNDALADDLKTYGSEVIPNHENSKAIFWKDGEPLKKGDKLVQKNLAKSLELIAENGPDAFYKGPIADQIADEMQKNGGLITKADLAEYKAVEREPISGTYRGYEVFSMPPPSSGGIHIVQILNILENFDMHKYGFGSADAMQVMAEAEKRAYADRSEYLGDPDFVKVPWQALTNKAYAKSIADQIDINKAKPSSEIRPGKLAPYESNQTTHFSVVDKDGNAVAVTYTLNTTFGTGIVAGNSGILLNNEMDDFSAKPGVPNVYGLVGGDANAVGPKKRPLSSMSPTIVVKDGKTWLVTGSPGGSRIITTVLQMVVNSIDFGMNVAEATNAPRFHHQWLPDELRVEKGFSPDTLKLLEQRGQKVAVKEAMGSTQSIMVGPDGALFGASDPRSVDDLTAGY

SEQ ID NO: 8870 - protein, 346 aa, Enterobacter cloacae
AMTLHCAFIGFGKSTTRYHLPYVLNRKETWHVAHIYRRSAKPEEQSPQYSHIHFTSDLDEVLNDPQVKLVVVCTHADSHFDYAKRALEAGKNVLVEKPFTPTIAEAKELFALAKSKGLTVTPYQNRRFDSCFLTAKKAIESGKLGEIVEIESHFDYYRPVAETQPGLPQDGSFYGLGVHTMDQIISLFGRPDHVAYDIRSLRNKANPDDTFEAQLFYGDLKAIVKTSHLVKIDYPKFIVHGKKGSFIKYGIDQQETSLKANIMPGEPGFAADDSVGVLEYVNDEGVTVREELKPETGDYGRVYDALFETLTNGTANYVKESDVLTNLEILERAFEQASPATVTLAK

SEQ ID NO: 8871 - protein, 272 aa, Enterobacter cloacae
AKTAPLRLFTIFEQRSQFSPSMIPGRLRPHLLHRNELRVKTMIYLRKANERGHANHGWLDSWHSFSFADYYDPNFMGFSALRVINDDVIDAGQGFGTHPHKDMEILTYVLEGAVEHQDSMGNKEQVPAGEFQIMSAGTGVRHSEYNPSKTEKLHLYQIWIIPEETGITPRYEQRRFDAKQGKQLVLSPDAREGSLKVHQDMELYRWALAKDEQSVHQIAANRRVWIQVVKGEVSINGTKATTADGLAVWDEQALSVHADSESEILLFDLPPV

SEQ ID NO: 8872 - protein, 390 aa, Enterobacter cloacae
CEAYPSSILACTISTHPLQEKNAMKNVGFIGWRGMVGSVLMQRMVEERDFDAIRPVFFSTSQLGQAAPSFGGTTGTLQDAYDLEALKALDIIVTCQGGDYTNEIYPKLRESGWQGYWIDAASSLRMKDDAIIILDPVNQGVITDGLNNGVKTFVGGNCTVSLMLMSLGGLFAQDLVEWVSVATYQAASGGGARHMRELLTQMGQLHQSVAAELADPASAILDIERKVTQLTRSGELPVDNFGVPLAGGLIPWIDKQLDNGQTREEWKGQAETNKILGTANTIPVDGLCVRIGALRCHSQAFTIKLKKDVSIPTVEELLAAHNPWAKVVPNDRDITMRELTPAAVTGTLTTPVGRLRKLNMGPEYLSAFTVGDQLLWGAAEPLRRMLRQLA

SEQ ID NO: 8873 - protein, 457 aa, Enterobacter cloacae
SGCYGCLARACARSVRIPKMIKKELVMVRLEKNDPLMLARQLPLKTVALILAGGRGTRLKDLTIKRAKPAVHFGGKFRIIDFALSNCLNSGIRRIGVITQYQSHTLVQHIQRGWSFFSEEMNEFVDLLPAQQRVHGENWYRGTADAVTQNLDIIRRYNAEYIVILAGDHIYKQDYSHMLIDHVEKGARCTVACLPVPVAEATAFGVMHVDGDDKIIDFVEKPANPPTMPGDDTKSLASMGIYVFDADYLYELLEEDDKDENSSHDFGKDIIPKITKAGMAYAHPFPLSCVQSDPNAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPDVWVGRSCRLRRCVIDRACVIPEGMVIGENAEEDARRFYRSEEGIVLVTREMLRKLQIKQER

SEQ ID NO: 8874 - protein, 85 aa, Enterobacter cloacae
RRPPWISLELADDVAQARSLASSISTDKPRPAASTAIPAPLMPPPITIRSLVSITPSCTFVKAQKCSISLIIAKERAFGNIKKTI

SEQ ID NO: 8875 - protein, 158 aa, Enterobacter cloacae
RGPYSPLKPGSQLLKNHRYAGMRINLREASKEEITMKRLLILTALLPFAALAQPINTLNNPNQPGYVIPSQQRMQTEMMSQQQQQKGMLNQQLKTQTQVQQQHLQNQMNTNTQRVQQGQMLEQPLPNTNGGMLGGGVSQSSGQQHMLPTQQNGSMLNK

SEQ ID NO: 8876 - protein, 105 aa, Enterobacter cloacae
STAPVSCKILPNIAPSATTMARKPSVPPIPFSIVAAILSSGMPEKRPAPIETTIKATKACIRAFITKNSSSNTEPTAVKTSVNVLKTYCLLLITSMVLATTPSSG

SEQ ID NO: 8877 - protein, 168 aa, Enterobacter cloacae
LTEAQGMSEIVIRHAEPKDYDAIRQIHAQPEVYHNTLQVPHPSMEMWQMRLGEQPGIKQLVACIDDIVVGHLTIDVAQRPRRSHVADFGICVGAEWHNRGVASALIRTMIDMCDNWLRVDRIELTVFVDNEPAIAVYKKHGFEIEGTGRRYALRNGEYVDAYYMARMK

SEQ ID NO: 8878 - protein, 511 aa, Enterobacter cloacae
ALTKVHEGVMETKDLIVIGGGINGAGIAVDAAGRGLSVLMLEANDLACATSSASSKLIHGGLRYLEHYEFRLVSEALAEREVLLKMAPHLAIPMRFRLPHRPHLRPAWMIRIGLFMYDHLGKRTSLPGSTGLRFGSESVLKPEIVRGFEYSDCWVDDARLVLANAQMVEKKGGEVKTRTRATAARRENGLWIVEAEDVDTGEKFSWKARGLVNATGPWVKQFFDDGMHLPSPYGIRLIKGSHIVVPRVHTQKQAYILQNEDKRIVFVIPWMDEFSIIGTTDVEYKGDPKNVEIDESEVSYLLKVYNAHFKKQLARDDVVWTYSGVRPLCDDESDSPQAITRDYTLDIHDVDGQAPLLSVFGGKLTTYRKLAEHALEKLAPYYKGIGPAWTKGAVLPGGDIGDNRDDYAAKLRRRFPFITEGMARHYARTYGSNTELFLGDAKEIADLGEHFGHELYEAELRYLVEHEWVRRLDDAIWRRTKEGMWLNAEQQSRVAQWLAQHAGKRELSLAS

SEQ ID NO: 8879 - protein, 199 aa, Enterobacter cloacae
FKMSEIISAAVLLILIMDPLGNLPIFMSVLKHTEPKRRRAIMIRELLIALLVMFIFLFAGEKILAFLNLRAETVSISGGIILFLIAIKMIFPSAEGSSSGLPAGEEPFIVPLAIPLVAGPTILATLMLLSHQYPNQMSHLVIALLIAWGGTFIILLQSSLFLRLLGEKGVNALERLMGLILVMMATQMFLDGIRAWMKG

SEQ ID NO: 8880 - protein, 212 aa, Enterobacter cloacae
GLSQRCSFQPPGEDPYNLNDLYSDKISHWIKMKTIEVDDELYQYIASQTRHIGESASDILRRMLKISAASQPTPVTKDVVSQPSVVAQVKPAVMPAKDKVRAMRELLLSDEYAEQKKAVNRFMLVLSTLYSLDNNAFAEATESLHGRTRVYFAGDEQTLLQNGNQTKPKHVPGTPYWVITNTNTGRKCSMIEHIMQSMQFPAELIEKVCGTI

SEQ ID NO: 8881 - protein, 554 aa, Enterobacter cloacae
PLHQKDQAMANHSRAGQPAQQRDLINVAQLTAQYYVLKPVVGNAQHAVKFGTSGHRGSAARHSFNEPHILAIAQAIAEERAKNGVTGPCYVGKDTHALSEPAFISVLEVLAANGVDVIVQENNGFTPTPAVSNAILVHNKKGGAQADGIVITPSHNPPEDGGIKYNPPNGGPADTNVTKVVEDRANALLANGLNGVKRISLDEAMASGHVKEQDLVQPFVEGLADIVDMAAIQKAGLKLGVDPLGGSGIEYWKRIAEHYKLDLTIVNDHVDQTFRFMHLDKDGAIRMDCSSECAMAGLLALRDKFDLAFANDPDYDRHGIVTPAGLMNPNHYLAVAINYLFQHRPQWGKEVAVGKTLVSSAMIDRVVDALGRKLVEVPVGFKWFVDGLHDGSFGFGGEESAGASFLRFDGTPWSTDKDGIIMCLLAAEITAVTGKNPQEHYNELAERFGAPSYNRIQAGATSAQKAALSKLSPEMVSASTLAGDPITARLTAAPGNGASIGGLKVMTENGWFAARPSGTEDAYKIYSESFLGAEHRQQIEKEAVEIVSEVLKNA

SEQ ID NO: 8882 - protein, 100 aa, Enterobacter cloacae
VVKLQTKRYYFNQVTDFTFSGDGFRPTTGEKNMDLYKEFPAHIIFMRRTFAVVAGVLALPVMLFWKDRARFYSYLHRVWAKTSEKPVWMDQAEKATCDFY

SEQ ID NO: 8883 - protein, 374 aa, Enterobacter cloacae
AAPERTGGQRGDWWRANGNLSARFTGRLAADWAHVHAVIRTRPGRAHTPASGGYAALYPAEGGSMLTLIRAGLYTSVQDAGRFGLRQSGVSYCGALDRPSLEIANLLVGNAGSTAALEITLGQCVIEFGQEAWFALTGAGCDATLDGKAVWTGWRLRAKAGQRLTLKRPLHGVRSYLAVAGGIDVPEVLGSSSTDQKAGMGGHEGRLLRDGDRLRIKTSTRHFTTTQGVKQLLWGNVIRALPGPEYQEFDEAAKESFWRSPWKISPQSNRMGYRLQGQPLTRTTDRELLSHGLLPGVIQVPGNGQPIVLMNDAQTTGGYPRIACIIEADRYHLAQIPLGQPIHFVQCSLEEALKARQDQQRYLEQLAWRLDGKD

SEQ ID NO: 8884 - protein, 166 aa, Enterobacter cloacae
HLEAMFCMTRSYRKGTLSDPHRSPEEGNNKNSMWALFMIRNVKKQRPVNLDLKTIRFPVTAIASILHRVSGVITFVAVGILLWLLGTSLSSPEGFLQASAIMNSFFVKFIMWGILTALAYHVVGGVRHMLMDFGYLEETFEAGKRTANISFVITVVLSLLAGVLVW

SEQ ID NO: 8885 - protein, 477 aa, Enterobacter cloacae
WTIARSFMPTHLVWFRADLRIHDNFALAAACRAKDANVLALFIATPEQWRQHDMAPRQAALLSAYLNDLQHSLAEKGIPLIYKEAHDFAAQRQTVQAICQQYAVTHLYYNYQYEFNEQQRDRQLEKSLAGVVCEGFDDSVMLAPGSVMTGSHEMYKVFTPFKNAFIKRLKEGLPECVTAPSVRGETITDLPAIRLNYPQQSFDETVFPASEKAAIARLRQFCAQGAVEYEARRDFPAIEGTSRLSACLALGALSPRQCLHRLLAEQPQALDGGAGAVWLNELIWREFYRHLMTYHPDLCKHRPFIRWTEQVQWQSNEKLLKAWQHGLTGFPIVDAAMRQLNETGWMHNRLRMITASFLVKDLLIDWRTGERYFISQLIDGDLAANNGGWQWAASTGTDAAPYFRIFNPTTQGQRFDADGEFIRRWLPELKDVPAKAIHEPWVWADKQRVTLNYPRPIVDHKQARVATLAAYEAARKV

SEQ ID NO: 8886 - protein, 218 aa, Enterobacter cloacae
VQRARCYLLGETAVVLELEPPVTLATQKRIWRLAQRLPELPGVVEAIPGMNNITVVLRDPHTGALDAIERLQRWWEESEALEPESRTIEIPVVYGGKGGPDLGVVAEHCGLTEKQVVELHSSVDYVVWFLGFQPGFPYLGGLSPQLHTPRRAEPRLSVPAGSVAIGGEQTGIYPLASPGGWQLIGHTSTPLFEPGQDAPILLRPGDTLRFIPQKEGVC

SEQ ID NO: 8887 - protein, 263 aa, Enterobacter cloacae
KPGRISSVISNSWRGGSMVKIDLNADLGEGSSADAALMTLVSSVNIACGFHAGDAQTMLASVRNAMKNGVAIGAHPSFPDRENFGRTAMDLPPETVYAQMLYQIGALEAIVRAENGVLRHVKPHGMLYNQAAKDPVLADAIARAVRDCNPRLVLVGLAGSELIRAGERLGLSTRQEVFADRGYLPDGSLVPRTRAGALITDEGKALAQTLEMVRFGRVTSTEGTTANVQADTVCLHGDGEHALQFARRLRAAFSEEGIVVSAE

SEQ ID NO: 8888 - protein, 267 aa, Enterobacter cloacae
KDNNMPEGPEIRRAADSLEAAIKGKPLTHVWFAFPQLKPFESQLVGQTVTHIETRGKALLTHFSHNLTLYSHNQLYGVWRVVEADEQPQTTRVLRVRLQTADKAILLYSASDIEMLTPEQLLTHPFLQRVGPDVLDMRLTASDVKTRLLSPTFRNRQFSGLLLDQAFLAGLGNYLRVEILWEVGLAPQHKASQLSDEQLEALSHALLDIPRLSYNTRGMVDENKHHGALFRFKVFHRAGKKCERCGGIIDRIMLSSRPFYWCPHCQK

SEQ ID NO: 8889 - protein, 619 aa, Enterobacter cloacae
TAGDSPSAATDYCCCSAGLRHLWICCGVGCVMKLPVREFDAVVIGAGGAGMRAALQISQSGQTCALLSKVFPTRSHTVSAQGGITVALGNSHEDNWEWHMYDTVKGSDYIGDQDAIEYMCKTGPEAILELDHMGLPFSRLENGTIYQRPFGGQSKNFGGEQAARTAAAADRTGHALLHTLYQQNLKNHTTIFSEWYALDLVKNADGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEQGEDVVIPGLFAVGEIACVSVHGANRLGGNSLLDLVVFGRAVGLHLQESIAEQGALRDATDDEIDASLERLNRWNGNRNGEDPVEIRKALQECMQHNFSVFREGDAMAKGLEQLKAIRERLKNARLDDTSSEFNTQRVECLELDNLMETAFATAMSANFRTESRGAHSRFDFPDRDDENWLCHSLYLPESETMTRRSVNMEPKLRPAFPPKIRTY

SEQ ID NO: 8890 - protein, 243 aa, Enterobacter cloacae
CGDRIMKLEFSVYRYNPDVDDAPRMQDYTLEAEEGRDMMLLDALIQLKEKDPTLSFRRSCREGVCGSDGVNMNGKNGLACITPISALNRPGQKIVIRPLPGLPVVRDLVVDMGQFYAQYEKIKPYLLNNGQNPPAREHLQSPEQREKLDGLYECILCACCSTSCPSFWWNPDKFIGPAGLLAAYRFLIDSRDTETENRLEGLSDAFSVFRCHSIMNCVSVCPKGLNPTRAIGHIKSMLLQRSA

SEQ ID NO: 8891 - protein, 419 aa, Enterobacter cloacae
RAERRLIKGYIMSSVDILVPDLPESVADATVATWHKKPGDAVTRDEVLVEIETDKVVLEVPASADGILDAVLEDEGTTVTSRQILGRLREGNSAGKESSAKSEEKASTPAQRQQASLSDQTNDALSPAIRRLLAEHSLDPAAIKGTGVGGRLTREDIDKHLAKAPSEAKAEAKAPAAAPAAQPALGARSEKRVPMTRLRKRVAERLLEAKNSTAMLTTFNEVNMKPIMDLRKQYGDAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVDGKVEILPMMYLALSYDHRLIDGRESVGFLVAIKELLEDPTRLLLDV

SEQ ID NO: 8892 - protein, 315 aa, Enterobacter cloacae
QRPEYYCSEKSDGCSSAGCCRSGGEIMSVLINKDTKVICQGFTGSQGTFHSEQAIAYGTQMVGGVTPGKGGTTHLGLPVFNTVREAVEATGATATVIYVPAPFCKDSILEAIDAGIKLIITITEGIPTLDMLTVKVKLDEAGVRMIGPNCPGVITPGECKIGIMPGHIHRPGKVGIVSRSGTLTYEAVKQTTDYGFGQSTCVGIGGDPIPGSNFIDILKLFQEDPQTEAIVMIGEIGGSAEEEAAAYIKDHVTKPVVGYIAGVTAPKGKRMGHAGAIIAGGKGTADEKFAALEAAGVKTVRSLADIGEALKSIIK

SEQ ID NO: 8893 - protein, 562 aa, Enterobacter cloacae
QETKMKAVSRVHITPHMHWDREWYFTTEASRILLVNNMEEILTRLEQDAEYKYYVLDGQTAVLEDYFAVKPENRPRVKALVAAGKLIIGPWYTQTDTTLVSGESIVRNLMYGIRDCLAFGEPMKIGYLPDSFGMSSQLPHIYNGFGITRTMFWRGCSERHGTDKTEFLWQSQDGSEVTAQVLPLGYAIGKYLPEDEAGLRKRLDTYFEVLEKASVTKEILLPNGHDQMPLQQNIFAVMDKLREIYPQRQFVMSRFEEVFDHIDAHRDELATLKGEFIDGKYMRVHRTIGSTRMDIKIAHARIENKIVNVLEPLATLAWTLGFEYHHGLLEKMWKEILKNHAHDSIGCCCSDKVHREVMSRFELAEDMADNLTCFYMRKIVDNMPQCEEDKLVMFNLTPWPREEVINTTIRLRASQFRLLDDRGNEIPYCLRSAREIDPGLIDRQIVHYGNYDPFMEFDIQLNQILPSMGYRTLYIEPHVAGKLLAPETTSEALLENAFWEITLNDDGTLRLLDKASGLIYDRALEIEESSDDGDEYDYSPSREEWRLTSAQAYFTTRPRSSR

SEQ ID NO: 8894 - protein, 277 aa, Enterobacter cloacae
TIPVPLSTINRRASPRWRRTKPPEKFERMMMKNSELERLINEKLNTASFSDYGPNGLQVEGRETVQKIITGVTASQALLDEAVRQEADAVIVHHGYFWKNESPIIRGMKRNRLKTLLANDINLYGYHLPLDAHPELGNNVQLAQLLGITVMGEIEPLVPWGELSMPVPGLELASWIEARLGRRPLWCGDTGPDTVKRVAWCTGGGQGFIDSAARFGVDAFITGEVSEQTIHSAREQGLHFYAAGHHATERGGIRALSEWLTENTDLDVTFIDIPNPA

SEQ ID NO: 8895 - protein, 132 aa, Enterobacter cloacae
HFICDHCRAFTSRRSSRMVSNASALGRNGVHDFILVRATAIVLTLYIIYMIGFFATSGTLTWEIWSGFFGSAFTKVFTLLALFSILIHAWIGMWQVLTDYVKPLAIRLPLQLIIVVALLVYVIYGFVVVWGV

SEQ ID NO: 8896 - protein, 938 aa, Enterobacter cloacae
GITMQNGAMKAWLDSSYLSGSNQSWIEQLYEDFLTDPDSVDANWRSMFQQLPGTGVKPDQFHSKTRDYFRRLAKDASRYSSAISDPDTNAKQVKVLQLINAYRFRGHQHANLDPLGLWQQERVADLDPAYHDLTEADFQESFNVGSFAIGKDTMKLGDLIDALKQTYCGSIGAEYMHITSTEEKRWIQQRIESVAGHANFSAEEKKRFLSELTAAEGLERYLGAKFPGAKRFSLEGGDALVPMLKELIRHAGKSGTREVVLGMAHRGRLNVLVNVLGKKPQDLFDEFAGKHKEHLGTGDVKYHMGFSSDIETEGGQVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLFCYRRHGHNEADEPSATQPLMYQKIKKHPTPRKIYADKLESEKVATLEDATEMVNLYRDALDAGECVVKELRPMNMHSFTWSPYLNHEWDESYPNKVEMKRLQELAKRISTVPEAIEMQSRVAKIYGDRQAMAAGEKLFDWGGAETLAYATLVDEGIPVRLSGEDAGRGTFFHRHAVVHNQSNGSTYTPLQHVHNGQGQFKVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSLEELANGTFLPAIGEIDELDPQAVKRVVMCSGKVYYDLLEQRRKNDQKDVAIVRIEQLYPFPHQAMQEVLKQYAHVHDFVWCQEEPLNQGAWYCSQHHFREVIPFGSALRYAGRPASASPAVGYMSVHQKQQQDLVNDALNVD

SEQ ID NO: 8897 - protein, 397 aa, Enterobacter cloacae
RLPEGWIEHMNLHEYQAKQLFARYGLPAPVGYACTTPREAEEAASKIGAGPWVVKCQVHAGGRGKAGGVKVVKSKEEIRAFAEHWLGKRLVTYQTDANGQPVNQILVEAATDIAKELYLGAVVDRSSRRVVFMASTEGGVEIEKVAEETPHLIHKVAIDPLAGPMPYQGRELAFKLGLEGKLVQQFTKIFMGLATIFLERDLALIEINPLVITTQGDLICLDGKLGADGNALFRQSDLREMRDQSQEDPREAQAAQWELNYVALDGNIGCMVNGAGLAMGTMDIVKLHGGEPANFLDVGGGATKERVTEAFKIILSDSNVKAVLVNIFGGIVRCDLIADGIIGAVEEVGVNVPVVVRLEGNNAELGAKKLADSGLNIIAAKSLTDAAQQVVAAVEGK

SEQ ID NO: 8898 - protein, 642 aa, Enterobacter cloacae
GRIFMNLTTLTDPRAVCVQAQFTSRDEAIRQLATRLVALGKIADADTFLAEVFHRESLGPTALGEGLAVPHGKSAAVKEAAFAVATLCEPLAWEGVDGPEEVELIFLLAIPPAQAGSTHIQVLTELTSRLADDDLRGRVMTATSAEAVLAALETAPDAQETAVAENAPTIVCVTACPAGIAHTYMAAEYLEKAGRKLGVNVVVEKQGANGIEGRITAQQLQEAKACIFAAEVAIKERERFQGIPAISVPVAEPLRHAEALIERALALQPVSDARPAHVDTDAKKCVKTELKQALLSGISFAVPLIVAGGTVLAVSVLLAQILGLQHLFDQENSWLWMYRKLGGGMLGILMVPVLAAYTAYSLADKPALTPGFAAGLAANMIGSGFLGAIVGGLIAGYLMRWVKNHIRLSSRYNGFLTFYLYPVIGVLGAGSLMLFVIGEPVAWINNALTAWLNGLSGANALLLGAILGFMCSFDLGGPVNKASYAFCLGAMANGVYGPYAIFASVKMVSAFTVTASTMLAPNLFKQFEIETGKSTWLLGLAGITEGAIPMAIEDPLRVIGSFVLGSMATGAIVGAMGIGLSTPGAGIFSLFLLHDAGLGGVMAAAGWFGAALIGAAISTLILLLWRRQAVKSGAYVTEDITS

SEQ ID NO: 8899 - protein, 564 aa, Enterobacter cloacae
CGGILMAAQAFLLIASFLLVLFVFARPLGTALARLINNVPLPGTRNIENVLWRISGISDREMNWRQYLMAILLLNIVGLIALFTLLMLQGSLPLNPQQLPGLSWHLALNTAVSFVTNTNWQSYAGETTLSYFSQMAGLTVQNFLSAASGIAVIFALTRAFARQNVSTLGNAWVDVTRITLWILVPVALIIALFFIQQGTLQNLLPYTPFTSLEGARELLPMGPVASQEAIKMLGTNGGGFFNANSSHPFENPTALTNFVQMLAIFLIPTALCFAFGDVVNDRRQGRTLLWAMSLIFVVCVALVMWAEWYGNSHFMQLGANSNINLEGKESRFGILASSLYAVVTTAASCGAVNAMHDSFTALGGMIPMWLMQIGEVVFGGVGSGLYGMLLFVLLAVFIAGLMIGRTPEYLGKKIDVREMKLTALAILVTPALVLLGTALALMTDVGRSGIFNPGIHGFSEVLYAVSSAANNNGSAFAGLSANSPFWNCLLAFCMFVGRFGVIIPVMAIAGTLVNKKIQPTTTGTLPTHGALFVGLLIGTVLLVGALTFIPALALGPVAEYLSLR

SEQ ID NO: 8900 - protein, 688 aa, Enterobacter cloacae
FCGEFFMSRKQLALLEPTLVRQALMDAVKKLSPRVQWHNPVMFIVWTGSLLTTVLAIAMGTGHLLGNATFTGAISLWLWFTVLFANFAEALAEGRSKAQANSLKGVKKTAFARKLREPKYGAHMDHVPADELRKGDVVLVEAGDIIPCDGEVIEGGASVDESAITGESAPVIRESGGDFASVTGGTRILSDWLVIQCSVNPGETFLDRMIAMVEGAQRRKTPNEIALTILLVALTIVFLLATATLWPFSAYGGTAVSITVLIALLVCLIPTTIGGLLSAIGVAGMSRMLGANVIATSGRAVEAAGDVDVLLLDKTGTITLGNRQASDFLPAPGVDEKTLADAAQLSSLADETPEGRSIVILAKQRFNLRQRDVQSLHATFVPFTAQTRMSGINIQDRMIRKGSVDAIRRHIEANNGHFPPEVDHLVESVARQGATPLVVAEGASVLGVIALKDIVKGGIKERFAQMRKMGIKTVMITGDNRLTAAAIAAEAGVDDFLSEATPEAKLALIRQYQAEGRLVAMTGDGTNDAPALAQADVAVAMNSGTQAAKEAGNMVDLDSNPTKLIEVVHIGKQMLMTRGSLTTFSIANDVAKYFAIIPAAFAATYPQLNALNVMHLHSPASAILSAVIFNALIIVFLIPLALKGVSYKALTAAAMLRRNLWIYGLGGLVVPFIGIKVIDMLLTLFGLV

SEQ ID NO: 8901 - protein, 195 aa, Enterobacter cloacae
KVDPMTMLRPAILLFILLSLITGGLYPLMTTALGQWWFQDQANGSLIIQNGENRGSRLIGQNFTDPRYFQGRPSATAESPYNPMASGGSNLAGSNPDLDKAIAERVAALRAANPQASREVPVELVTASASGLDYSLTPDAVVWQIPRVAAARQLTVEQVSQLVAEHTQKPLVSFIGMPVVNIVELNLALDALRKN

SEQ ID NO: 8902 - protein, 895 aa, Enterobacter cloacae
MTDEPMRPDPDRLLEQTAEAHRGKLKIFFGACAGVGKTFAMLTEAQRLRAQGLDILIGVVETHGRKETAALLTGLATQPPQRISHRGRLVTEFDLDAALARRPALILMDELAHSNAPGSRHPKRWQDVEELLEAGIDVFTTVNVQHLESLNDVVSGVTGIQVRETVPDPFFDSADEVVLVDLPPDDLRQRLHEGKVYIAGQAERAIEHFFRKGNLIALRELALRRTADRVDDQMRAWRDLQGQERVWHTRDAILLCIGHGSGNEKLVRTAARLAAKFGSVWHAVYVETPQLHGLPENQRRAILSALRLAQELGAETATLSDPQEDKAILRYAREHNLGKIVIGRRQHRRWFSRESFADRLARRAPDLDLVIVALDDKPAPLPNRTPDARTFGDKWRIQIRGCMVAVVLCALITVIASQWLIAFDAANLVMIYLLGVVVVALFYGRWPSVLATVINVISFDLFFIAPRGTLAVSDVQYILTFAVMLTVGLVIGNLTAGVRYQARIARYREQRTRHLYEMSKSLAVGRTQRDIVQTSEQFIRSTFHASNLILLPDEQGRLRPLTSPSGMTPWDEAIARWSFDKGLPAGAGTDTLPGVPYQILPLRSADKNHGLVIVEPSNLRQLMIPEQQRLLETFTLLVASALERLALTASEEQARLASERESIRNSLLAALSHDLRTPLTVLFGQSEILTLDLAAEGSKHAMQASEIRQHVLNTTRLVNNLLDMARIQSGGFNLKKEWLTLEEVVGSALKMLEPGLGGRHIELDMPEPLTLIHVDGPLFERVLINLLENAAKYAGAKARLGIAARVDKRVLRLDVWDTGPGIPAGQERAIFEKFARGNKESAIPGVGLGLAICQAIVDVHGGTISAENRPEGGARFCVTLPLESPPELDELPEDL

SEQ ID NO: 8903 - protein, 64 aa, Enterobacter cloacae
NDRLLVICFTVNPFSLDKMTMLSITERKLNMENNNRLMPHIRRTTHIMMFAHRNCFDFHLFNAR

SEQ ID NO: 8904 - protein, 737 aa, Enterobacter cloacae
NKEIKMKTLKIAVSRACPECFTTSRDIVDITASDYIDVAAVVLAVSDIFNGAIEEIEATGFGIPVFIATHKEERVPAEFLSRIHGVFEYSDTSNAYYGRQLEAAAQKYETQLRPPFFRALVDYVQQGNSAFDCPGHQGGQFFRRHPAGNQFVDFFGETLFRADLCNADVAMGDLLIHEGAPCIAQQHAAKVYNADKTYFVLNGTSSSNKVVLNALLTPGDLVLFDRNNHKSNHHGALLQAGATPVYLETARNPYGFIGGIDAHCFDESYLRELVSEVAPGRARDERPFRLAVIQLGTYDGTIYNARQVVDKIGHLCDYILFDSAWVGYEQFIPMMADCSPLLLELNENDPGILVTQSVHKQQAGFSQTSQIHKKDSHIKGQARYVPHKRLNNAFMMHASTSPFYPLFAALDINARMHEGQSGRNMWMDCVVTGIEARKLILQNCQFIRPFVPETVDGRPWESWDTAEIATDLRFFHFVPGERWHAFEGYAEHQYFIDPCKLLLTTPGINARTGEYDDFGVPATILANFLRENGIVPEKCDLNSILFLLTPAEDMGKLQQLVAQLVRFEKLLQSDVPLKEVLPSLYKQHPERYADYTLRQICQEMHDLYARHNVKQLQKEMFRRSHFPRVMMNPQEANYAYLRGEVELVSLRDAEGRIAAEGALPYPPGVLCVVPGEVWGGSVLRYFAALEDGINLLPGFAPELQGVYVEECDGRKQVRCYVIKQPAAQPSLLKGEKL

SEQ ID NO: 8905 - protein, 249 aa, Enterobacter cloacae
FPEKVLNRRDPMGNKPMYRQIADAFREKINAGELKPGDALPTESSLQEAFSVSRVTVRQALKLLADEQIIESIQGSGSYVKEERVNYDIYQLTGFYEKLADRNVDTHSDVSVFEVVKADERLATKLALNPDDKVWHVKRVRFIREKPVNLEETWMPLAMFPDLTWEVMEQSKYHYIEQIKKMVIDRSEQELVPVMPSDEAIAALALDPAKPILEKVSRGFLKDGRVFEYSRNVFNSDDYKFTLVAKRRQ

SEQ ID NO: 8906 - protein, 406 aa, Enterobacter cloacae
KARSVRMLLISVRWVPKGYSPFDPGFTSTASCESKITYIDGDEGILLHRGFPIDQLATESNYLEVCYILLNGEKPTQAQYDEFKTTVTRHTMIHEQITRLFHAFRRDSHPMAVMCGITGALAAFYHDSLDVNNPRHRDIAAFRLLSKMPTMAAMCYKYSIGQPFVYPRNDLSYAGNFLRMMFSTPCEEYEVNPVLERAMDRILILHADHEQNASTSTVRTAGSSGANPFACIAAGIASLWGPAHGGANEAALKMLEEISSVEHIPEFVRRAKDKNDSFRLMGFGHRVYKNYDPRATVMRETCHEVLKELGTKDDLLEVAMELEHIALNDPYFIEKKLYPNVDFYSGIILKAMGIPSSMFTVIFAMARTVGWIAHWNEMHSEGMKIARPRQLYTGYEQRDFKSDLKR

SEQ ID NO: 8907 - protein, 230 aa, Enterobacter cloacae
ITRGFVINVLIVEDELAISRFLRTALEGDGLRVHEAGTLQRGLIEAATRKPDLVILDLGLPDGDGIDFIREVRQWSQMPILVLSARTEETDKIAALDAGADDYLIKPFGIGELQARLRVALRRHSATSPSDPVYAFGDIRVDLAARRIVRGEEEIHLTPIEFRLLAVLLNNHGKVLTQRQLLSQVWGPNAVEHSHYLRIYMGHLRQKLEADPARPRHLLTETGIGYRFMI

SEQ ID NO: 8908 - protein, 462 aa, Enterobacter cloacae
RSQTGALLRHQTTCRSAIAAERRKIMSKANKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELFGATLTPVQIGLATIGVLWICTVANFGGARITGQLSSITVWGVIIPVVGLCIIGWFWFSPTLYANSWNPHHVPFFTAVGSSIAMTLWAFLGLESACANAEVVENPEKNVPIAVLGGTLGAAVIYIVSTNVIAGIVPNMDLANSTAPFGLAFAQMFTPEVGKVIMGLMVMSCCGSLLGWQFTIAQVFKSSADEGYFPKIFSRVTKADAPVQGMLAIVIFQSGLSLMTISPSLNSQFNVLVNLAVVTNIIPYILSMAALVIIQKVAKVDPRKARAANIVALIGAIYSFYALYSSGQEAMLYGAMVTFMGWTLYGLVSPRFELKNKHS

SEQ ID NO: 8909 - protein, 176 aa, Enterobacter cloacae
EGILMSVQQTKAELLLAIDKNFSKLISYLKAIPPEITSDNSMDGHAKGTEMSVRDLVSYLIGWNALVVKWITSDAKGLPVDFPETGYKWNQLGLLAQKFYSDYSGLTYELLIIELQTVKNELVKLIDERTDDILYGRPWYTKWTMGRMISFNTSSPYANANGRLRKWAKNNNISLK

SEQ ID NO: 8910 - protein, 199 aa, Enterobacter cloacae
NYMDEKSLYAHILNLTAPWQVKSLTLDENAGSVTVTVGIAENIQLTCPTCGKSCPVHDHRHRKWRHLDTCQFATLVEADVPRIMCPDHGCQTLPVPWAGPGSRYTLLFESFVISWLKISTVDAVRKQLRLSWNAVDNIMQRAVKRGLARRKAPQSARHLCVDEVAFKKGHQYVTVISDTQGQALELRDDRGVESLAGYL

SEQ ID NO: 8911 - protein, 104 aa, Enterobacter cloacae
SLGDRQIESIKTLSMDMNQAYISAARIHLPNAVEKIAFDHFHVAKMLCAVVDKTRQSEMRIIPLQARKSAHRSRYLWLYGRHKRHGRIAERLEAAQMVLPCQRQ

SEQ ID NO: 8912 - protein, 268 aa, Enterobacter cloacae
GAAVMYELETLLNRLKMEHLSYHVENLLEQAAKQELNYREFLCMALQQEWSGRHQRGMEARLKQARLPWVKTLEQFDFSFQPGIDRKVVRELASLAFVERSENVILLGPPGVGKTHLAVALGVKAADAGHRVLFMPLDRLVATLIKAKQENRLERQLQQLSYARVLILDEIGYLPMNREEASLFFRLLNRRYEKASIILTSNKGFADWGEMFGDNVLATAILDRLLHHSTTLNIKGESYRLKEKRKAGVLAKSATPISDVEMVESGQR

SEQ ID NO: 8913 - protein, 399 aa, Enterobacter cloacae
GSHTEKDSSMLSREDFFMIKQMRQQGAYIVDIATQVGCSERTVRRYLKYPEPPARKTRHKMAKLKPFMDYIDMRLAENVWNSEVILAEIRTMGYTGGRSMLRYYIQPKRKMRPSKKTVRFETQPGYQLQHDWGEVEVDVAGQRCRVNFAVNTLGFSRRFHVFAAPKQDAEHTYESLVRAFRYFGGSVKTVLVDNQKAAVLKNSNGNVVFNAGFLLLADHYGFLPRACRPRRARTKGKVERMVKYLKENFFVRYRRFDSFPHVNQLLEQWIADVADRRELRQFRETPAERFVVEQTHLQPLPATDFDTSYFDIRHVSWDGYIEVGGNRYSVPESLCGHPVSIRISLDDELRIYSNENLAATHRLSGASSGWQTVPEHHAPLWQQVSQVEHRPLSAYEELL

SEQ ID NO: 8914 - protein, 110 aa, Enterobacter cloacae
QPETSRCWAMKEMARELWNRRYDGHSRRLWLEWIAMAKDVGVPQLSSAARTLRKRLYGILNAMKHRVSNGNAESLNSKIRLLRIKSRGYRNKERFKIAVMFHYGRLNMGL

SEQ ID NO: 8915 - protein, 198 aa, Enterobacter cloacae
CAPDTPRSRGVSLFLTGEMIMSSRGVNKVILVGNLGQDPEVRYIPNGSAVATLSLATSESWRDKQSGEQKEVTEWHRVVIFGKLAEIAGEYLRKGSQVYIEGQLRTRKWTDQAGQDKYTTEVVVNIGGTMQMLGGRQSGSGQNTSSRNDWGQPQQPSGPTHSGQASGSSAGAPPMDFDDDIPFIGFGYGVPKSAIHAL

SEQ ID NO: 8916 - protein, 703 aa, Enterobacter cloacae
RRQTMSNRYVIEALLRPAVELNTAVVSGMAAYVCVQAPWAVALAPSVSYVTAAGFAALAVTRTHQGMKIIRYRRNLRRLPRYVMSTKQIPVSHRRLFLGRGFRWTQKHTQRLQDTLRPEVARYLQPNRFYQGARQLELLTEHRLPWLGKLLSADTPLNPVRPLPPVGGNPALHGIEPDEKDVTLALGERVGHTVVYGTTRVGKTRLAELLVTQDIRRGEVTIVFDPKGDADLMKRVWAEAHRAGRGDELYIFHLGWPEISARYNAVGRFGRVSEVASRVAGQLSGEGNSAAFREFAWRFVNIIARALVALGERPDYTLIMRYVNNIADLYIRYAEKIIQAQLPALQTQIENNQQVLGEDDVPRNMQGQPDALRIWAIEVALSSEEGKKLYDPILDGLRSAVRYDRTYFDKIVASLLPLLEKLTTGKTAELLSPDYQDIDDTRPIFDWEQIIRKKAVVYVGLDALSDSEVASAVGNSMFADLVSVAGHIYKHGINAGLPGGKEGKSLINLHCDEFNELMGDEFIPLINKGGGAGMQVTAYTQTSSDIEARIGNAAKTAQVQGNFNNLIMLRVRENRTAELLTTQLPQVEIYTKTLVSGHQDTADVNADQDFTSSTQDRVGTVKVPLLEPADIVTLPKGQAFALLEGGQLWKIRMPLPAGDADDVLMPESIEKIAEEMRRSYHSGESWWRDGPALNVPVTGGANG

SEQ ID NO: 8917 - protein, 674 aa, Enterobacter cloacae
RGRQHMQLFLCEKPSQAKDIARVLGISKREQGFISGGNIVVTWAVGHLLETASPEAYGEQYGRPWRADVLPVLPEAWKMVVKEQTKSQFTVISKLLKKASEVVIATDADREGEVIARELLEYCHYSGAVRRLWLSALDEASVKEALSSILPGEKTALLYDAGKGRSQADWLIGMNLTRLYTLKARDSGVSEVLSVGRVQTPTLAMVVNRDNEITSFVPKPWWQVHALIEKEGVRFRAGWVPVEQYCDEEKRCINPQAARAVGQLCQQQGRATVLEVTQKREKTAAPLCFDLGTLQQVCSRKFGMGANDVLAIAQSLYETHKATTYPRTDCGFLPTSMQQEIPDVLAAVAKSDPAVAPVLNQLDRKFVSRVWNDKKITAHHAIIPTRQAFDLSRLSADELKVYQLIRQHYFAQFLPLQESDVTEASFNIGGQLFRTRGKVGVVTGWKSLFQAEKDDDEEDADGDSMALPALAKGDICAVTGAEVKDMKTSPPKPFTEGTLIAAMKNAASFVSDPKLKKVLRDNAGLGTEATRAGVLETLFKRHYLEKKGKHIHSTQVARELIAALPETLTSPGMTALWEQALDDISQGKMSLAVFMQKQLQWTRHLVEKGRQDSVKITAPVTPPCPLCKGPTRKRKGKNGDFWGCIRYPDCEGIISTGKKKAAKRKKTSVKAKTE

SEQ ID NO: 8918 - protein, 192 aa, Enterobacter cloacae
AVMSAPYINGLLMAHPYGAVILVVLFLVVMVFLNLRRREKASTRRHRRYRATAGRVLNKLNSLPGDGQRLTYLRKISPYVFEELLLSAFERQGLTVVRNASYSADGGLDGQVIIDGEYWLIQAKRYSRAVSPAHVEDFDRLLLQTGRRGLFVHTGRTGKMSRAIRTTSPRLRIISGQRLLTILAGQDVRQYL

SEQ ID NO: 8919 - protein, 493 aa, Enterobacter cloacae
YLMRKTVKKTPSFSAARVSLLLTGSLLTVLPAAHAADDDNTILGMSLPQVNNSAIGYGKSVDGAVSDKLFYTLGGGSVISQPATRGNMQKLGLNTGWSSDLMCGNFDLKTTVGNQLNGVTSGFKNLMGDVIQGATGAVASLPAMVIQRANPGLYDMLTNGVLQANVSFDKAQLNCQNMAKKMMDFSDSSNWTQQAMMDEYKSVVNSGDTDAVRADEAGRKVTGTSGNNWIGGQKRGGAGQPAIRVTHDLVAAGYNMMNGLPVTANSTVGESSCNGGACSKFGSAEEAAAMTVKVLGDRSMRTCANASECTSGDADDQPGTTVAGTGFAPLLEEATKANAEQLVRLVNGTEKPTAANLAKLKTGGLPVTAGVIKALQRDPDNAALTARLAGELAMSDTVETALLMRRMMVTGMSEPNAAAQPKAIDTAGQRIEALDREIAALKNEMEMKRELSRNSVLTIIDRENQRVETNPQTQSDDNTDSRFNQMAAPQSAE

SEQ ID NO: 8920 - protein, 97 aa, Enterobacter cloacae
RGSLKITKHCFWRPGMTISAKRVSFDEATMWVELNDARTIGVPLAWFPRLLHASTEQLNSYELSPRGIHWDALDEDISIAGLLEGRGDVTHRPHKVA

SEQ ID NO: 8921 - protein, 505 aa, Enterobacter cloacae
NRRPAMQIKSNALVKFIVPAVVIAGLAVGLKSCKNEPAEPSQAKQSGGPLHNLPPDELKALGVEGDTPEDTLRTLIGRLNDVRERQKTLDKQNADLVKENERLRRRNQDVSGQVNEAVNGLREQYDKRQAQLQNEQLSLTAKIQELTDKLKKPDSEKKTADSDIPLGLGLDGMGSSTGGAASQGSDGMMWVAPTDQKEADPRDAASGKASPQFPTSFLGENELTRQKAAYEEKVKGRTNEKGAEESAEPVYTLPENSTLVGSRAMTALLGRVPINGTVTDPYPFKVLIGKDNLTANGIELPDVEGAIVSGTASGDWTLSCVRGQVNSITFVFSDGTVRTLPRPDTSNNAGGQNNNAQAKQDTSTSGGIGWISDENGIPCIGGERKSNASTYLPTIFGLSAAGAAGEAMSQGQYTTQNNVNGISATMTGDAGQAALGKAISGGMSETTDWIKQRYGMTFDAIYVPPGARLAVHITRQLAIDYEEKGRKVRYDFTLPGGVSDNGGLD

SEQ ID NO: 8922 - protein, 109 aa, Enterobacter cloacae
FEGRVMPIPLEQTMCWDKSSQKNSANTPVLMMAAIARLTGSNPSLACVPLFGDGVSCGFPSPAQDYVEKRLSLDDLCIRYPESTYLVRAEGDSMLNAGIKDGDLLIVRY

SEQ ID NO: 8923 - protein, 475 aa, Enterobacter cloacae
GFMMSKVKQTDIDQLIVLVGGRDNIATVSHCITRLRFVLNDPAKANPKAIEELSMVKGCFTNAGQFQVVIGTEVGDYYQALLATTGHSSADKEQAKKAARQNMKWHEQLISHFAEIFFPLLPALISGGLILGFRNVIGDVPMSDGKTLAQMYPALQSIYDFLWLIGEAIFFYLPVGICWSAVRKMGGTPILGIVLGVTLVSPQLMNAYLLGQQTPEVWNFGLFTIAKVGYQAQVIPALLAGLALGFIETRLKRIVPDYLYLVVVPVCSLILAVFLAHAFIGPFGRMIGDGVAFAVRHLMTGSFAPIGAALFGFLYAPLVITGVHQTTLAIDMQMIQSLGGTPVWPIIALSNIAQASAVTGIIIVSRKHNEREISVPAAISAYLGVTEPAMYGINLKYRFPMLCAMIGSGLAGLLCGLNGVMANGIGVGGLPGILSIQPAFWQVFALAMAVAIIIPMALTTVVYQRKFRQGTLQIV

SEQ ID NO: 8924 - protein, 564 aa, Enterobacter cloacae
FSLSGRSCAPSHLQERTMNTLPHWWQNGVIYQIYPKSFQDTTGSGTGDLRGVTQRLDYLKTLGIDAIWLTPFYISPQVDNGYDVANYTAIDPTYGTLDDFDELVARAHEHGIRIVLDMVFNHTSTQHAWFRESLDKASPYRQFYIWRDGTPDTLPNNWRSKFGGNAWRWHAESEQYYLHLFAPEQADLNWENPAVRAELKKVCEFWADRGVDGLRLDVINLVSKDQDFPDDTLGDGRRFYTDGPRIHEYLQEMSRDVFTPRNLMTVGEMSSTSLENCQQYASLDGRELSMTFNFHHLKVDYPGGEKWTKAKPDFVALKTLFRHWQQGMHNKAWNALFWCNHDQPRIVSRFGDEGEHRVAAAKMLGMVLHGMQGTPYIYQGEELGMTNPHFSRITDYRDVESLNMFAEQRANGRDTDELLAILASKSRDNGRTPMQWDASHNAGFTEAEPWIGVCDNYETVNVRAALDDPDSVFYTYQSLIRLRKTLPVLTWGDYEDLLPDHPSLWCYRRQWQGQTLMVVANLSHLPQEWQADALSGESQVVISNYPAPHTSMLRPFEAVWWLKQ

SEQ ID NO: 8925 - protein, 160 aa, Enterobacter cloacae
GHQVNAMNYHQYYPVDIVNGPGTRCTLFVSGCVHECPGCYNKSTWRLNSGMPFTAEMEDRIINDLNDTRIKRQGISLSGGDPLHPQNVPEILKLVKRIHHECAGKDIWVWTGYKLDELNAQQMEVVDLINVLVDGKFMQDLKDPMLIWRGSSNQVVHHLR

SEQ ID NO: 8926 - protein, 195 aa, Enterobacter cloacae
LVTLASFFKEPDMTKQPEDWLDDVPGDDIEDEDDEIIWVSKSEIKRDAEELKKLGAEMVELGKNALDKIPLDQDLRDAIELAQKIKKEGRRRQLQLIGKLLRQRDVEPIRQALDKLKNRHNQQVALFHKLEQIRDRLIEQGDDAVPEVLNLWPNADRQQLRSLIRNAKKEKEGNKPPKSARLIFQYLRELSENEE

SEQ ID NO: 8927 - protein, 155 aa, Enterobacter cloacae
PVRMGAKKQRHLTVALSFFRTGLCLTSYRFQSALTRRPNVGTRTSMHCRKASGSTGERIHRPWCARHQVRPAWHYQYDKPHPVPFRSPELRLDSGPDCTTGSFRLCNFPATGRWSSSGCCLAWFVNCRKQIFALLKLKLIEQIKCLVYAGHCFQI

SEQ ID NO: 8928 - protein, 188 aa, Enterobacter cloacae
GNTMTLRNLLVAACLLLPLMASAHNIEKGQRVPPVGIADRGELILDNDKFSYKTWNSAQLAGKVRVVQHIAGRTSAKEKNATLVEAIKAAKLPHDRYQTTTIVNTDDAIPGSGMFVRSSLENNKKLYPWSQYMVDSNGVTRKAWQLEEESSAIVVLDKNGRVEWVKDGALTQDEVQQVVALLHKLLTQ

SEQ ID NO: 8929 - protein, 690 aa, Enterobacter cloacae
TIPLSVKQFWFQRPFFWQHSHFCKQQILHTYSFVAWIEKRTPQMIKFSATLLATLIAASVQAATVDLRILETTDLHSNMMDFDYYKDTPTEKFGLVRTASLINAARGEVKNSVLVDNGDLIQGSPLGDYMAAKGLKKGEIHPVYKAMNTLDYAVGNLGNHEFNYGLKYLHDALAGAKFPYVNANIIDVKTKKPRFTPYLIKETEVVDQDGKKQTLKIGYIGFVPPQIMTWDKANLDGKVTVNDITETARKYVPKMRAKGADVVVVVAHSGLSADPYQVMAENSVYYLSQVPGVDAILFGHAHAVFPGKDFADIKGADIEKGTLNGVPSVMPGMWGDHLGVVDLVLNNDSGSWKVTQSKAEARPIYDAAAKKSLAGEDKKLVDVLKHDHDATREFVSKPIGKSADNMYSFLALVQDDPTVQVVNMAQKAYAEHYIQGDPDLANLPVLSAAAPFKVGGRKNDPASYVEVEKGQLTFRNAADLYLYPNTFVVVKATGKEVKEWLECSAGQFNQIDPHSSKPQSLINWDGFRTYNFDMIDGVDYQIDVTQPAKYDGECQAINPQAERIKNLTFNGKAIDPNATFLVVTNNYRAYGGKFAGTGDSHIAFASPDENRSVLAAWISAESKKAGEIHPAVDNNWRLAPIHSDTKLDIRFETSPSDKAAAFIKDKAQYPMQKVATDDIGFAIYQVDLSR

SEQ ID NO: 8930 - protein, 716 aa, Enterobacter cloacae
NGVIMTPHVMKRDGCKVPFKSERIKEAILRAAKAAGVDDADYCATVAEVVSSQMHERSQVDINEIQTAVENQLMSGPYKQLARAYIEYRHDRDVQREKRGRLNQEIRGLVEQTNSSLLNENANKDSKVIPTQRDLLAGIVAKHYARQHLLPRDVVSAHERGEIHYHDLDYSPFFPMFNCMLIDLKGMLTHGFKMGNAEIEPPKSISTATAVTAQIIAQVASHIYGGTTINRIDEVLAPFVTESFNKHRKTAEEWQIPNADGYARSRTEKECYDAFQSLEYEVNTLHTANGQTPFVTFGFGLGTSWESRLIQQSILRNRISGLGKNRKTAVFPKLVFAIRDGLNHKFGDPNYDIKQLALECASKRMYPDILNYDQVVKVTGSFKTPMGCRSFLGVYEDENGEQIHDGRNNLGVISLNLPRIALEAKGNEAAFWTLLDERLQLARKALMTRIARLEGVKARVAPILYMEGACGVRLKADDDVSEIFKNGRASISLGYIGIHETINALFGDKHIYDNDALREKGIAIVQRLRDAVDQWKEETGYGFSLYSTPSENLCDRFCRLDTAEFGIVEGVTDKGYYTNSFHLDVEKKVNPYDKIDFEAAYPPIANGGFICYGEYPNIQHNLKALEDVWDYSYQHVPYYGTNTPIDECYECGFTGEFECTSKGFTCPKCGNHDAARVSVTRRVCGYLGSPDARPFNAGKQEEVKRRVKHLGNGQIG

SEQ ID NO: 8931 - protein, 349 aa, Enterobacter cloacae
DCWTSTALLNIRCRESVMKTLGEFIVEKQHEFSHATGELTALLSAIKLGAKIIHRDINKAGLVDILGASGAENVQGEVQQKLDLFANEKLKAALRARDIVAGIASEEEDEIVVFEGCEHAKYVVLMDPLDGSSNIDVNVSVGTIFSIYRRVTPVGTPVTEEDFLQPGSKQVAAGYVVYGSSTMLVYTTGCGVHAFTYDPSLGVFCLCQERMRFPEKGNTYSINEGNYIKFPNGVKKYIKFCQEEDKATQRPYTSRYIGSLVADFHRNLLKGGIYLYPSTASHPDGKLRLLYECNPMAFLAEQAGGKASDGKERILDIVPESLHQRRSFFVGNRHMVDDVERMIREFPDA

SEQ ID NO: 8932 - protein, 209 aa, Enterobacter cloacae
RREGEKSKTGGDFQRQLAIIPATCLPSILKDTDMSLLNVPAGKELPEDIYVVIEIPANADPIKYEIDKDTGALFVDRFMSTAMFYPCNYGYINHTLSLDGDPVDVLVPTPYPLQPGSVIRCRPVGVLKMTDEAGEDAKLVAVPHTKLSKEYDHIKDVNDLPELLKAQIAHFFEHYKDLEKGKWVKVEGWDNAEAAKAEIIASFERAAKK

SEQ ID NO: 8933 - protein, 223 aa, Enterobacter cloacae
PKQRYPGGPTVSLFDKKHLVSQADALPGRNTPMPVATLHAVNNHSMTNVPDGMEIALFAMGCFWGVERLFWQLPGVYSTAAGYTGGYTPNPTYREVCSGETGHAEAVRVVYDPSVISYEQLLQVFWENHDPAQGMRQGNDHGTQYRSAIYPLTPEQEAAAHASLTRFQEAMQAAGDKRQVTTEIATAKPFYYAEDDHQQYLHKNPYGYCGIGGIGVCLPPQQD

SEQ ID NO: 8934 - protein, 446 aa, Enterobacter cloacae
TMLNSILVILCLIAVSAFFSISEISLAASRKIKLKLLADEGNINASRILKMQENPGMFFTVVQIGLNAVAILGGIVGDAAFSPAFYGLFVKYMSVELAEQLSFILSFSLVTGLFILFADLTPKRIGMIAPEAVALRIINPMRFCLYVFRPLVWFFNGLANVIFRIFKLPMVRKDDITSDDIYAVVEAGALAGVLRKQEHELIENVFELESRTVPSSMTGRENIIWFDLHEDEQSLKTKVAQHPHSKFLVCNEDIDHIIGYVDSKDLLNRVLANQSLALNSGVQIRNTLIVPDTLTLSEALESFKTAGEDFAVIMNEYALVVGIITLNDVMTTLMGDLVGQGLEEQIVQRDENSWLIDGGTPIEDVMRVLDIDEFPQSGNYETIGGFMMFMLRKIPKRTDSVKFSGFKFEVVDIDNYRIDQLLVTRIDSKPTVLVPKLPDAEEKVSA

SEQ ID NO: 8935 - protein, 74 aa, Enterobacter cloacae
FAGDTRMKIFQRYNPLQVAKYVKILFRGRLYIKDVGAFEFDKGKILIPKVKDKQHLSVMSEVNRQVMRLQTEMA

SEQ ID NO: 8936 - protein, 979 aa, Enterobacter cloacae
IMSLWKKISLGVLIFIVLLLGTVAFLVGTTTGLHLLFNAANRWVPGLEIGQVTGGWRDLRLKNIRYEQPGVAVNAGEFHLAVKLGCLRDSQLCVNDLSLKDVNVAIDSKKMPKSEPVEEEDSGPLNLSTPYPIALYRVALDNVNIKIDDTTVSVMDFTSGLRWQEKNLTLTPTSLQGLLIALPKVADVAQEEIVEPKIQNPQPEEKPLGETLKDLFSKPVLPEMTDVHLPLNLNIEEFKGEQLRLTGDTDLTVFNMLLKVSSIDGNMKLDALDIDSSQGSVNASGNAQLRDNWPVDITLNSALNIDPLKGEKVKVKVGGALREKLEFGVNLSGPVDMVLRGQTQLAEAGLPLNLEVVSKQLYWPFTGEKQFQADDLKLKLSGKMTDYTLSFRTAVKGQGVPPADITLDAKGNELQVNLDKLTVAALEGKTELTALLDWQQAISWRGELKLTGINTAKEVPDWPSKLDGLIKTRGSLYGGTWQMDVPELKLTGNVKQNKVNVEGSLKGNSYLQWVIPGLHVALGRNTADIKGELGVKDLDLDATIDAPNLDNALPGLGGTAKGLVKVRGTVEAPQLLADITANNLRWQELSIARVRVEGDVKSTDQIGGNLDLRVERISQPDVNISLVTLAAKGNEKQHDLQLRVQGEPVSGQLHLTGSFDRQATRWKGVLDNTRFSTPVGPLVLSRSIALDYRNAEQKLSIGPHCWTNPNAELCVPQTIDAGAEGRAQINLNRFDLAMLKPFMPETTQASGVFSGKADVAWDTTKEGLPQGSVTLSGRNVKVTQEVNDAPLPVAFDTLNVNADLRNNRAELGWLIRLTNNGQFDGQVQITDPQGRRNLGGNVNIRNFNLAMVNPIFSRGEKAAGMLSANLRLAGDAQSPQLFGQMRLNGVDIDGNFMPFDMQPSQLTMNFNGQSSTLSGSVLTQQGQINLSGDADWSQLDNWRARIAAKGSRVRITVPPMVRLTFRRTGAWRQPGFFHP

SEQ ID NO: 8937 - protein, 277 aa, Enterobacter cloacae
RRVDVPWRASCSRSPGKRGGVSSDGVMLNENLKPVEQKSAGIPINSNLIVHVGNNVRLDAFGLKARLTGDLKVAQDQQGLGLNGQINIPEGRFHAYGQDLIVRKGELLFSGPPDQPVLNIEAIRNPEATEDDVIAGVRVTGSADEPKAEIFSDPAMSQQEALSYLLRGQGLDSQQGDGAAMTSMLVGLGVAQSGQVVGKIGETFGVSNLALDTQGVGDSSQVVVSGYVLPGLQVKYGVGIFDSLATLTLRYRLMPKLYLEAVSGVDQALDLLYQFEF

SEQ ID NO: 8938 - protein, 350 aa, Enterobacter cloacae
MPSRRKESNVMSRSLSQTGEAKRRFTWPTGTPQIVALLLVLLVDSLVAPHFFQIVVQDGRLFGSPIDILNRAAPVALLAIGMTLVIATGGIDLSVGAVMAIAGATAASMTVAGHSLPVVLLAALGSGVLAGLWNGILVAVLKIQPFVATLILMVAGRGVAQLITSGQIVTFNSPSLAWIGSGNFLFFPTPVIVALVTLVVFWLFTRKTALGMFIEAVGINIRAAKNAGVNTRLMVMLTYVLSGVCAAIAGVIVAADIRGADANNAGLWLELDAILAVVIGGGSLMGGRFNLLLSVVGALIIQGMNTGILLSGFQPELNQVVKAVVVLIVLIVQSPRFITLIKRFRGHDKT

SEQ ID NO: 8939 - protein, 402 aa, Enterobacter cloacae
SSPLPFGERVRVRGNKPHTPEGATMHTRTLLVASLSMLATAAVAQTQYAWVGTYNPNGEGLYRFTVDPQTGALNDKTLVSKLPNAAQLTVSHDGKTLYLASEVEQGVVQALRIGDNGTLSELNQVASGGAGPVYLSLTPNGKHLLVANYISGTVAVLPVNADGSLSDATDTHQDKGEPGAAKPEAAVEGSFAISDHNGPHAHMIAADPSGKYVFSTDLGLDRIYQYRFDDQTGKLTPNDPPFISASSKGAGPRHFVFTPKGDALWLINEEASTLTHYALDSNGRLKEGKTVSALPDGYKGTSFAAGLALSADGKQLYVANRLHNSIGHFTVTAEGTLTHQDDVWTRGDYPRTLTLDKQGRWLYVMNQRSDNITRFRVAPDGKLSAEPDYTPVGSPSQMVISP

SEQ ID NO: 8940 - protein, 257 aa, Enterobacter cloacae
VMPTALTKRWRMLDKICQLARDAGDAIMQVYDGAKPMDVVSKADDSPVTAADIAAHAVILKGLQALTPDIPVLSEEAPQSWDERQHWQRYWLVDPLDGTKEFIKRNGEFTVNIALIENGKAVLGVVYAPVMKVMYSAAEGKAWKEECGVRKQIQVRDARPPLVVISRSHSDSELEEYLQQLGEHQTTSIGSSLKFCLVAEGQAQLYPRFGPTNVWDTAAGHAVAAAAGAHVHDWQGKPLDYTPRESFLNPGFRVSLY

SEQ ID NO: 8941 - protein, 619 aa, Enterobacter cloacae
EIFGCYTLFQPVIWVFGFQAVFCRGAALHLLPGWKQGYSGENVTKIRQLCLVSLLLTSGIASAANVRLQVEGLSGALEKNVRAQLSTIQSDEVTPDRRFRARVDDAIREGLKALGYYEPTIDFDLRPPPAKGRQVLIARVSPGEPVLIGGTNVVLRGGARTDRDYLDLLSTRPKVGTVLNHGDYDRFKKSLTSVSLRKGYFDSQFNKSQLGVALERRQAFWDIDYDSGERYRFGDVTFEGSQIRDEYLQNLVPFKKGDYYQSSDLGELNRRLSATGWFNSVVVAPEFDKSRKTKVLPLHGVVSPRTENTIETGVGYSTDVGPRVKASWKKPWMNSYGHSLTTSVSLSAPEQQLDFSYKMPLLKNPLEQYYLVQGGFKRTDLNDTEQDSTTLAVSRFWDLSSGWQRAINLRWSLDHFTQANVTNTTMLLYPGVMISRTRSRGGLMPTWGDSQRYSIDYSNTAWGSDVDFSVFQAQNVWIRTLYDKHRFVMRGNLGWIETGDFERVPPDLRFFAGGDRSIRGYKYKSISPENDKGQLTGASKLATGSLEYQYNVSGKWWGAMFVDGGEAVNDIRRSDFKTGAGVGVRWQSPVGPIKLDFAVPVGDKDEHGLQFYIGLGPEL

SEQ ID NO: 8942 - protein, 362 aa, Enterobacter cloacae
IRSSKRSWCLSCLSCSRRALSLSLRGSAVMIKRNLPLMITLGVFVLGYLYCLTQFPGFASTRVICNILTDNAFLGIIAVGMTFVILSGGIDLSVGSVIAFTGVFLAKAIGFWGISPLLAFPLVLVMGCAFGAFMGLLIDALKIPAFIITLAGMFFLRGVSYLVSEESIPINHPIYDTLSSLAWKIPGGGRLSAMGLLMLGVVVIGIFLAHRTRFGNQVYAIGGSATSANLMGISTRSTTIRIYMLSTGLATLAGIVFSVYTQAGYALAGVGVELDAIASVVIGGTLLSGGVGTVLGTLFGVAIQGLIQTYINFDGTLSSWWTKIAIGILLFIFIALQRGLTVLWENRQSSPVTRVNTSLTER

SEQ ID NO: 8943 - protein, 540 aa, Enterobacter cloacae
RPILFFYAQKYLATGNNIMLKTLSIRTGLLSLLAVMTLLLLIVSGIGIYALTQSSASLQRINHLQGEQMVQLNAGYTLILRARNEAGQAVRMMEVGLLDDAARAVKTINQEVALAQKTLKDVIGSGVADEQGQKLLDNVAASLAVYNQQGISPMLKALNEQSADSYYDLLENKLVPVAKQFDNDMQAFQAWSEARGKAEVSAVQASKTRVLILIIVAALLTAGIIVLAWLVLRHMLLEPLSASIAQLEHVAAGDLTHTLNAPASQEFNRLNAAIEGMRQSLMDSVLRVRDASSQIDTGSRELTAGNMNLAQRTESTATSLEQTAASMEEITATVKLNADNAEQAHQLAKSVSDTADHGSEMVCYVIEKMRDISGSSARIADILSVIDGIAFQTNILALNASVEAARAGEQGRGFAVVAGEVRNLASRSADAAKEIHSLISDSQTHVNEGSELAQQAGETMDEIATEVLRMTKLMREIATASQEQSRGIEQVNIAVNQMDETAQQNAALVQQSSAATRSLEEQSRELMEAMASFKLTTQTA

SEQ ID NO: 8944 - protein, 458 aa, Enterobacter cloacae
RMRIHILGICGTFMGGLAMLARSLGHEVTGSDANVYPPMSTLLEKQGISLIQGYDASQLEPQPDLVIVGNAMTRGNPCVEAVLERNIPYMSGPQWLHDFVLRDRWVVAVAGTHGKTTTAGMATWILEACGYKPGFVIGGVPGNFDVSARLGDSPFFVIEADEYDCAFFDKRSKFVHYCPRTLILNNLEFDHADIFDDLKAIQKQFHHLVRIVPGQGRIILPENDINLKQTMAMGCWSEQELVGEQGHWQAKKLNADASEWEVLLDGEKVGEVKWGLVGEHNMHNGLMAIAAARHVGVLPADAANALGTFINARRRLELRGEAHGVTVYGDFAHHPTAILATLAALRGKVGGTARILAVLEPRSNTMKMGICKDDLAPSLGRADEVFLLQPQHIPWQVAEVADACIQPAHWSADVDVLADMVVKAAQPGDHILVMSNGGFGGIHQKLLDGLAKKAAAAE

SEQ ID NO: 8945 - protein, 391 aa, Enterobacter cloacae
YPRALRRPPYQENPMFDLLLRRARLADDTLTDIAIQDGKIAATGDINAPARKTVELNGDVFVSAGWIDSHVHCYPNSPIYHDEPDSVGIATGVTTVVDAGSTGADDVDDFYAITRKASTEVFALLNISRVGLIAQNELANMANIDADAVKEAVKRHPDFIVGLKARMSSSVVGENGITPLARAKAIQKENGDLPLMVHIGNNPPNLDEIAELLSSGDIITHCYNGKPNRILTPSGELRASITSALKRGVRLDVGHGTASFSFEVAKRAIAMGILPHTISSDIYCRNRINGPVGSLASVMSKFLAIGMSLPQVIDCVTANAADGLRLTRKGRIQPGLDADLTLFTLKRQPTVLTDAENDSLQAEHILVPLAAIRAGKGYMTEQGSTEHAFDL

SEQ ID NO: 8946 - protein, 640 aa, Enterobacter cloacae
EDNDVRFPNQRLAQLFDLLQNETLPQDELAQRLSVSTRTVRADITALNALLASHGAQFILSRGNGYQLKINDVARYQQLQASHPRALRIPRTGPERVHYLVVRFLTSAFSIKLEDLADEWFVSRATLQSDMVEVREWFHRYNLTLETRPRHGMKLFGSEMAIRACLTDLLWELAQQDSLNPLVTDVALNAGVAEKMVPVLHDALTRHHIRLTDEGELFLRLYCAVSVRRISEGYPLPEFHAEDVEENVHEAAKDIAVAIQELAGKALSPSEESWLCVHIAARQIQEIAPSAINADDDEALVNYILRYINTHYNYNLLSDEQLHADLLTHIKTMITRVRYQIMIPNPLLDNIKQHYPMAWDMTLAAVSSWGKYTPYVISENEIGFLVLHIGVGLERHYNIGYQRQPRVLLVCDAGNAMVRMIEAVLQRKYPQIEVTRTLTLREYELADAIGEDFVISTARVSEKSKPVVMIAPFPTDYQLEQIGKLVLVDRTRPWMLEKYFDAAHFRIIDKPVDQQTLFRELCEQLEAEGFVGAEFLDSVIEREAIVSTMLGDGIALPHSLGLLAQKTVVYTVLAPQGIQWGDETAHVIFLLAISKSEYEEAMAIYDIFVTFLRERAMARLCQCENFAAFKAVAMESLSRF

SEQ ID NO: 8947 - protein, 117 aa, Enterobacter cloacae
VLAMRIFVYGSLRTRQGNSHWMTNAQLLGNYTIENYQLYSLGHYPGAVPGNGTVQGEVYRIDNATLAELDALRTRGGEYARQLIQTPYGSAWMYVYQRSVDGLTLIESGNWLDRDQF

SEQ ID NO: 8948 - protein, 367 aa, Enterobacter cloacae
NESDYKLVINVLFTFLKCDVTQSVTYSIGYSSSAEHLLTNNNLPYEDVHMWKRLLLVTAVSAAMSSMAMAAPLTVGFSQVGSESGWRAAETNVAKSEAEKRGITLKIADGQQKQENQIKAVRSFIAQGVDAIFIAPVVATGWEPVLKEAKDAEIPVFLLDRSIDVKDKSLYMTTVTADNVLEGKLIGDWLVKQVDGKPCNVVELQGTVGASVAIDRKKGFAEAIAKAPNIKIIRSQSGDFTRSKGKEVMESFIKAENNGKNICMVYAHNDDMVIGAIQAIKEAGLKPGKDILTGSIDGVPDIYKAMIDGEANASVELTPNMAGPAFDALEKFKKDGTQPEKLTITKSTLYLPDTAKEELEKKKNMGY

SEQ ID NO: 8949 - protein, 537 aa, Enterobacter cloacae
PSSRRGEGKGRVGQKIKDGHDIVPSPLRGEGQGEGETMTTEQHQEILRTEGLSKFFPGVKALDNVDFSLRRGEIMALLGENGAGKSTLIKTLTGVYHADRGAIWLEGNAISPKNTAHAQQLGIGTVYQEVNLLPNMSVADNLFIGREPRRFGLLRRKEMEARAAKLMESYGFSLDVREPLNRFSVAMQQIVAICRAIDLSAKVLILDEPTASLDTQEVEMLFTLMRQLRNQGVSLIFVTHFLDQVYEVSDRITVLRNGSFVGCRETRELPQIELVKMMLGRELETNALQRAGRTLLSEKPIAAFHDYGRKGTIAPFNLEVRPGEIVGLAGLLGSGRTETAEVIFGIKPADSGTALIKGKLQTLRSPHQASCLGVGFCPEDRKTDGIIAAASVRENIILALQAQRGWLRPIPKREQNAIAERFIRQLGIRTPSAEQPIEFLSGGNQQKVLLSRWLLTKPQFLILDEPTRGIDVGAHAEIIRLIETLCADGLALLVISSELEELVGYADRVIIMRDRRQVAEIPLDKLSVPAIMNAIAA

SEQ ID NO: 8950 - protein, 477 aa, Enterobacter cloacae
KKRLMLPVKTRTEKRFSVRLHLTLSYSMAFAMKVTSQVEAQRKILEEAVSTALTLASGKSDGAEVAVSKTTGISVSTRYGEVENVEFNSDGALGITVYHQNRKGSASSTDLSPDAIARTVQAALDIARYTSPDPYAGVADKELLAFDAPDLDLFHPAEVTPDEAIELAARAEQASLQADKRITNTEGGSFNSHYGIKVFGNSHGMLQGYCSTRHSLSSCVIAEENGDMERDYAYTIGRALGDLQSPEWVGKACAERTLSRLSPRKLSTMKAPVIFANEVATGLFGHLVGAIAGGSVYRKSTFLLDSLGKQILPEWLTIEEHPHLLKGLASTPFDSEGVRTERRDIVKDGILTQWLLTNYSARKLGLKSTGHAGGIHNWRIAGQGLNFEQMLKEMGTGLVVTELMGQGVSGITGDYSRGAAGFWVENGEIQYPVSEITIAGNLKDMWRNIVTVGNDIETRSNIQCGSVLLPEMKIAGQ

SEQ ID NO: 8951 - protein, 129 aa, Enterobacter cloacae
AMRKHLLAIVAASTLVLGSSAFAADLEDNMDILSQNLKVVKKTDNAAEMKDALTKMREAALDAQKATPPKLESKAADSAEMKDYRHGFDVLVGQIDGALKLANEGKVKEAQAAADQFAATRNAYHKKYR

SEQ ID NO: 8952 - protein, 379 aa, Enterobacter cloacae
PNKGARNMPSIYEKYNLKQVINTSGRMTALGVSTPRPEVVQAAMNGMNHYFEMKELVNKTGEYIAKLLEVEGATVVSCASAGIAQSVAAVLVKDSDWLLENLHVTPIENNEIVLPKGHNVNFGAPVGTMVALGGGKLVEAGYANECSADQLAAAITPRTAAILYIKSHHCVQKSMLSVEQAAVVARKHDLPLIVDAAAEEDLHTYYRSGADLVIYSGAKAIEGPTSGLVIGKTQYVEWVKRQTAGIGRAMKVGKEGILGLTCAIEHYLTATKESGAEMVAKMTPFIEALNTLNGVTARVVWDSAGRDIARTEIKFDEATTGVGTGDLVNALKQGEYAIYFRGYKANEGIIEADVRSVNADQLNIVYRRISEVLGQEKNA

SEQ ID NO: 8953 - protein, 262 aa, Enterobacter cloacae
KDLIRSLSRLKSARSNAVIAFFFTFNRPDMTNSNRIKLTWISFFSYALTGALVIVTGMVMGNIADYFQLPVSSMSNTFTFLNAGILISIFLNAWLMEIVPLKTQLRFGFVLMVAAVAGLMLSHSIALFSAAMFVLGLVSGITMSIGTFLITHMYEGRQRGARLLFTDSFFSMAGMIFPMVAAYLLARSIEWYWVYACIGLVYVAIFILTFGCEFPVLGKKAQTTSEPVAKEKWGIGVLFLSIAALCYILGQLGFISLGSRVC

SEQ ID NO: 8954 - protein, 119 aa, Enterobacter cloacae
TYSGDAGGGKRMSQWVNICNINDILPATGVCALLGNEQVAIFRPRHDEQVYAISNIDPFFEASVLSRGLIAEHQGELWVASPLKKQRFRLTDGRCMEDESFSVKHYDVRVKDGEVQLKG

SEQ ID NO: 8955 - protein, 251 aa, Enterobacter cloacae
SDNVPARQVVLPCRARFFWLEFPLMHLDIDWQAVDTVLLDMDGTLLDLAFDNYFWQKLVPETYGEQQGISPAEAQEFIRSQYSAVQHTLNWYCLDYWSERLGLDICAMTTAQGARAVLREDTVPFLDALKACGKRRILLTNAHPHNLAVKLEHTGLASHLDLLLSTHTFGYPKEDQRLWHAVVEETGLQPERTLFIDDSEPILDSAAAFGIRYCLGVTNPDSGLAEKSYLRHPGLNDYRRMIPSLTVKETP

SEQ ID NO: 8956 - protein, 82 aa, Enterobacter cloacae
PLVESGAMQFTPDSAWKIIGFTREISPAYRQKLLSLGMLPGSSFQVVRVAPLGDPVHIETRRVNLVLRKKDLALIEVESLSR

SEQ ID NO: 8957 - protein, 782 aa, Enterobacter cloacae
QASGFSESITMKKLTIGLIGNPNSGKTTLFNQLTGARQRVGNWAGVTVERKEGQFTTTDNQVTLVDLPGTYSLTTISSQTSLDEQIACHYILSGDADLLINVVDASNLERNLYLTLQLLELGIPCIVALNMLDIAEKQKLRIDVDALSARLGCPVVPLVSTRARGIDALKLAIDRHTGNADVELVHYAQPLLREAGQLAQEMDNSMPARQRLWLGLQMLEGDIYSRAYAGDAADKLGVAQARLSDELDDPALHIADARYQAIAAICDVVSNALTAEPSRFTAAVDKIVLNRFLGLPIFLLVMYVMFLLAINIGGALQPIFDGGSVAIFVHGIQWLGYTLHFPEWLTIFLAQGIGGGINTVLPLVPQIGMMYLFLSFLEDSGYMARAAFVMDRLMQALGLPGKSFVPLIVGFGCNVPSVMGARTLDAPRERLMTIMMAPFMSCGARLAIFAVFAAAFFGQEGALAVFSLYVLGIVMAILTGLMLKHTIMRGEASPFVMELPVYHVPHLKSLIIQTWQRLKGFVLRAGKVIVVVSIFLSALNSFTLSGQAADNINDSALASVSRIITPVFKPIGVQEDNWQATVGLFTGAMAKEVVVGTLNTLYTAENIQEEEFNPAAFNLGDELLGAVEETWQSLKDTFSLSVLANPIEASKGDGEMATGAMGVMGQKFGSASAAYSYLIFVLLYIPCISVMGAIARESSRGWMGFSILWGLNIAYSLATVFYQAVNYSQHPRYSLVCILAVILFNVMVIGLLRRARSRVDINLLATRKTPTTCCNSPAGDCH

SEQ ID NO: 8958 - protein, 194 aa, Enterobacter cloacae
AKAMIRISDSAQAHFAKLLANQEEGTQIRVFVINPGTPNAECGVSYCPPDAVEATDTALKFEQLTAYVDELSAPYLEDAEIDFVTDQLGSQLTLKAPNAKMRKVSDDAPLMERVEYLLQSQINPQLAGHGGRVSLMEITEDGLAILQFGGGCNGCSMVDVTLKEGIEKQLLNEFPELKGVRDLTEHQRGEHSYY

SEQ ID NO: 8959 - protein, 248 aa, Enterobacter cloacae
FSRWSPRIFWRAALSGTGYMPALVWSMSRSLFSPSAASSRCWAKKRRLHPSRLRKKNGVSAYCSSPSPRCVTSSASWALSPWVPEYAKGLGMSLNDAGKLVSDFWMSYMFGMWAFSFILRFFDLQRILTVLAGLATVLMYLFINGSPEHMPWFILTLGFFSSAIYTSIITLGSLQTKVASPKLVNFVLTCGTIGTMLTFVVTGPIVAHSGPLAALHTANGLYAVVFIMCFVLGFVTRHRQHNPSTATH

SEQ ID NO: 8960 - protein, 822 aa, Enterobacter cloacae
ADAEQFDITVFCEEPRKAYDRVHLSSYFSHHTAEELSLVREGFYEKHGVKVLVGERAITINRQEKVIHSSAGRTVFYDKLIMATGSYPWIPPIKGSETQDCFVYRTIEDLNAIESCARRSKRGAVVGGGLLGLEAAGALKNLGVETHVIEFAPMLMAEQLDHMGGDQLRRKIESMGVKVHTSKNTKEIVQEGTEARKTMRFADGSELEVDFIVFSTGIRPRDKLATQCGLAVAQRGGIMINDTCQTSDPDIYAIGECASWNNRVFGLVAPGYKMAQVAVDHILGSENAFTGADMSAKLKLLGVDVGGIGDAHGRTPNSRSYVYLDESKEVYKRLIVSQDNKTLLGAVLVGDTSDFGNLLQLVLNAIELPENPDALILPAHASSGKPSIGVDKLPDSAQICSCFDVTKGMLISAINKGCHTVAALKAETKAGTGCGGCIPLVTQVLNAELAKQGIEVNNNLCEHFAYSRQELYHLIRVEGIKSFDELLEKHGQGYGCEVCKPTVGSLLASCWNEYVLKPEHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTASWLDNLEGGIDYLKSVIIDDKLGLNEQLESEMTRLREAVICEWTETVNTPAAQTRFKHFINSTQRDPNVQVVPEREQHRPATPYERIPVMLVEENA

SEQ ID NO: 8961 - protein, 60 aa, Enterobacter cloacae
QGMHMFKLAKAAVLVGLLTTLTACTGHVQNTKNNCSYDYLLHPAISISKIIGGCGPAAQQ

SEQ ID NO: 8962 - protein, 874 aa, Enterobacter cloacae
IRLAFILPRDCLETAQAKPNGKSPVKFVKYLLILAVCCILLGAGSIIGLYKYVEPQLPDVATLRDVRLQIPMQVYSADGELMAQYGEKRRIPLTLNQIPPVMVKAFIATEDSRFYEHHGVDPVGIFRAASVALFSGHASQGASTITQQLARNFFLSPEKTLMRKIKEVFLAIRIEQLLSKDEILELYLNKIYLGYRAYGVGAAAQVYFGKPIDQLTLSEMATIAGLPKAPSTFNPLYSQDRATARRNVVLSRMLSEGYISQSEYDKARSDVIDANYHAPEIAFSAPYLTEMVRQEMVSRYGDKAYEDGYRVYTTVTRKVQQAAQQAVRNNVMDYDMRHGYRGPSNVLWKVGEGAWDSKKITDSLKALPTYGPLRPAVVTQADPQEAVAMMADGTSVSLRMEGVRWARPYRSDTLQGPTPRKVTDVVQTGQQIWVRQVGDAWWLAQVPDVNSALVSINPQNGAVMALVGGFDFNQSKFNRATQALRQVGSNIKPFLYTAAMDKGLTLASILNDVPISRWDAGAGSDWQPKNSPAQYAGPIRLRQGLGQSKNVVMVRAMRAMGVDYAAEYLQRFGFPAQNIVHTESLALGSASFTPLQVARGYSVMANGGFLVDPYFISNIENDQGGVLFEAKPKIACPECDIPVIYGDTPKSNVLENKDMEDVAISQERQNLAVPQPQLEQANQALVAQSGVQEYAPHVISTPLSFLIKSALNTNIFGEPGWQGTGWRAGRDLQRHDIGGKTGTTNSSKDAWFSGYGPGVVTSVWIGFDDHRRTLGRTTASGAIKDQISGYEGGAKSAQPAWDAYMKAALEGVPEQPLTPPPGIVTINIDRSTGQLANGGNSRAEYFIEGTQPTTQAVHEVGTEIIDNGETHELF

SEQ ID NO: 8963 - protein, 116 aa, Enterobacter cloacae
LACCAGRVAALTLTCWQRAKPQRPAVTAQQATVTEGKKMASLIQVRDLLALQGRMEAKQLSLSLHTPQPMIDAMLERLEAMGKAVRIQEEPDGCLSGSCKSCPEGKACLREWWTLR

SEQ ID NO: 8964 - protein, 460 aa, Enterobacter cloacae
GNVVDHLPIFCQLRNRDCLLVGGGDVAERKARLLLEAGARLTVNALTFAPQFDVWAQEGMLTQVQGEFDESLLDTCWLTIAATDNDDVNQRVSDACEARRIFCNVVDAPKEASFIMPSIIDRSPLMIAVSSGGRSPVLARLLREKLEAVLPQHLGQIAQYAGLLRSRVKQTFATVGERRRFWEKFFVNDRLAQSLANQDTKAVEETTEQLLSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLVTGHLKTGSELDWHNLAAEKQTLVFYMGLNQAATIQAKLLEHGMEADMPVALVENGTAITQRVVDGVLTQLGELAQQVESPALIVVGRVVALREKLNWFSSH

SEQ ID NO: 8965 - protein, 716 aa, Enterobacter cloacae
DGESMSTILIFLAAVLACASIAVWVFRRRVHRRYRLPFLNAFAGANTRKLSPEERSTVEQYLDTLNRSRLSPGPTGASTAPVSLNLNAQSDTVLCVTRSITRYGITTDDPNKWRYYLDSVEVHLPPFWEQYINDENSVELIHTDTLPLVISLNGHTLSEYVQEAPRFALERASGTQASIRGEETEQIELLNIRQETHEEYVLSRPDGIREAVLIVASFLLFFICLLTPDVFVPWLAGGAVLLLAAGLWGIFAPPAKTSLREIHCLRGTPKRWGLFGENDQEHINNISLGIIDLIYPRHWQPWIAQDLGHKTDIDIYLDRHVVRQGRYLSLHDEVKNFPLQHWLRSAVIAGGAALIFLMLLLFVPLDMPIKFTLSWIKGAQTVEATSVQQLEEAGVRVGDTLRLKGTGMCNIHSPGAWNTRQNSPFAPFDCSQIIWNDASPLPLPESDVVNKATALTQTINRQLHPKPDDDSRVSPALRSAIQKSGMVLLDDFGEIVLKTEDLCSAQDDCIRLKNALVNLGNSKDWDALVKRAEAGRLDGVNVLLRPVSAESLDNLVATSTAPFVMRETTRAAQALNSPAPGGFVIASDEGSDLVDQPYPQVSLYDYPAQEQWSEFQRLAQMLMQTPFSAEGIVTTLFTDANGTRHIGLHRMPDSAGLWRYIGTSLLLIAMLACIVWNGYQAVRRYQRSRTRLAEIQAYYENCLNPKLISSSESLIG

SEQ ID NO: 8966 - protein, 158 aa, Enterobacter cloacae
KKLSATSGAERLSPDDPLTHREGDAMKEKPSDGVRLDKWLWAARFYKTRALAREMVDGGKVHYNGQRSKPSKLVELNATLTLRQGNDEKTVVVKAITEQRRPATEAVLLYEETAESIEKREKTALARKMNALTMPHPDRRPDKKERRDLMKFKHGESE

SEQ ID NO: 8967 - protein, 300 aa, Enterobacter cloacae
PSPAREMKMAQHDQLHRYLFEQFAVRGELVTVSETWKQILENHNYPLPVKTLLGELLVATSLLTATLKFAGDITVQLQGDGPMSLAVINGNNQQQMRGVARVQGDIPENADLKTLVGNGYLVITISPEEGERYQGVVGLEGDTLAACLEDYFMRSEQLPTRLFIRTGEVDGQPAAGGMLLQVLPAQDAQTNDFEHLATLTETIKAEELFTLSATDVLWRLYHEEEVTVYDPQDVEFKCTCSRERCAGALKTLPDEEIDSIMAEDGEIDMHCDYCGTHYVFNSMDIAEIRNNASPADPQVH

SEQ ID NO: 8968 - protein, 558 aa, Enterobacter cloacae
HPQKNPTISGSTYWLRSSDMRVNGLTPQDLKAYGIHDVQEVVYNPDYDTLYQEELNPALEGYERGVLTNLGAIAVDTGIFTGRSPKDKYIVRDDTTRDTLWWADKGKGKNDNKPLSPETWQHLKGLVTHQLSGKRLFIIDAFCGANADTRLSVRFITEVAWQAHFVKNMFIRPTDEELQDFTPDFIVMNGAKCTNPQWKEQGLNSENFIAFNLTERIQLIGGTWYGGEMKKGMFSVMNYLLPLRGIASMHCSANVGEKGDVAVFFGLSGTGKTTLSTDPKRRLIGDDEHGWDDDGVFNFEGGCYAKTIRLSEEAEPDIYHAIRRDALLENVTVRADGSIDFDDASKTENTRVSYPIYHIENIVKPVSKAGHATKVIFLTADAFGVLPPVSRLTASQTQYHFLSGFTAKLAGTERGVTEPTPTFSACFGAAFLSLHPTQYAEVLVKRMQASGAQAYLVNTGWNGTGKRISIKDTRAIIDAILDGSLDNAETFTLPMFDLAIPTALPGVDTRILDPRNTYGSPEQWREKAESLAKLFIENFEKYTDTPAGAALVSAGPKL

SEQ ID NO: 8969 - protein, 266 aa, Enterobacter cloacae
RSITACGQTNFAARSAFASCFRAVRDKHVAQTPNGLNITRMRRIFFHHATQTRDLHVDRTLHRGVFTTTRQVHQLVTGERLTRVADQRFQHRELTAGERHWLIFTEHLTGAEVQLELTECNDGLFLRWRARQFVRLTTQHGANTRQQFTRVKRLWNVVISANLKADNTVDFFTLRRHHDDRHRVALAAQTAANREPVFARQHQVQHHQVERFTRQQTIHLFRVRDATNLEALLGQITFQQRTQAHVVIYDQNFVVLLHCVYSQRFG

SEQ ID NO: 8970 - protein, 217 aa, Enterobacter cloacae
KSARVRPANSGINSRRNCYKAYLTAAYLFISSHKSLLILSVTLCATYCAQRQLTGIKGCTMKTPLITREGYEKLKKEMDYLWREERPEVTKKVTWAASLGDRSENADYQYNKKRLREIDRRVRYLTKCLENLKIVDYSPQQEGKVFFGAWVEIENDNGDTLRFRIVGYDEIFGRKDYISIDSPMARALLKKEVGDLAVVQTPAGEASWYVNEIVYVK

SEQ ID NO: 8971 - protein, 805 aa, Enterobacter cloacae
SESALPGWHFLVSARITIPLIFDPQDELTMMKESLCRIIAGELQARAEQVEAAVRLLDEGNTVPFIARYRKEVTGGLDDTQLRNLETRLGYLRELEDRRQAILKSIGEQGKLTSDLEKAINGTLSKTELEDLYLPYKPKRRTRGQIAIEAGLEPLADLLWNEPSHDPETEAAKFIDADKGVADTKAALDGARYILMERFAEDAALLAKVRDYLWKNAHIVSSVVSGKEEEGAKFRDYFDHHEPISTAPSHRALAMFRGRNEGVLQLSLNADPQFDEPPKESHCEQIIMDHLGLRLNNAPADSWRKGVVSWTWRIKVLMHLETELMGTVRERAEDEAINVFARNLHDLLMAAPAGLRATMGLDPGLRTGVKVAVVDGTGKLVATDTIYPHTGQAAKAAVVVAALCEKYNVELVAIGNGTASRETERFYLDVQKQFPKVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLKVSRLGPKAFEQCAGFLRINHGDNPLDASTVHPEAYPVVERILAATQQALKDLMGDSSALRNLKAVDFTDEQFGVPTVTDIIKELEKPGRDPRPEFKTATFADGVETMNDLLPGMVLEGAVTNVTNFGAFVDIGVHQDGLVHISSLADKFVEDPHTVVKAGDIVKVKVLEVDLQRKRIALTMRLDEQPGDTNARRGGNGGGREQQRPAAKAAKPRGRDAQPAGNSAMMDALAAAMGKKR

SEQ ID NO: 8972 - protein, 284 aa, Enterobacter cloacae
IHQVYRELRGQFLTYATPHFGVQSPSVQQHKMTISRPNGLPPQRLHQLTFSFFTWRLRMLTVPGLCWLCRMPLALSAWGVCSVCTRALGYLKGCPQCGLPAVSQTLPCGRCLKKAPPWSALVAVDDYVLPLSRLVHQFKFSSQIALAQPLARLLLLAVLQARRTRGLPPVDTLVNVPLFQRRHWRRGYNQSDLLCRPLARWLGCRYPASALKRIHATAVQHRLNARSRKRNLKNAFRLELPVNGLHIAIVDDVVTTGSTVAELSRLLLQSGAASVQVWCLCRTL

SEQ ID NO: 8973 - protein, 400 aa, Enterobacter cloacae
NNDVTHNNSKARSIMPLFIVAIGVVLLLLLMIRFKMNGFIALVLVALAVGLMQGMPLVKVISSIKAGVGGTLGSLALIMGFGAMLGKMLADCGGAQRIATTLIDKFGKQHIQWAVVLTGFTVGFALFYEVGFVLMLPLVFTIAAAANIPLLFVGVPMAAALSVTHGFLPPHPGPTAIATIFHADMGKTLLFGTILAIPTVILAGPVYARFLKGIDKPIPEGLYSAKTFTEEDMPGFGVSVWTSLVPVILMAMRAIAEMVLPKGHAFLSVAEFLGDPVMATLIAVLIAMFTFGLNRGRSMDQINDTLTSSIKIIAMMLLIIGGGGAFKQVLVDSGVDKYIAAMMHETNVSPLLMAWSIAAVLRIALGSATVAAITAGGIVAPLIATTGVSPELMVIAVGSG

SEQ ID NO: 8974 - protein, 449 aa, Enterobacter cloacae
SMRRMRFSPRSSFARTLLLIVTLLFVSLVTTYLVVLNFAILPSLQQFNKVLAYEVRMLMTDKLQLEDGTQLVVPPAFRREIYRELGISLYSNEAAEDAGLRWAQHYEFLSQQMAQQLGGPTEVRVEVNKSSPVVWLKTWLSPNIWVRVPLTEIHQGDFSPLFRYTLAIMLLAIGGAWLFIRIQNRPLVDLEHAALQVGKGIIPPPLREYGASEVRSVTRAFNHMAAGVKQLADDRTLLMAGVSHDLRTPLTRIRLATEMMGEQDGYLAESINKDIEECNAIIEQFIDYLRTGQEMPMEMADLNAVLGEVVAAESGYEREIATDLQAGEIQVRMHPLSIKRAVANMVVNAARYGNGWIKVSSGTELNRAWFQVEDDGPGIKPEQRKHLFQPFVRGDSARSTSGTGLGLAIVQRIVDNHNGLLEIGTSERGGLSIRAWLPVPVLRGQVKES

SEQ ID NO: 8975 - protein, 161 aa, Enterobacter cloacae
PLMSAICASRSDGHGNEKERKKVKIRIGLLLAVLSQPLWAATPKPVTLLVDDVPVVQILQALVAQEDRNLVVSPDVSGSLSLNLTRVPWRQALQTVVNSAGLVLRKRAAFFMCIRRHGNGSNKRVKSRSGPSVCSTPRCTLTAFRLLMRMRPNCKKRRKSS

SEQ ID NO: 8976 - protein, 213 aa, Enterobacter cloacae
DNFSSDSRSIANEVSVHVLLRRVSAQRGLPLTNSLSSTEKMAEKRNIFLVGPMGAGKSTIGRQLAQQLNMEFYDSDQEIEKRTGADVGWVFDVKGEEGFRDREEKVINELTEKQGIVLATGGGSVKSRETRNRLSARGVVVYLETTIEKQLARTQRDKKRPLLQVETPPREVLEALADERNPLYEEIADVTIRTDDQSAKVVANQIIHMLESN

SEQ ID NO: 8977 - protein, 367 aa, Enterobacter cloacae
GGCRVMERITVTLGERSYPITIAAGLFNDPASFLPLKAGDQAMLVTNETLAPLYLDRVRHLLEQAGVKVDSVILPDGEQYKSLTVLDTVFTALLQKPHGRDTTLLALGGGVVGDLTGFAAASYQRGVRFIQIPTTLLSQVDSSVGGKTAVNHPLGKNMIGAFYQPASVVVDLDCLKTLPARELASGLAEVIKYGIILDGEFFTWLEENMDALLRLDGQAMAYCIRRCCELKAEVVAADERETGLRALLNLGHTFGHAIEAEMGYGNWLHGEAVAAGMVMAARASERLGQFRPEETARIIALLKRAGLPVSGPQEMSAQAYLPHMMRDKKVLAGEMRLVLPLAIGKSEVRGGVPHEVVLGAIADCQQA

SEQ ID NO: 8978 - protein, 290 aa, Enterobacter cloacae
SAGCCRSFLHSRRRCNQLVSMKKNRAFLKWAGGKYPLLDDIKKHLPKGECLIEPFVGAGSVFLNTDFSRYILADINSDLISLYNIVKLRTDEYVEEARKLFTPENNNPDVYYQFRAEFNQSQDPFRRALLFLYLNRHGYNGLCRYNLRGEFNVPFGRYKRPYFPQDELYHFAEKAQNAEFYCLSYEECMELAGVNSVVYCDPPYAPLSATANFTAYHTNSFSPAEQARLAEMAEKLVSKRIPVLISNHDTPDTREWYKAAKHFQVKVRRSISSNGGTRKKVDELLALYRP

SEQ ID NO: 8979 - protein, 232 aa, Enterobacter cloacae
THFKEMRMKQFLIAPSILSADFARLGEDTAKALAAGADVVHFDVMDNHYVPNLTIGPMVLKALRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGYDIRLEVDGGVKVNNIGEIAAAGADMFVAGSAIFDQPDYKKVIDEMRRELAKVSHG

SEQ ID NO: 8980 - protein, 83 aa, Enterobacter cloacae
WRCRFPPVRPAYLLPCRAPAVSPESWLPDLAPCRRPASAFQRPDYASPARCRFSGGPSPGARSGHSRDGLTECRNRQNSRMPP

SEQ ID NO: 8981 - protein, 261 aa, Enterobacter cloacae
LMKTLWWQTVGTGNCHLVLLHGWGLNAEVWRCISEELASQFTVHLVDLPGYGRSHGYGAMTLDDMAEQVLEAAPQKAVWLGWSLGGLVVSQIALRHPERVQALITVASSPCFSAREAWPGIKPEVLAGFQHQLSEDFQRTVERFLALQTMGTETARQDARTLKQTVLSLPMPEVEVLNGGLEILKTADLREPLASLTVPHLRIYGYLDGLVPRKVVPLLDALWPESKSMVVAKAAHAPFISHPAEFCSALSGFISEASTTP

SEQ ID NO: 8982 - protein, 277 aa, Enterobacter cloacae
ICFVTISSRIYTRICWSNPCTFLEYAVPGLSEPLGVHTMQENYKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAVIAFGKFKLNLGTREMFREDEPMPLTSGEFAVLKALVSHPREPLSRDKLMNLARGREYSAMERSIDVQISRLRRMVEEDPAHPRYIQTVWGLGYVFVPDGSKA

SEQ ID NO: 8983 - protein, 196 aa, Enterobacter cloacae
SQFTQQRPVKMTKPLQKPTILNVETVAKSRLFNVESVDLEFSNGVRRVYERMRPSSREAVMIVPIVDEHLILIREYAVGTESYELGFSKGLIDPGETVFEAANRELKEEVGFGAKELTFLKKLSMAPSYFSSKMNIVVAEDLYPESLEGDEPEPLPQVRWPLAHLMDLLEDPDFNEARNVSALFLVREWLKGQDRL

SEQ ID NO: 8984 - protein, 177 aa, Enterobacter cloacae
LHRLPGAGHERGAVMSMPNLLPWRRQQRNQRLRFWGLLFAASLLVMLAGGFSLRATQSLALQALQSELAGTRAVHKVLRARQPQSAGLKTPSPPSDPAWQPALESLASAMPRQAWLTALRYQPPSLTLTGYTTSLPALAAMTDALKRVTGFNPGPAGELQQDSLGRWMFSFKLHSRR

SEQ ID NO: 8985 - protein, 151 aa, Enterobacter cloacae
PVGIWYQRWADARPSRRVLCWLIASGLVAWAIWGLLLRPAALRYADVQAQAISAKRINASLWPEAGRQAVFTQVTPSRPFSPLAFQREDARLVYWKPQQSGGELALDASWGAVPALFSRLALENVRVSAFSIIPQGKQLRLSLQLEIGHAQ

SEQ ID NO: 8986 - protein, 104 aa, Enterobacter cloacae
RTARVSGVYHATSGQYSVMGNDPRNDFAFSLLQMFDVGHELAYKEYRFELDLRLISLCAGNGDLISCQTSRSIEIIFRLTLALLQMRFQFMSCYAGCLRSGDYH

SEQ ID NO: 8987 - protein, 254 aa, Enterobacter cloacae
VMDKLQAIRGVAFDLDGTLVDSAPGLTSAVDQALYALELPVAGEERVVTWIGNGADVLMERALTWARQERASQRSAQGKPSVDHADIPQDEQQRILRKLFDRFYEETVEEGSFLFPDVAETLSALYAKGIPLGLVTNKPTPFVAPLLEALDIAKYFSVIVGGDDVQNKKPHPEPLLLVAGKLSLTPAELLFVGDSRNDILAARAAGCPSVGLTYGYNYGEAITLSEPDVVFDHFKDLLPALGLSHSEHQELNND

SEQ ID NO: 8988 - protein, 166 aa, Enterobacter cloacae
NSAKPTVKPVNTTAHWMCCLPNLSIRVVAIRCAPPQSASILPSMAPKPMISARLPSVPPTPALMELITLTSGIPCIRPTASATRTRAINPFILKRIIKSSNNTTPIATMNNGMIDLAFELLWVTSLFQRQIPVVPTGNRVLTALILMPAKTLSLVGCYKGVECPRE

SEQ ID NO: 8989 - protein, 586 aa, Enterobacter cloacae
EMENRETLSALTRVAVVLAGALQGVICYVITWYIEYAKLPSDTLWLMCVVPATVVMTTTLSLAMTSFRKPFLWLSLGMIGAAVAGMGGWLKWSVAGLESWNLRDEMLVFGFHLLLMTLFVLPWLQRRLDPVPTTSFYSDFYQRNWHNALTLLIIFVSNGLFWLVLFLWAELFELIGIGFFDRLFFHSDGFISVAIGVVSASAAVLTRMQVRLILALQNLLTLIATGLLPLMAALALLFIGALPFVGFESISARISAAGLLTTLALLLLFLVTIVWHPQRQTLPYYAPLRGMIRLAVAIVPAYPVLAGWALWLRISQYGWSPERLYGVLITIVALVWAIGFCASALIQRREPQKIHAYVIPATGLLSLIFLALVHTPVLDPWRISVASHMARYQDGRITADQVSLYMLSNAGRKGREAMLTLQNDPQFISNPKRQREINGLLSRNAGGAGKMTAAMLEKQVQLAPGMAHPDKTLWQAMLSNQYRFESCDSAQSNCLLMPLDLNSDGKPEAVLFQFTDRTIVAYTQTNTGWRIAGDAWKMPEALTRGELDRALRQRKVKSVVKPWADIEIFGERVDMSYDSYNNAQWR

SEQ ID NO: 8990 - protein, 258 aa, Enterobacter cloacae
SMAFKTWQTGIHIQQDKVVAVALTRERAGWRLRRWWAVPLSDGVIGEGKILKPEELVNALRGWRKTLPHSHRVFLSFPATRVLQRALPRPSVTLRDSEQLTWVGAALARELEMPADTLCFDYAQDTFSNTFQVTAAQNREVDTLLTLANALRLRLAAIAPDAGALANLLSAVAPARCVAWRDQHQWLWAMRHQWGRRYTTEAATVNELAALLALSSSDIAVFDAARDPWEAVTLCQPPLPECGADYTVSLALAMSEAP

SEQ ID NO: 8991 - protein, 155 aa, Enterobacter cloacae
VRFPSSHRANSYASACNWRSVMRSKARLVILLSPLFLTGMRDPFSVPEERCSAGQLSQWRYQGIVSGSRDIGLMQDGQKRWHRVKTQMRLPTGWRVSAIDRQQLTVDVGDMCEPKRWTWQREGTKKSEDKDRAVTGGTQPAPVGRDAKTGHPAGG

SEQ ID NO: 8992 - protein, 382 aa, Enterobacter cloacae
CPGGANITGAGSAGGSQSGGVAGCQRFAFAEFNAGALEAGASDGSEQRRAGIAEEGGIFYVHTAAWQREQQTRKEQERAQRLLDAPLHSHSIPFAYADAAELQKAAEKLLSPKGSLSVDKRTNRFLVRDNQTVVDMLQRWAVQMDLPVEQVELAAQIVTISEKSLRELGVKWNLADATEASKVGQVTTLGADLSVASATTHAGFNIGRINGRMLDLELSALEQKQQVDIIASPRLLASHMQPASIKQGSEIPYQVSSGESGATSVEFKEAVLGMEVTPVVLPGGRVRLKLHISENMPGQVLQQADGETLAIDKQEIETQVEVKSGETLALGGIFSQKNKTGRDSVPVLGNIPWLGQLFRHDGKDNERRELVVFITPRLVSIQ

SEQ ID NO: 8993 - protein, 429 aa, Enterobacter cloacae
MDEFKPEDELKPDPSDRRTGRSRQSSERDNEPQINFDDVDLDADDRRPSRSRNARNEREDEEFESEEELMDEQPVKRRPRKRKKAVAAKPASRQYIMMGLGVLVLVLLIVGIGSALKAPSTHSTEQTASAEKSIDLSGNDASNQANGAQPAPGTTSAEQTAGNTSTGQDISLPPVSSTPTQGQAPATPEGQQRVEVQGDLNNALMQPQNQEQVNAAVVNSTLPTEPATVAPVHGSNAQQQTTATETKPRQTQTAPRQERKQAVIEPKRETKPQAVAKAPETKAPAQTKPAVSQPVKAPTPAATAAPKATATTAAPAATTPAAPAAKTGASPGKTTGNVGSLQSASSSNYTLQLSSSSNYDNLNAWAKKSNLKNYVVYQTTRNGQPWYVLVSGIYASKDEAKRAVSTLPADVQAKNPWAKPIHQVQADLK

SEQ ID NO: 8994 - protein, 335 aa, Enterobacter cloacae
IMTKPIVFSGAQPSGELTIGNYMGALRQWVSMQDDYHCIYCIVDLHAITARQDPEKLRKATLDTLALYLACGIDPEKSTIFVQSHVPEHAQLGWALNCYTYFGELSRMTQFKDKSARYSENINAGLFDYPVLMAADILLYQTNQVPVGEDQKQHLELSRDIAQRFNALYGDVFKVPEPFIPKSGARVMSLLEPTKKMSKSDDNRNNVIGLLEDPKSVVKKLKRAVTDSDEPPVVRYDVQNKAGVSNLLDILSGVTGQSIPELEKHFEGKMYGHLKGEVADAVSGMLTELQERYHRYRNDEAFLQKVMKEGAEKASARASETLTAVYEAIGFVAKP

SEQ ID NO: 8995 - protein, 545 aa, Enterobacter cloacae
GSGEVRMTQVNDVRDAHVETTPAPTVSPWQPLSQPVFRMLWIATVVSNVGSWMSDVGINWSMLTLSADPLDIALVQAASSLPMFLFALPSGVMADIVDRRKYLLFSQLWVFIAAAGLTLLSFTGHVTPTVLLVATFLLSVGAAMSSPPFQAVVPDLVSKPELGAAVALNSLGVNISRAIGPALGGFLLSLAGPWMVFALNALSVVGVAWVLWRWRPAPSVQRLPPEHFFSAVRSGIRYVHAAPVLRNVLVRTVAFFVFGSAGWALLPLVARRELGLGPAGYGVMLACIGLGAIAGAILLPRLRQRLNADRLMVAASLVFALTMLALAFVRHVWLLNLFEFFTGFAWIAVLSTLNLGAQRSAARWVKARALAVYLTVFFGSMTAGSALWGQIASQFGTPTSLVVATLGMVLASATVFRWKLEKDPDLNLDLSGQPLDGVKIDLPNERGPVLVSHEYIIDPHNAKAFLQAVHELRRVRRRAGAMSWAVYEDIERPGLFIETFLMGSWIEHLRQQERHTMNDLLLQSRVLAFHQGTTSPAIRYLVAPV

SEQ ID NO: 8996 - protein, 281 aa, Enterobacter cloacae
PSPVQEHTMATFKAQDGTQIYYKDCGAGKPVLFSHGWPLDGDMWDSQLNYLAERGFRAIAFDRRGFGRSDQPWNGYYYDTFASDINDLITTLDLHEVMLVGFSMGGGDVTRYINNYGSARVAGLALLGAVTPIFGKSDTFPQGVDQSVFDGIRDGLRKDRAQFISDFATPFYGINAGQTVSAGALTQTLNIALLASLKGTIDCVTAFGETDFRPDMAKIDVPTLVIHGSNDQIVPFETTGKLAAEMIKNATLKVYDNAPHGFALTHQDQLNEDLLAFVKSL

SEQ ID NO: 8997 - protein, 338 aa, Enterobacter cloacae
LRVDWSEFCEHHRKTTGSCNRTMTIAKSLSQKIAGMKTAWYNKAPALNKPLLVLYVLSQYKKGHERLFQFQDEIQDQLRDLLKRYGPKRSNYEVLMPFWRLKHDGFWALEGTDSALLKSPEEPRLQTVLDNNVRGGFDVTSFFLLQNQKLLIDSLAKQVVVQYLPIEFHSALFKELGFETHEPFEVNENPNDRIALVQPDIDIITQDLAIDETTRTALIQARIGQGNFRAECLRLYPACPVTGITFQPLLRASHIMPWSACQTAKERLDPYNGLMLAAHIDTLFDSGWISFANEGDVLISNHLDFGTCDKLNLPERIIALPKPSYNYMQWHRQNVFKG

SEQ ID NO: 8998 - protein, 285 aa, Enterobacter cloacae
RLPRAAPGPRAGHGGRAGARGAPSGGAPLAVPPARHLQRIHQPHAGRLREGEPRHSVQRPALVLRPCGNRYPGQHRPHQRTGRRHCRPAPHGLPGRILCRALRHRSHPPHAAGSENARDRRAGGLRDGRHPRGELQPVDRALLAGLRPHRRRDADVRPQRPSGPRYRPDALDPGQRVVLQRAESEGADQGRPACRPGSAEQRLLPRAGRGDQGHRVRPDGGERRHRLRRRQLWPARAAGHPGPARVVPGGEGAGSLPQRAAAGRPRGHECGSPLQRPVRGSQPPA

SEQ ID NO: 8999 - protein, 392 aa, Enterobacter cloacae
CAGESPGFQKGTSQRMTDLAERDDTQARAAVSRIPLRNIWLLMLYASSLFRHHGRSMVAAENNPEEIPALVARILLHEVEQRLLRHLSMGYQTRRATLNRVRGRIDVLRTTSRQLLERAQVACQFQEMTLDTPRNRYVRSALEHLVPLLSNGPLAAQCRAMAINLRRRGIEGGMPSKGELPSITRFGRHDAADKAMVDAAKLAFELWLPTQTAGQKLLPTPSNDPYWMRKLFEKSMAGFYHFHLPKKDWTVAAGKELKWGLTSQSAGSESIFPTMNSDIILEHKQPAQRVIIDTKFNNILTKGWYRDKSLRSGYIYQIYTYLRTQENRTDPLSLRSAGLLLHPAVDVMLYEFVEVQGHKIHFATVDLAADAATMTQQLLKLARDCCGITDVN

SEQ ID NO: 9000 - protein, 344 aa, Enterobacter cloacae
CEFAKGRGRMKRKTKVTMNDIARAAGVSQATVSLVLNQSRNIKLSDDTRQRVIGVATELGYDRLPAVHAPRNQEEIALLVSSMQSFDPFIDAISQAREAAWRNETLLTVYDYGDDIELALNIIRQLEKRNCIGIVLASPVTTLVDMTAFQDCTRIPLVLLNQRDPGSPLLPSFIPDDYANAFQVTKHLIACGATRIAHITGESWMEASRQRLAGYQAALQQAGLACDDGLVRQTNWQFSESFTATTSLLELAERPDAIFCASDWLAIGCYQALAVNGVRIPQDMLLAGYDDQKISEQLTPPLTSIQLPYSELGRLAVEYLCNQEDAATHVTLAGRLKVRASSLV

SEQ ID NO: 9001 - protein, 205 aa, Enterobacter cloacae
MEHIVYVVDDDDTVRQSVVRLLESADMHALGFSSAEAFLSHPFEDLPSCVILDMQMPTITGFDVADALKASGREIPIIFLTGHGTIPMSVRAIKGGAYEFLTKPVESSALIGSIESALRLAQHNAARVKEHYALKQRHMSLTPRENEVLELAISGKLNKQIAAELGVSEITVKVHRRRVMEKMQVRSVAELVRAVERLTKHQPVE

SEQ ID NO: 9002 - protein, 627 aa, Enterobacter cloacae
SGALMVTLGKADLILVNGQFHTVDRENPLAEAVAVRDGKFLEVGTVAEVMQHHGDGTKVVDLKGHTAIPGLNDSHLHLIRGGLNYNLELRWEGVPSLADALRMLKEQALRTPSPQWVRVVGGWSEFQFAERRMPTLDEINDAAPDTPVFILHLYDRALLNRAALKVVGYTKETPNPPGGEIQRDANGNPTGMLIARPNAMILYATLAKGPKLPLEQQVNSTRQFMRELNRLGLTSAIDAGGGFQNYPEDYEVIAELHEKKQMTIRIAYNLFTQRPGHELEDFEKWTDMLTPGQGSDFFRQNGAGEMLVFSAADFEDFLEPRPDLAPGMEDELERVVRHLVEHRWPFRLHATYNESISRMLDVFEKVNRDIPFNGLHWFFDHAETVTQANIDRIKELGGGIAVQHRMAFQGEYFAERYGIEATRHTPPVAKMLETGVPVGLGTDATRVASYNPWTALYWLVSGRTVGGMQMYDHSARLDRDTALMLWTQGSAWFSSEQNQKGQIKVGQLADLAVLSKDYFRVPEEEIKGIESVLTVVNGDIVYAAGSFGPLAPPAIPVLPEWSPVVKVPGHYRSAPPQAARVGMSVAHHCSGPCGVHSHQHDFARTSAMPVSDDNAFWGALGCSCFAF

SEQ ID NO: 9003 - protein, 675 aa, Enterobacter cloacae
LFTQAYNPVKFIRQVTEACNFTGEHMDAVEQDVRFEWADFYQAFASQLLTWRNRREELVAGIHRIAAEIGSMSHLQDKPANGVPHPLKDICPFTTMGLFNRSLTVTNRRNIAASLAKLIGVREKVPESFDGIPLLNNQKSWFFGYEKSRKPEDIDTLWEMFSQAISFADTPNADPADFLFSYDAASNVRNVGWNLTMGLYWLRPWFYPTLDSQSQYYIQKVLNIKIIKKGAKGRCSGHNYQAVALALKKAFTQPNYPVHSFPELSLAAWNIDLQQSNDEVERLTWKAYLLNKIKVLCLRKDSPFFSLRELKEAYLDEIKADYPNNNTIESSISYYLQKLRDDDELEFQTPGNYEYLNFDKGELQSITEETVEENVPAEIPHKPYTISNLIDEGCFLEEEKIQFILQRLQAKKNLILQGPPGTGKTWLARRLAYCLMGEETSKRISAVQFHPTLSYEDFIRGWRPNNEGRLALVDGPFLHAIDKAVNDPTTKYVVIIEEINRGNPAQIFGETLTLMEADKRTPNEALELSYRSDMHEKTYIPENLYIIGTMNIADRSLALLDLALRRRFAFIDLKPEFNDAWKKWVNQRFNVSLETLALIESKLTALNEKLSRDAALGPQFCIGHSYVTPPAGLKIDDGMAWYEQVVETEICPLLAEYWFDAPEKVQDSRKELLSV

SEQ ID NO: 9004 - protein, 337 aa, Enterobacter cloacae
GVFMNAPTILTGDRPTGPLHLGHFVGSLRQRVALQQTHSQFVLIADLQGLTDNGSNPQKIRDNIPEVLADYLAAGIDPNLTTICLQSALPALADLTMLYMNIVTVARVERNPTVKNEIAQKGFARSLPVGFMAYPISQAADITAFKAECVPVGDDQLPMIEQTNEIVHKMNSLLPAPVLRHCKAMLSDTSRLPGIDGSAKMSKSLGNTLHLSASEETIHRAVSAMYTDPNHLKVSDPGQIEGNVVFTYLDAFHPDKDKVAAMKAHYQAGGLGDRVCKNELEGCLQELIAPMRERRAMYMRDRGELMAMLKRGTERAQGVTQETLREVKVGLGVPVFS

SEQ ID NO: 9005 - protein, 123 aa, Enterobacter cloacae
KGVGSDRHVRCENARIGPDQGPEFTCRALDRWACEHGVDLRLIQPGNPTHNGFIESFNGRFRDECLNEHWFSDIVHARKIINDWRQDYNECRPHSTLNYQTPSEFAAGWRKGHSENEDSDVTN

SEQ ID NO: 9006 - protein, 137 aa, Enterobacter cloacae
RRPNPAAHRLRVAPAAGRGGRDVLPASAGPDRAGALGRGELPRLHPHGADDGDYPAAATARTTAVLYRMAGAPRGQHHRRAAPADVRGEGRAVPVGAGARQNPDVAAVAGGDEGVHGLLPPLVPRRVRGERYPVFTR

SEQ ID NO: 9007 - protein, 384 aa, Enterobacter cloacae
SRLFTLSLVLTMAYQLNLNWPEFLEKYWQKQPVVLKNAFPNFVDPITPDELAGLAMEPEVDSRLVSHANGKWQASNGPFEHFDNLGETGWSLLAQAVNHWHKPAAELVRPFRVLPDWRLDDLMISFSVPGSGVGPHIDQYDVFIIQGMGSRRWRVGDKLPMRQFCPHPALLHVDPFEPIIDEDLAPGDILYIPPGFPHDGFTHETALNYSVGFRGPNGRDLISSFADYALENDLGGEHYSDPDLTCREHPGRVEQYELDRIREMMIDMISKPDDFTKWFGSFVSTPRHELDIAAAEPPYSAEEVLDALQGGETLSRLSGLRVLNVNGSFFINSEQLETADVNGADALCRYTELGQAELGDALNNPAFVDELTGLINQGYWYFDE

SEQ ID NO: 9008 - protein, 171 aa, Enterobacter cloacae
NARSNRMAVPVHLFLTNDGGTMICGSCDVAQREGSIELRGLQHNLSLPTDSATGKVTGTRQHSPFQFTKELDSSSPYLFKAAATGQTLKTAEFRFYHINYSGQEEEYYRITLENVKVISVSPVMYDTRGCPGTGHMEEVAFNYEKITHLYKDGNLLAHDAWNERPTSGSAA

SEQ ID NO: 9009 - protein, 370 aa, Enterobacter cloacae
ILSVRGRVMKEQWSREQAQAWYQQKGWLCGFNYLPSTAVNWTDIWQAETFDAATIERELGWAADAGYNTLRINLPFIVWEHDRDGLMARIDRFLTIADDRGFSTMLTLMDDCGFSGDEPYLGPQKPPVPGKHNSQAAASPGRDKVCDPDCWADIERYIRDVVRQFREDKRVLLWDLYNEPGNRGIFATGTQEVQYDAKLESCAHELMKLAFQWVREEDPTQPLTVCAWRLPPEEEGETFFQHPLDQTALALSDVVSFHAYTHTGRMTAIIQQLQQLGRPLFCTEWLARHVGSTIEEQLPLMYAAKVAPYQWGLVRGKTQTWLPWPVVMKESTDYCRLWFHDVFEENGIPFSRAEIALMKKLRKIAPDPQG

SEQ ID NO: 9010 - protein, 477 aa, Enterobacter cloacae
RPGALSPGNQVRTMATTMKIPSRELWSYFGYGLGQCFSFGLVGSFINYFYTDVLGISALAASTIFLIARAWDAVHDPLFASIMDTINSRFGKFRHFLLIAPLLITGVTLLSFYKIEADMTTKILYAGVTYILWGTLYAISDIPFWSMSSVMTNDSAQRTRAVTAAMLGVNAGIACANIFFPKLAAFFAQYSNDKGYFMAALVMMLVGLPLMLNGFMQIKERVPPSPEKVTIRDTFHNLRQNKPLFIVLLSFFFCVFHNVAGGLYIYFFINNMGDGSLQMAIGVMGIVAAVLCLVAPMLTRRMQKRKLFMILCGLDVAVRVVMWFTGYQHTALLFILLGLSTLFVMMTNILTSSMIADTIEYAEYHTNKRCAAITFSGQTFTGKMSVAVGGGLIGVFLTMIDYVPQAQAQSDSVLSGLFFGICLLPAIGSLIRMGFMSRFTFTEEKHAEVCRLLAERRHHVENSRAENERLERPAPAN

SEQ ID NO: 9011 - protein, 155 aa, Enterobacter cloacae
MRTEDQWYRAPSAREGKPRRVTICLRKDSMTLPWRIAIIDDERSVRSGLSNLLQSEGYATDTFDSAEVFLSHPLALSGASLVIADIKLRGMNGIELFEKLRLLAMPPPPILFISGHADENMQRYALSLGAAAFLRKPINIDILLDHIQRELTRRQ

SEQ ID NO: 9012 - protein, 1864 aa, Enterobacter cloacae
GSRMNEHTSPAFWPARGSLHEGRAFVLKEDVIFTVLAQEGGISWMNGRHPQSGGSFIIATAVSDEEEERATRLLKNEFALRDRLHDGWAIRPVASTQYRGRFALVYAPFCFELLACRAGKAISGIARFIEMAIRICGPLRQMHQHNLIHGDIKPGAIFVHHDATCRLCSFGLSCGTSDAFSQSRLAASGGTPAYMSPEHTTRTRRAVDSRSDLYSLGIVLYELLTGRLPFELSADDQTNWAHYHIASEPLAPGRVRPDVPGMLSTIILKLLEKNPENRYQTVDGLIADLRRCQATLTVEGEIVDFIPGQQDRSPAIHLADSLFSAHPQASDVIAAFERVSQSGAPEVVTIGGPSGIGKSSVIATTLKSLQQRKVLLAVGKVDQYSPTLPYGVLSSAFRTLTLHLLGLPAGEVATWKIRLSRALEGFEELAVSLVPELNLLLENKPRFSADTFSIDARARFSHMVLALVKTFATQGAPLVLLLDDVQWIDAASLQTLDHLLRACGAIPLLVVVAHRDLSSLSDPTLQTALASLPEAAQYATTIVPQPLSVKAVARWLGGIFHARSSGTADLATLIHEKTGGNPLFVQEFFRRIVDDGLVVHNKYQGKWHYDLQAIRARHYTENVVTLVLEQLKEMPDETRRLLGSIACLGCTGELEMLCRVVGRSAAEIRYALHPAVTAQLIVLTEKEYAFTHDRVQEAAFALLDEGEKSHLHLTTASLLADAARQTAGNELLFRAVHHVSAALDCIQPAPQRQRFRELSLQAARRAKRTGDYLSALSYIQTARALGNAGPVSDFMLDIEEAGCEFALGHLERTRALCDAILGSPGGLTEKALAANLLAEVYMRQSEIRLALEASLCWLGVFGIQISRYPENAECDEAWQQFCQRTADAPLNPFSQLKLMENAETEAVMNLLYSASIFASFTCPRLHFLLLCRMMHLTLDHGITGASTTAMAWFGVLIGHRYAEYRLGFEYGTLARELVNRHGYDAYEAKTLLPLDQLSVWTQPLSYTIECAKACFTSAVTHGDMTMACFAACHQIINFLSRGDHLDGVLTSIDRGLAFVRKTDYQDIETVLHIQRRYVEFLRTPVTGPWSAAQALPDDLLPAPPEQAPEQTSTMLFWYWLYRGMAHFSCGEYADAQADLERAGWYAWSAPGHIHLLDYHFYSALALSRQLTPETFSADYRRSIHHHYDKIALWARINSGTFADKEALIYAEIVRLDGMNSIALEQYEKAVRLSREGGFNPINALAHELAGRFSLACGYPTASDAHFRGAIAAWGRAGAQAKVRQLEQDFPHLLASGQSRAYDTAAFAQNEVIRDLQSVIKASRALSEEINLERLIENLMTLLLERAGAQRGLLLRVSDNHIPEIEASAWTSTDGVRVRILKASPMATDMPLSVLAAVIRTGQEIRTGKPEEFHPFSQDPYLVTSGAAVMCVPMFKQARLVGVLYLENRLMPEVFTAEHSRVVSLLGAQAAVSLETARLYAELLAENIQRRRVEKELRASQTSLMLGEQISHTGSWRWELVQDLMFMSEEYARILGLPEQQKMISMAEFLTFVHEDDYGRISTLVNQSVRDGLSMRAEFRIIRTDGSVRYILGIGDPVGVGSEVNEYYGIITDITSQRAAEDAMRVAQADLARVSRATTVGQLTSSIAHEINQPLMSIVSNAGASLRWLNRDPARLDKVREGLEEIAAEGERAGEIIRSIQSLTRKQDPTFTRIDLHFLIHHIIMLSRSELELRHISVDYLLNADDSFIIGDSVQIQQVLLNLVMNAMEAMAEVTDRPCSITISTANCGEGKVIFEIADTGSGIEPELTERIFDSFYSTKAQGMGMGLTISASIIERHRGKLSARRREPYGTVFTFALPLAGQEE

SEQ ID NO: 9013 - protein, 209 aa, Enterobacter cloacae
ARQAEDITMHYTLKSSDDKEKAEGTNGAGALQQKLLESRSIVISGEINQELAQKVITQMILLQSVSNDPIKLYINSQGGHVEAGDTIHDFIKFIRPEVHVIGTGWVASAGITIFLAAKKEHRYSLPNTRFMIHQPLGGVRGQATDIEIEAREIIRMLERVNKLIADATGQPLEKVKKDTDRNFWMSPAEALDYGIVGKLITHYDELNLD

SEQ ID NO: 9014 - protein, 338 aa, Enterobacter cloacae
LLPLQMDGTVLPVLSRCRPRMMLQSENKSAKRIFFVEDFQVFGERYGIDYRFPQLKEAQVSGSPVLQGNVEEMMLSSGISLTHSDVRVLQPYETTSRHSSPLYMLVVLEGCVTLTLNGINYPVRPGMAFSSHLSEDQVMSARHDADSTLKTLSFGVYPHDAGREALLESLLLEWQSLNAPAFVWQVPEFVMSGILHAQRQGGSVLSRKLLLEGLMYQLLGHGLNQRQQPCPSRPEHARLERVRSLLEQSPERDHTLAQLAALAAMSPSSLRSKFRQRYGCTLFDYLRNCRLALARRYLLEGHSVQQAAWMCGYQHATNFATAFRRHYGISPGDVRKLR

SEQ ID NO: 9015 - protein, 92 aa, Enterobacter cloacae
LSVVSNRGGRSQRLNEALEKLNEMGITTKLVNRVHSKIVVGDEGLLCVGSFNWFSAAREERYQRYDTSMVYRGDSLKAEIKTIYSSLEQRQL

SEQ ID NO: 9016 - protein, 158 aa, Enterobacter cloacae
ELYMAATNFKPEFTVCKTESDAFTGMIENRELVRKNSARRLHGNQPNAAPVHPRAETPQDSAACCELYARIDMKYLLLGGEWLTRAGFINGMPVKIRAMKDCIVITPQHTRELWGCLEGMSVVNINKQKVAQWLKTFPGALNDTGDIPVVKRNIVQAK

SEQ ID NO: 9017 - protein, 203 aa, Enterobacter cloacae
RCNAERGLRCEKAAFRRLSENGENYSMPPLRRQPPAVYGEHGVVYVHLFTVPRPARKTKGHVMLQSLNHLTLAVSDLQKSVTFWHELLGLTLHARWNAGAYLTCGELWVCLSYDEARQYVPPQESDYTHYAFTVAEEDFEPFSQRLKQTGVTVWKQNKSEGASFYFLDPDGHKLELHVGSLAARLAACREKPYAGMVFTSDEA

SEQ ID NO: 9018 - protein, 236 aa, Enterobacter cloacae
PLTSLDNLMTTSKLEVLTPANCQIIFIDHQPQMAFGVQSIDRQVLKNNTVALAKAAKVFNIPTIITTVETESFSGNTYPELLDVFPGQDILERTSMNSWDDQKVRDALKANGKKKVVVAGLWTEVCNNSFALCAMLEGDYEIYMVADASGGTSKEAHDFAMQRMIQAGVIPVTWQQVMLEWQRDWARKETYTAVMDIVREHSGAYGMGVDYAYTMVHKAPSRQKSEHRTLAPVPAR

SEQ ID NO: 9019 - protein, 703 aa, Enterobacter cloacae
EISLERVMFAKSRLALLVGWVTGSVAFPLLAQDAQKTDTVVVTSQMQSAATKLETPDIETPQSVSIVTREQFEEQGATSVRQAVSYTPGVYSNQIGASNRFDYMVLRGFSDGSLDNVYLDGLKMMGDTNSHSSLVVDPWFLDSIEVVRGPASVLYGRSSPGGIVALTSRKPSFDPGGEIKLFAGNNNQRGAMFDVTGPVDDNDRVAVRLSGMTRYADSQFDPLKEERYALMPSLTWRITDNTRLDLMAYLHRDPEGGSHSGLPYEGTVVPHSGKKISNTFFEGEDDYDKYDRRENMVGYNIEHLFDSGWSVRQKLRYLHTKVELNQVYAAGWLNDTELNRGYSGSDEKMNAITLDNQVDGSFDTGEVNHRVLIGMDYQDRTNNVTGYYGGFPPIDAFHPVYGAKPDYITQYSREKHKLRQTGYYLQDQMSIDRWRLTLGGRYDQVSVSNVDNFNHTRSDLDKNRYSSRAALLYLFDNGVAPYVSYSTAFTPTSFADEQGNILDPMKGKQWEAGVKYEPEGMNSQFSASVFRINQKNIATKEEPTDPYRSIGEIESEGVELEAIGQLTDSLRMQAAYTYTDIRYKKSSPEEEGKRAVYAPRNMASAWLSYDVKTGLLDGLTVGSGVRYVNGIASDRQNTHTLPSYTLVDMTVGYDLSKVGLTGVSAQLNVNNLTDRSYVAACNSLSYCYFGAERSIVGSVSWKF

SEQ ID NO: 9020 - protein, 380 aa, Enterobacter cloacae
VKSVPGLVCLQKRGLGSHAPTSCRTYGSITMTDIAQLLGKDADSLLQHRCMTIPADQLYLPGHDYVDRVMVDNNRPPAVLRNMQTLYNTGRLGGTGYLSILPVDQGVEHSAGASFAANPLYFDPKNIVELAIEAGCNCVASTYGVLASVSRRYAHRIPFLVKLNHNETLSYPTEYDQTLYASVEQAFNMGAVAVGATIYFGSEQSRRQIEEISAAFERAHELGMVTVLWAYLRNASFKKDGVDYHVSADLTGQANHLAATIGADIVKQKMAENNGGYKAVNFGYTDDRVYSKLTSDNPIDLVRYQLANCYMGRAGLINSGGAAGGETDLTDAVRTAVINKRAGGMGLILGRKAFKKSMADGVKLINAVQDVYLDSKVTIA

SEQ ID NO: 9021 - protein, 205 aa, Enterobacter cloacae
GFRARCTKGESAMRLCDRDIEAWLDEGRLSITPRPPVERINGVTVDVRLGNKFRTFSGHTAPFIDLSGPKDEVSAALDRVMSDEIVIDEGEAFYLHPGELALAVTFESVTLPADLVGWLDGRSSLARLGLMVHVTAHRIDPGWSGRIVLEFFNAGKLPLALRPGMMIGALSFEPLTGPADRPYNRRQDAKYRDQQGAVASRIDKD

SEQ ID NO: 9022 - protein, 744 aa, Enterobacter cloacae
GGIHLTRPVCPSVGAGTESSAGITMTEKTRPSAAPTSGSDEIDIGRLVGTVIEAKWWVLGITAIFAVAAIVYTLFATPIYSADALVQIEQNTGNSLVQDIGSALANKPPASEAEIQLIQSRLVLGKTVHDLGLDIAVTKNTFPVFGAGWDRLMGRSNDTVKVTDFVIPKGAGDQTFTLTVLGPKQYQLTSDAGFSARGEVGQMLTKEGVSIKVSAIQAHEGGEFTVTKFSTLGMINNLQNNLTVTENGKDTGVLSMTFTGEDKDQIRDILNSITRNYLEQNVERKSAEAAKSLAFLSKQLPEVRARLDDAENKLNAYRQDKDSVDLPLEAKSVLDSMVNIDAQLNELTFKEAEISKLYTKRHPAYRTLLEKRRTLEEEKAKLNDRVTAMPKTQQEIVRLTRDVESGQQVYMQLLNKQQELKITEASTVGDVRIVDPAITQPGVLKPKKALIILGSIILGLMLSIVGVLLRSLFNRGIESPQVLEENGISVYASIPLSEWQKSRDSVKTVKGVKRYKQSQLLAVGNPTDLAIEAVRSLRTSLHFAMMQAKNNVLMMTGVSPSIGKTFVCANLAAVVSQTNKRVLLIDCDMRKGYTHELLGTNNVNGLSEILLGKGEISESAKPTSIPKFDLIPRGQVPPNPSELLMSERFTQLIEWASKNYDLVLIDTPPILAVTDAAVVGRHAGTTLMVARYAVNTLKEVETSLSRFEQNGIEVKGVILNSIFRRATGYQDYGYYEYEYKSDSK

SEQ ID NO: 9023 - protein, 169 aa, Enterobacter cloacae
RASGEIMFLEDCRANSWSLRPCCMVLAYRFAHFCSVWRKKNVLNNIWAAPVLVLYRIITECFFGYEIQAAATIGRRFTIHHGYAVVINKFVVAGDDFTIRHGVTIGNRGPDSLACPVIGNNVELGANVVMIGDITVGNNVTIGAGSVVLDSIPDNALVVGEKARVKVIK

SEQ ID NO: 9024 - protein, 371 aa, Enterobacter cloacae
LPPTATPRGKCWRNRAVKPSVKTRCCRWCSCRRPISRRLFLARTWNRSATAAAKLTVDNRCWRSMSRSIRICSYLLLPLIYLLVNVKIAQLGESFPITIVTFLPVLLLLYVDKLNLKKLMIALGIGFGLTAFNYIFGQSLDASKYVTSTMLFVYIVIIIGMVWSIRFKTISPHNYRKILRFFYIVVGLIVVLAAMEMAQIILTGGSSLMEIISKYLIYSNSYVLNFIKFGGKRTTALYFEPAFFALALISIWLSIKQFGIKTPKTDAMILAGIVLSGSFSGVMTFILFYLLEWAFQYLNKEAIKKKLPLAIISLTVFLVGVIFAFPYISERLGDLGTEGSSSYYRIIGPLVMVGYSLTHLDVFTTSRRHPT

SEQ ID NO: 9025 - protein, 379 aa, Enterobacter cloacae
SMMKSKMKLMPLLVSVTLMSGCTVFPGSNMSTMGKDVIKQQDADFDLDKMVNVYPLTPRLVEQLRPRPNVAQPNMSLDQEIASYQYRVGPGDVINVTVWDHPELTTPAGQYRSSSDTGNWVQSDGTMFYPYIGKVHVAGKTLAEIRSDITGRLAQYIADPQVDVNIAAFRSQKAYISGQVNKSGQQAITNVPLTVLDAINAAGGLTDGADWRNVVLTHNGKEQRISLQALMQNGDLTQNRLLYPGDILYVPRNDDLKVFVMGEVKKQSTLKMDFSGMTLTEALGNAEGIDLTASNASGIFVIRPIKGENAKGKIANIYQLDMSDATSLVMATSFRLQPYDVVYVTTAPVARWNRLINQLLPTISGVRYMTDTASDVHNW

SEQ ID NO: 9026 - protein, 149 aa, Enterobacter cloacae
AAMFNKILVVCVGNICRSPTAERLLKNYQPALTVDSAGLGALVGKGADERAASVALEHNLSLDGHVARQVSGRMCREYDLILAMEKRHIHALCDIAPEMRGKVMLFGHWDGEREIPDPYRKSREAFEAVYTLLDQSARQWAQALKAQQG

SEQ ID NO: 9027 - protein, 283 aa, Enterobacter cloacae
GENMTTQRPLISIYMPTWNRQQLAIRAIKSVLRQDYDNWELIIVDDCSSSYEQLQKFVEDLNDPRVMYTHNAINSGACAVRNQAIMQAKGQYLTGIDDDDEWTPNRLSIFLSHKAQLVTHAFLYANDYVCQGEVYSQPASLPLYPKSPYSRRLFYKRNIIGNQVFTWAWRFKECLFDTELKAAQDYDIFLRMVVEYGEPWKVEEATQILHINHGEMQITSSPKKFSGYFHFYRKHKDKFDRASRKYQLFTLYQIRNKRMNWRTLLTLLSVRNGKRLADGLRGK

SEQ ID NO: 9028 - protein, 339 aa, Enterobacter cloacae
SNPINTINPHAGEKGRDFSEMSARRQQEYESKAQRDLSVYAEVNTKGETMYTLNWQPPYDWSWMFGFLAARAVTGVETVTKDYYERSFGYAGHQGVFRVTPDSATHTLAVSLSPGLIPVADICLDRIARLFDLDCDPQHIAQTLGDLGAARPGLRLPGAMDAYEQGVRAILGQLVSVAMAAKLASRVVALCGEPIQDAPGYLCFPPPEVLAAVDPLALKALGMPLKRAESLIHLAQSVVDGEFPLFPPANVEDGMKALQQRPGIGRWTANYLALRGWQAKDVFLPDDYLIKQRFAGMTPAQIRRYAERWQPWRSYALLHIWYTDGWSPSVDGEIAGIKQ

SEQ ID NO: 9029 - protein, 177 aa, Enterobacter cloacae
QPLHFALFVQYPVRQRTNVADAILDANAKFQLERHPGLKGFSQHLFGVGAIFRHHGRMPELPGGFNVRGDLVQLKHPLIPADHVRLEIPLPYPDATGFVREGDTLHQALIDPLGLFQVVDIFNLGNKVERGAVGMAHNGDGQQRPHHRAAASVVAFFEAVAIDLPVNQLSQLLQVGI

SEQ ID NO: 9030 - protein, 230 aa, Enterobacter cloacae
RSGVVLPYIQVNQVAKFMTDKSHQCVIIGIAGASASGKSLIASTLYRELREQVGDEHIGVIPEDSYYKDQSHLSMEERVKTNYDHPSAMDHSLLFQHLEALKRGEAIELPVYSYVEHTRTQETIRIEPKKVIILEGILLLTDARLRESMNFSIFVDTPLDICLMRRIKRDVNERGRSMDSVMAQYQKTVRPMFLQFIEPSKQYADIIVPRGGKNRIAIDILKAKISQFFE

SEQ ID NO: 9031 - protein, 626 aa, Enterobacter cloacae
RLICEFTEEAMRRVLTTLMILLVVLVAGLSALVLLVNPNDFRAYMVRQVEARSGYELKLDGPLRWHVWPQLSILSGRMSLTAPGAAQPLVTADNMRLDVALIPLLSHQLQVEQVMLKGAVIQLTPQTEAVRQADAPVAPRENTLPDVPSDTGWSFDIGNLKVADSVLVFQHEDDEQITVRNINLRMEQDANHHATMEFSGRINRNQRDLNLSMNANVNASDYPHQLTADVQQLNWQLTGADLPAKGIAGQGTMQAVWHEERKQLELNALNLQANDSSLKGQASVTLDEKPKWVLDLQFDKLNLENLLPLQPVNATDEGATQVGQSQATQSRPVISSNLDLPDYNGLRGFTADILLKANSVRWRGIDFTDVSSQMFNHNGLLVISELSGKMGAGNLSLPGTLDVRKDVASAAFQPRLENVEIGTILKAFNYPIALTGQLSLAGDFSGTKIDADAFRRSWQGQAHVELKDTRMEGLNFQQLVQQAVERSSSVKANENYDSATRLDSFTSELALDDGQLSLDDMQGTSSLLALTGTGALDLVKETADTRFNVRVKAGWEGEGQLVEFLKETPIPLRVYGKWQALNYSLQVDQILRKHLQDEAKRRLNDWADRNKESQSGKDVKKLLDKL

SEQ ID NO: 9032 - protein, 435 aa, Enterobacter cloacae
RDDWRRQRGAGQHSGQRAGGGRESPREGDKMNILQFNVRLAEGGAAGVALDLHQRALQKGLQSRFVYGYGKGGKKSVSHDNYPQVLKQTPRLTSIANIALFRLFNRDLFGNLNNLYRTVTRTRGPVVLHFHVLHSYWLNLEEVVAFCGKVKAHKPDTRFVWTLHDHWSVTGRCAFTDGCEGWKDNCQKCPTLSNYPPVKIDRAHQLVEGKRQLFRDMLSLGCTFISPSQHVADAFNSLYGAGRCQIINNGIDVATEAILAELTPVAVTAGKPKIAVVAHDLRYDGKTNQQLVRDMMALGDKIELHTFGKFSPFEGANVVNHGFETDKRKLMSALNGMDALVFSSRVDNYPLILCEALSIGVPVIATHSDAAREVLEKSGGKTFSENEVLPLVQLSKADIAQAVFGTDLESFRNRSRKAYSGQQMLEEYVSFYQNL

SEQ ID NO: 9033 - protein, 482 aa, Enterobacter cloacae
HDQKRRDPTRQKECTMKFWRPGITGKLFVAIFATCIVLLITMHWAVRVSFERGFIDYIKHGNEQRLQGLSDALGEQYSLHGNWRFLRNNDRFIFQILRSLEHDNDDDRPGPGMPPHGWRTQFWVIDQEMRVLVGPRSPVPPDGTKRAITSNGATVGWVIASPVERLTRNTDINFDRQQRQTSWLIVALSTLLAALATFPLARGLLAPVKRLVEGTHKLAAGDFSTRVDTRSQDELGKLAQDFNQLASTLEKNQQMRRDFMADISHELRTPLAVLRGELEAIQDGVRQFTPESVASLQAEVGTLTKLVDDLHQLSMSDEGALAYQKAPIDVINILEVVTGAFRERFASRDLKINLSLPDSAVVFGDRDRLMQLFNNLLENSLRYTDGGGALHISGRQENGRFALTFADSAPGVKDAQLEKLFERFYRTEGSRNRASGGSGLGLAICVNIVEAHGGTIRAAHSPFGGVSITVELPLERDLSREA

SEQ ID NO: 9034 - protein, 1138 aa, Enterobacter cloacae
NVCTSINQIINFTRPDLAPDNMASLDRAVMNKQYQRVLVTTPHPLLRLVCLGLVTFIFTLFSLELTRFGTLLAPLWFPTSIMMVAFYRHAGKMWPGIALACSFGNIFASWMLFSWESLNITYTAINIIEATVGALLLRKLLPWYNPLQNLNDWVRLALGSALVPPLVGGVLVHFLVPSAEPLRNFLVWVLSEAIGALALVPLGLLFKPHYLLRHRNPKLLLETLVTLVVTLVLCWTAITWLPWPFTCIIVLLMWSAVRLPRMEAFLIFLFTIMMVSLMMARNPLSMTPSSMIVTFNAPWLPFLMMLLPANIMTMVMYAFRAERKHITESEERFRNAMEYSAIGMALVGIEGQWLQANKALCNFLGYSQSELQSLTFQQLTWPEDLNTDLEQLGQLINGEINSYSLEKRYYTRSGAVVWALLAVSVVRHADGTPLYFIAQIEDINDLKQTEWVNKRLMERITLANEAGGIGIWEWDLEPDVISWDKRMFELYEIPTHIKPTWQLWHAAMVPEDRTHAEQVLRESLQARVPFKLEFRIRVKDGIRHIRSLANRVLNKQGEVERLLGINMDMTEVKQLNEALFQEKERLHITLDSIGEALLCTDIDMNITFMNPVAEKMSGWSQSEALGQPVLKVLHITFGENGPLMENIHSGDMSRTDIEQDVVLNCRNGGSFDIHYSITPLSTLEGNTIGSVLVIQDVTESRKMLRQLSYSASHDALTHLANRVSFENHLKRLLQTVQETHQHHALVFIDLDRFKAVNDTAGHAAGDALLRELSSLMLTMLRSSDVLARLGGDEFGLLLPDCNVESARYIAGRLIDAINNYHFSWEGRLHRIGASAGITLIDDTNYQAAEVMSQADIACYASKNSGRGVVTVYEPQQERIHSTRSMMSLDEQWHMIKDNHLLMIARSVASPRIPESSSFWLISLRLWTSQGEVLEEHAFRAGLAEPELLHALDRRIFSEFFRTYAAQVAAKGMGVALPLSEAGLASVTLVDELLDLITKGPLPARLLHLAIAADVLSNTDENVQQGLQKLRQAGCRVVLTRVGRDMNVFSQLSANTADYLLLDADVVTNVHGNLMDEMMVTIIQGHAQRLGIKTIAGPCHQSIMMNTLSGIGVDFIYGDTIGEAQPLDLLLNTSYFAIN

SEQ ID NO: 9035 - protein, 1061 aa, Enterobacter cloacae
PADRRGAGRGGGSAEYRSKSLMQVMPPSSTGGPSRLFILRPVATTLLMVAILLAGIIGYRFLPVSALPEVDYPTIQVVTLYPGASPDVVTSAITAPLERQFGQMSGLKQMSSQSSGGASVVTLQFQLALSLDVAEQEVQAAINAATNLLPSDLPNPPVYSKVNPADPPIMTLAVTSSAMPMTQVEDMVETRVAQKISQVTGVGLVTLAGGQRPAVRVKLNAQAIAALGLTSETIRTAISSANVNSAKGSLDGPTRAVTLSANDQMQSADEYRQLIIAYQNGAPIRLGDVATVEQGAENSWLGAWANKQQAIVMNVQRQPGANIIDTADSIRTMLPQLVESLPKSVSVKVLSDRTTNIRASVTDTQFELMLAIALVVMIIYLFLRNVPATIIPAVAVPLSLVGTFAVMVFLDFSINNLTLMALTIATGFVVDDAIVVIENISRYIEKGEKPLAAALKGAGEIGFTIISLTFSLIAVLIPLLFMGDIVGRLFREFAVTLAVAILISAVVSLTLTPMMCARMLSHESLRKQNRFSLASERMFERIIAAYGRVLAKVLNHPWATLGVALGTLALSVMLWIFIPKGFFPIQDNGIIQGTLQAPQTVSFANMAQRQQQVSEIIMKDPAVESLTAYVGVDGTNPSLNSARLQINLKPLDDRDDRVNAVIERLQSAVARVPGIELYLQPIQDLTIDTQVSRTQYQFTLQATSLDALSTWVPQLVDKLKALPQISDVSSDWQDKGLAAYVNVNRDTASRLGITMSDVDNALYNAFGQRLISTIYTQANQYRVVLEHNTENTPGLAALDSIRLTSKDGGIVPLSAIASVEERHTPLSINHLDQFPSTTISFNVPDGYSLGEAVEAILGAEKELSFPSDIQTQFQGSTLAFQAALGSTVWLIVAAVVAMYIVLGVLYESFIHPITILSTLPTAGVGALLALMLAGSELDVIAIIGIILLIGIVKKNAIMMIDFALAAEREQGMAPREAIYQACLLRFRPILMTTLAALLGALPLMLSTGVGAELRRPLGIGMVGGLLVSQVLTLFTTPVIYLLFDRLALWTKSRFPKREEEA

SEQ ID NO: 9036 - protein, 1025 aa, Enterobacter cloacae
VKFFALFIYRPVATILLSVAITLCGVLGFRLLPVAPLPQVDFPVIMVSASLPGASPETMASSVATPLERSLGRIAGVNEMTSSSSLGSTRIILEFNFDRDINGAARDVQAAINAAQSLLPSGMPSRPTYRKANPSDAPIMILTLTSETYSQGELYDFASTQLAQTIAQIDGVGDVDVGGSSLPAVRVGLNPQALFNQGVSLDDVRSAISNANVRKPQGAIEDNSHRWQIQTNDELKTAAEYQPLIIHYNNGAAVRLSDVASVTDSVQDVRNAGMTNAKPAILLMIRKLPEANIIQTVNSIRARLPELQETIPAAIDLQIAQDRSPTIRASLEEVEQTLIISVALVILVVFLFLRSGRATLIPAVAVPVSLIGTFAAMYLCGFSLNNLSLMALTIATGFVVDDAIVVLENISRHLEAGMKPLQAALQGTREVGFTVLSMSLSLVAVFLPLLLMGGLPGRLLREFAVTLSVAIGISLVISLTLTPMMCGWMLKRSQPHSQPRRKGFGRVLMAMQSGYGKSLKWVLNHTRIVGLVLIGTIVLNVWMYITIPKTFFPEQDTGVLMGGIQADQSISFQAMRGKLQDFMKIIREDPAVDNVTGFTGGSRVNSGMMFITLKPRGERHETAQQIIDRLRLKLAKEPGANLFLMAVQDIRVGGRQANASYQYTLLSDDLAALREWEPKIRKALAALPQLADVNSDSQNNGAEMALTYDRETMARLGINVEAANSLLNNAFGQREVSTIYQPMNQYKVVMEVDPRYTQDISALDKMFVINDDGKAIPLSYFASWQPSNAPLSVNHQGLSAASTVSFNLPTGSSLSEASDAINRAMTQLGVPSSVRGSFAGTAQVFQDTMNSQVILILAAIATVYIVLGVLYESYVHPLTILSTLPSAGVGALLALELFGAPFSLIALIGIMLLIGIVKKNAIMMVDFALDAQRNGNLTPDEAIFQACLLRFRPIMMTTLAALFGALPLVISGGDGSELRQPLGITIVGGLVMSQLLTLYTTPVVYLFFDRLRLRFSRKKRTTVTE

SEQ ID NO: 9037 - protein, 471 aa, Enterobacter cloacae
MTDLPSNVRWQLWIVAFGFFMQSLDTTIVNTALPSMAKSLGESPLHMHMVIVAYVLTVAVMLPASGWLADKVGVRNIFFTAIVLFTTGSLFCAQANTLDQLVMARVLQGVGGAMMVPVGRLTVMKIVPRAQYMAAMTFVTLPGQVGPLLGPALGGILVEYASWHWIFLINLPVGIIGAIATLTLMPNYKMQTRRFDFFGFILLAAGMATLTLALDGQKGLGISSLSLALLVALGVTAILWYLWHARGNANALFSLNLFKNPTYRLGLFGSFAGRIGSGMLPFMTPVFLQIGMGFSPFHAGLMMIPMVLGSMGMKRIVVQVVNRFGYRRVLVAATIGLALVCLLFMAVALLGWYYILPLVLFCQGIINSMRFSSMNTLTLKDLPDELASSGNSLLSMIMQLSMSVGVTVAGLLLGMYGQHHLSADTPVAHQVFLYTYLSMAVIIALPAFIFARVPNDTTKNVVIRRGKRSAP

SEQ ID NO: 9038 - protein, 118 aa, Enterobacter cloacae
LSRFLPCLRRSPPSRWRAACWRRLSAWWKARTSWRRVISRPAWTPAARMNWASWRRTSTSSPARWKKTSRCAAILWPTFRTSCAPRWRCCAASWRRFRTACGSSPPSRWPRFRRKSVR

SEQ ID NO: 9039 - protein, 461 aa, Enterobacter cloacae
PVIRTRTNMFKPELLSPAGTLQNMRYAFAYGADAVYAGQPRYSLRVRNNEFNHENLQLGINEAHALGKKFYVVVNIAPHNAKLKTFIRDLKPVVEMGPDALIMSDPGLIMLVRENFPEMDIHLSVQANAVNWATVKFWKQMGLTRVILSRELSLEEIEEIRTQVPDMEIEIFVHGALCMAYSGRCLLSGYINKRDPNQGTCTNACRWEYNVQEGKEDDIGNIVHKHEPIPVTNVEPTLGIGAPTDSVFMIEEAKRPGEYMTAFEDEHGTYIMNSKDLRAIAHVERLTKMGVHSLKIEGRTKSYYYCARTAQVYRKAIDDAAAGKPFDTSLLETLEGLAHRGYTEGFLRRHTHDDYQNYEHGYSISERQQFVGDFTGERKGPLAAVAVKNKFTKGDSLELMTPQGNMNFRLEHLENKKGEAIEVAPGDGHVVWLPVPEEVELEFALLMRNFEGENTRNPHGK

SEQ ID NO: 9040 - protein, 542 aa, Enterobacter cloacae
SKCDISHITEGIAFTMEWIADPSIWAGLVTLVVIELVLGIDNLVFIAILADKLPPSQRDRARVTGLLLAMVMRLLLLASISWLVTLTKPLFSVQGLSFSARDLIMLFGGLFLLFKATVELNERLEGKDSENPTQRRGAKFWPVVAQIVVLDAVFSLDSVITAVGMVDHLAVMMAAVIIAITLMVLASKALTRFVNSHPTIVILCLSFLLMIGFSLVADGFGFHIPKGYLYAAIGFSVLIEFLNQLAIFNRRRFLSANQTLRQRTADTVMRLLSGKKEDAELDAESAAMLADHSDGQIFNPQERRMIERVLNLNQRTVSSIMTSRHDIEHIDLTAPEEQIRALLDKNQHTRVVVTGGEEEEELLGVVHVIDLLQQQLHGEPLNLRALVRQPLVFPEALPLLSALEQFRNARTHFAFVVDEFGSVEGLVTLSDVMETIAGNLPNEVDEIDARHDIQKNADGSWTANGHMPLEDLVQFVPLPLDEKREYHTIAGLLMENLQRIPQPGEEVQVGDYMLKTLQVESHRVQKVQLIPLRGEDEMDFEV

SEQ ID NO: 9041 - protein, 483 aa, Enterobacter cloacae
TERSRCALLSYSCCRLADISLKSRPFSPAWGFIVFIGFDYGTANCSVAIMQNGQPQLLKMENGSTLLPSMLCAPTREAVSEWLFRHHQVPATAAETQALLRRAVSFNREEDIDVTPSSVQFGLSSLGQYIEDPEEVYFVKSPKSFLGASGLKPQQVAMFEDLVCAMMLHIRNQAQSQVPDAITQAVIGRPINFQGLGGDEANQQAQGILERAAHRTGFRDVVFQYEPVAAGLDFEATLTEEQRVLVVDIGGGTTDCSLLLMGPKWHHRRDRENSLLGHSGCRVGGNDLDIALAFKSLMPLLGMGGQTEKGIALPILPWWNAIAINDVPAQSDFYSTANGRFLNDLVRDAQDAEKVALLYKVWRQRLSYRVVRTAEESKIALSDRPEHAVSLPFISDDLATAITQEGLEMALTQPLQRILEQVQLALENGKVKPDVIYLTGGSARSPLIKKALAEQLPGIPIAGGDDFGSVTAGLARWAQVVFS

SEQ ID NO: 9042 - protein, 404 aa, Enterobacter cloacae
ERITMKGSNKSRWAIAAGLIVVVLAAAWYWHSQSANSTAPAGASSPSQRPTGGGRHGMRGGALAPVQAATAVNKAVPRYLSGLGTITAANTVTVRSRVDGQLMAIHFQEGQQVKAGDLLAEIDPSQFKVALAQAQGQLAKDKATLANARRDLARYQQLVKTNLVSRQELDTQQSLVSESQGTIKADEAAVASAQLQLDWSRITAPIDGRVGLKQVDIGNQISSGDTTGIVVITQTHPIDLVFTLPESDIATVIQAQKAGKSLVVEAWDRTNKQKLSEGSLLSLDNQIDTTTGTIKLKARFNNQDDALFPNQFVNARMLVATEENAVVIPTAALQMGSEGNFVWVLNSENKVSKHLVKTGIQDSQTVVISAGLSAGDRVVTDGIDRLTEGAQVEVVEAQNTGAKA

SEQ ID NO: 9043 - protein, 255 aa, Enterobacter cloacae
HYSRVTSGTGFIEGSMTELPIDDNTPRILIVEDEPKLGQLLIDYLRAASYAPTLISHGDQVLPYVRQTPPDLILLDLMLPGTDGLTLCREIRRFSDVPIVMVTAKIEEIDRLLGLEIGADDYICKPYSPREVVARVKTILRRCKPQRELQVLDAQSPLIVDESRFQASWRSKLLDLTPAEFRLLKTLSHEPGKVFSREQLLNHLYDDYRVVTDRTIDSHIKNLRRKLEALDADQSFIRAVYGVGYRWEADACRIA

SEQ ID NO: 9044 - protein, 306 aa, Enterobacter cloacae
LKKGATRMATYPDSLLILNGKSAGNDLLRQAITELREDGARIHVRVTFEKGDAARYIDEGIRLGAETIISGGGDGTINEIAGALIDLNAAARPAMGILPLGTANDFATSAGIPEDLGKALQLAILGKATAVDIAQVNERTCFINMATGGFGTRITSETPEKLKAALGGVSYLIHGLMRMDTLKPDSCEIHGENFHWQGDALVIGIGNGRQAGGGQQLCPEALINDGQLQLRIFTGDGLLPALFTTLTQPEESPNIIDGKSAWFEVIAPHGMTFNLDGEPLSGERFRIEVLPGALQCRLPPDCVLLR

SEQ ID NO: 9045 - protein, 94 aa, Enterobacter cloacae
QLNRIKKGQKTVVTLLNDKIRFNGSVESISKGILDYSNKGSQGELHEVNPTFEWVRLPMRIPVRIAIPSNQDNYDLLVSGMTCTVTISENHEKL

SEQ ID NO: 9046 - protein, 463 aa, Enterobacter cloacae
ARMRHSRGEERRSAADRDAAFEKINEARSPLLPQLGLGADYTYTNGFRDNNGINSNATSASLQLTQTLFDMSKWRELSLQEKSAGIQDVTYQTDQQTLILNTATAYFNVLSAIDALSYTEAQKQAIYRQLDQTTQRFNVGLVAITDVQNARSQYDTVLANEVTARNNLDNALESLRQVTGNYYPELASLNVDSFKTDKPQAVNALLKEAENRNLTLLQARLSQDLAREQIRLAQDGHLPTLSLSASTGVSDTSYSGSKTNTAQYDDNNMGQNKVGLSFSLPLYQGGMVNSQVKQAQYNFVGASEQLESAHRNVVQTVRSSFNNVNASISSINAYKQAVVSAQSSLDAMEAGYSVGTRTIVDVLDATTTLYNAKQQLSSARYQYLINQLNIKQALGTLNEQDLQMLNSTLGKPVSTSPDSVAPENPQQDAAVDNFTANSSTPVAQPAAARSTSPASSGTNPFRN

SEQ ID NO: 9047 - protein, 67 aa, Enterobacter cloacae
RSPGFHPSSLHFQPLILYPERYYHWVLEDKYETDKNDESRVVPQKLERTPPDTCRAGGHRRLYAGRL

SEQ ID NO: 9048 - protein, 399 aa, Enterobacter cloacae
CDRLLNSLNGRLIMERVSIAERPDWREKATEYGFNFHTMYGEPYWCEDAYYKLTLAQVKKLEEVTAELHQMCLKVVEKVIDSDELMTKFRIPKHTWSFVRQSWKTNQPSLYSRLDLAWDGVGEPKLLENNADTPTSLYEAAFFQWIWLEDQANAGNLPEGSDQFNSLQEKLIERFVELREQHGFNLLHLACCRDTEEDRGTVQYLQDCAAEAEVATEFLYIEDIGLGEKGQFTDMQDQVISNLFKLYPWEYMLREMFSTKLEDAGVRWLEPAWKSIISNKALLPMLWEMFPNHPNLLPAYFAEDDFPPMEKYVVKPIFSREGANVSIIENGKTLEAVEGPYGEEGMIVQAFYQLPKFGDSYTLIGSWLINDQPAGIGIREDRALITQDLSRFYPHIFVE

SEQ ID NO: 9049 - protein, 843 aa, Enterobacter cloacae
CTNNSVTSRYQPTGNPCRSALFIYSSNRMMTYKVQWIIIIASLLMTIVASATEFNINAIDKDQRGSVDLSRFKDQISVTPGSYFVTVSVNDIPLANGWQLRWRDINNAVQVCIPPELADTFAFQDDVRHALPEKEGCVDFAARPDIKFTFEQGSQTLKVTIPQAWLQYRAVDWMPPSTWDNGVPGVLLDYNLFASHYQPNSSGSNDNANTYGTAGANMGAWRLRSDYQYTRSDTEAGSEQNGRFSRVYMFRPLPSIGAKLTLGETDFQSSIFDAFTYTGASLISDERMLPWSLRGYAPQITGIAQTNATVAVSLADRVIYQSKVPPGPFVIQDLNQSVQGTLDVKVTEEDGRVNTFQVSAESVPFLTRKGQVRYKLAAGKARQGASHDVEDNAFMSGEFSWGMLSHTSLYGGTLADGDRYRSVAAGIGQNMAWLGALSFDVTQATSQLPHQRSQTGYSYRINYSKRFDTTGSQLTLASYRYSDPQFLSYARYLDYDNGDRQSEKQTLSVTASQYISALSLNLYVNMLRQTWWNDSPSTTGSITAGYNFDIGRWKNLGVTLSWSKTHYEEEDENDDTQFYLSLSVPLDPDHRLNYDLRNSDTLSHNVSWYDTSDRNNTWGVSAGTESGKPDSGAQVSGNYQHYSAYGDLNLSGSYKANEYNSLSASWSGSFTSTAKGAALHRRSYGNEPRVMVSTDGVGHIPLNMSRDETNRFGIGVLPSFSSYSPSSVQVNMNNLPDGVDVDNRVVTSTWTEGAIGYRQIATRAGQDVTGVLRMSSGTPPLGAIVRLDESNLQVGMVADEGRVWLGAVEPEQQFRVTWGDNQQCRFSLPSHLENSMQLILPCQ

SEQ ID NO: 9050 - protein, 256 aa, Enterobacter cloacae
EIIMKLTPIKSLCLMLISTTFTAHAAINLDRTRIVFPESDKASSLKVDNQSKALPYLALSWIEDEKGQKEDVHFMALPPIQRIEAGASSQVRIVKQAATRQLPKDRESLFYFNLREVPPKSTSASEERSVMQVAMQSRIKLFWRPEAIRKKSGELTEMRMEITANAKGLTVHNPTPYYITLAWLSKNAKTMLPGFDSLMIAPFATATASTGDYHGSYYSIGYIDDYGALKKVDVQCTGTVLCKLNERKIDKDAKAH

SEQ ID NO: 9051 - protein, 199 aa, Enterobacter cloacae
ATASQRWRSDARRGPSVGRHAAVLSGPGSTSRHGARAARPAGKLWRGDAHRRSAVGAFSLARQPDLSAGDARYLAVASPAFNPQNRLFAAHLADIKRNAMELTPREKDKLLLFTAALVAERRLARGVKLNYPESVALISAFIMEGARDGETVASLMEAGRHVLTRDQVMEGVPEMIPDIQVEATFPDGSKLVTVHNPIV

SEQ ID NO: 9052 - protein, 84 aa, Enterobacter cloacae
CQRQTEFIKGESYMPVIKVRENEPFDVALRRFKRSCEKAGVLAEVRRREFYEKPTTERKRAKASAVKRHAKKLARENARRTRLY

SEQ ID NO: 9053 - protein, 659 aa, Enterobacter cloacae
VPNIDREAPGSRTERQRQKYKYALALKVGSPSPTPIKRIKCGYRLMEQNPQSQLKLLVQRGKEQGYLTYAEVNDHLPEDIVDSDQIEDIIQMINDMGIQVMEEAPDADDLLLAETSNNTDEDAEEAAAQVLSSVESEIGRTTDPVRMYMREMGTVELLTREGEIDIAKRIEDGINQVQCSVAEYPEAITYLLEQYDRVEAEEARLSDLITGFVDPNAEEDMAPTATHVGSELSQEEMDDDEDEDEEEDDDSSDDDNSIDPELAREKFAELRTQYEVTRDTIKAKGRSHAAAQEEILKLSEVFKQFRLVPKQFDYLVNSMRVMMDRVRTQERIIMKLCVEQCKMPKKNFITLFTGNETSETWFNAAIAMNKPWSEKLHDVKEDVQRGLQKLHQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 9054 - protein, 400 aa, Enterobacter cloacae
LKYLSARAKGIMSTPIKRLEIIKNAIELEDDDIIRSQLKRLKEEAFDDELLSIVAALEQKNYTAALRAITTWLQSQRAVTPWRDPQLAASKLELKALEERLRDLIDRRNARVQQLDEFNDLYFSRLGPLMQQILALRKTLAELNLRRQQAETRRREEDYRRCQSYMAQAVEVLTTLTRRWRDLPADSVQAAEARKHLQQQSNLIANLLAEAMELETGLTREEEPARQARDEANEEYKKYREQHHDAEVRLRKGKDLSEEDRNELKRLWRQASKLCHPDLVADDLKEEANRMMVQLNQAKQRGDVKAIRLLVARLQQGFEPMMASDRLNDLERIRKKMAQVREQIDTLVNELAELEKEESWLLVSSLSNMEAYFAQQEKALKEVCASLEHQVSEAQLDPAA

SEQ ID NO: 9055 - protein, 260 aa, Enterobacter cloacae
SPPNVSQRKDPPDFTPRRFIFNHSSSILSVITTGSWKTNMKRTKTMNHASFRKSWNARHLTPVALAVTAVFMLAGCEQNDETVSLYQNADDCASATGKAAECTTAYNNALKEAERTAPKYASREDCVAEFGEGQCQQAPAQAGMAPENQAQAQSSGSFWMPLMAGYMMGRLMSGGAGYQQQPLFSSKNPNSPAYGKYTDATGKGYGAATPGRTMTVPKTAMAPKPATTSTITRGGFGESVAKQTTMQRSATGSSTRSMGG

SEQ ID NO: 9056 - protein, 124 aa, Enterobacter cloacae
KKSTYSAPERCYVSLTNGKSIKMRKLTSFLLTLLLTTLPLKEALALNCYLGGSGGPVEETKTISPFAIPSNAQVGQKIWESDDIKIPVTCDNNVTSGFKPEDVFAWVNPYPAATDPYYELGVTL

SEQ ID NO: 9057 - protein, 525 aa, Enterobacter cloacae
KERRSVNRSLCLITKCDFCHLLPVVTVRDTTQPHKKKMAEITDSTPLPAAGNTPDGDIKWVRSASDVSRLVNDGSQGRANARIVVGIALGGIFLDAYDLGALAFGIKDITREFNLTPAGTGMVASAITFGAIVGALLGGYLTDKIGRYRVFMADMVFFVVAAIACALAPNEYVLAGARFVMGLGVGIDLPVAMAFLSEFARLKGPGNKASSVAMWCPTWYAAISISYLLVLFFYAVLPESHSDWLWRLILGFGAVPALVIIAIRSRYMSESPVWAANQGNLKEAASILRQSYNINAHVPQDALDQPAPVVNKAKWSNYLNLFRGIYLRRTTLATLLSVVSSFAYNAVAFGLPVIISSFFVQSMLTTILISLALNLLFAFVGGLLAVRYVPRFGAWRMSLAGYACQLAALLGLALIGRPDGATEGVVAVAMLALFLFGQGFGPGAHTMTFASLSYPTSLRGVGVGLNQTLMRSSSTLSLFLFPLLVASLDTAVFWVIALAPFIGLASLLAIRWEPSGYDVDAEDYR

SEQ ID NO: 9058 - protein, 281 aa, Enterobacter cloacae
CGSGSTMLATQVTDNSYKGWQASLALQFCHTPEKTLLHSARHTGPLTVQRPFYPEGETCHLYLLHPPGGIVGGDTLDISVRLDAKSHALITMPGASKFYRSSGPLACLSQHFYLDEEATLEWLPQDTIIFPGANAALRSVFHLHATSTLLAWELYCLGRPVINETFSQGTLESRLEVWVDGEPRLIERLHLSGGDLTPVADHPWVGTLLFYPAREAHLDTVRERLAPLENFGGATLTDDLLSVRFLSHDNLICQRVMRDIWQSLRPLLTPKTACSPRIWQT

SEQ ID NO: 9059 - protein, 132 aa, Enterobacter cloacae
SRIFRWKPPSRTDPSSSPSTTRSCKERVMIPGEYRIQSGNIALNVGRETRSVIVENHGDRPIQVGSHYHFYEVNPALKFDREATRGYRLNIPAGTAVRFEPGQKREVTLVQVTGAQRIFGFRGEIMGEVKHG

SEQ ID NO: 9060 - protein, 241 aa, Enterobacter cloacae
NLRWRADRLCPAGADELMEHARQRLRLMQLSSSSLPVGSFTWSQGLEWAVEAGWVTDAEAFRRWQIQQMEQSFFCVDLPLFIRLYRACEKQDVATAKRWTAYLLACRETRELRDEERNRGAAFTRLIKSWEPACPPEWLPLLTQSQLCGMAWLGVRWGISARELALSLGYSWIESAVMAGVKLVPFGQQAAQQLIIDLSDHFAAGFEQAFLRGDDALGAATPLSAIASARHETQYSRLFRS

SEQ ID NO: 9061 - protein, 208 aa, Enterobacter cloacae
GVNMADYKHPLRVGVGGPVGSGKTALLEALCKAMRDTYHLAVVTNDIYTKEDQRILTEAGALEPERIVGVETGGCPHTAIREDASMNLAAVEALSEKFGNLDLIFVESGGDNLSATFSPELADLTIYVIDVAEGEKIPRKGGPGITKSDFLVINKTDLAPYVGASLEVMERDTNRMRGERPWTFTNLKAGDGLGTIIAFLEEKGMLRV

SEQ ID NO: 9062 - protein, 603 aa, Enterobacter cloacae
GRASGRNARLVFVYKSLKFLGHMAGRIPRVFINDLLARTDIVDLIDARVKLKKQGKNYHACCPFHNEKTPSFTVNGEKQFYHCFGCGAHGNAVDFLMNYDKLEFVETGRRLAAMHNLEVPYEAGSGPSQIERHQRQTLYQLMDGLNSFYQQSLKHSAAEPARQYLNKRGLSDDVIARFAIGYAPPGWDNVLKRFGGNSEDRKSLIDAGMLVTNDQGRSYDRFRERVMFPIRDKRGRVIGFGGRVLGDALPKYLNSPETDIFHKGRQLYGLYEAQQDNAEPPRLLVVEGYMDVVALAQYDINYAVASLGTSTTADHIQLLFRVTNNVICCYDGDRAGRDAAWRALETALPYMTDGRQLRFMFLPDGEDPDTLVRKEGKAAFEARMEQAQPLSTFLFNSLMPQVDLSTPDGRAQLSTLALPLISQVPGETLRIYLRQELGNKLGILDDSQLERLMPKQAENGTVRPAPQLKRTTMRILIGLLVQNPELAPQVPSLAGLNHEKLPGLGLFSELVNTCLSQPGLTTGQLLEHYRGTKEAATLEKLSMWDDIADKDIAEKTFTDSLNHMFDSMLELRQEELIARERTQGLSSEERRELWMINQELAKK

SEQ ID NO: 9063 - protein, 167 aa, Enterobacter cloacae
GRNMRHEHDGGGRRPRFFGHGDLRLVILDILTRNASHGYELIKEIENLTQGHYTPSPGVIYPTLDYLQDQSLIIITEEENGRKRIAINAAGEQWLEDNREQLEQIQTRIKARSVGFQLRKNPQMKRALDNFKAVLDLKVNQGELSDAQLKQIIGVIDRAALEISQLD

SEQ ID NO: 9064 - protein, 260 aa, Enterobacter cloacae
GECMSVPLILTILAGAATFIGAFLGVLGQKPSNRLLAFSLGFAAGIMLLISLMEMLPAALHTEGMSPVLGYGMFIIGLLGYFALDRILPHAHPQDLMQKSVTPVPGNIKRTAILLTLGISLHNFPEGIATYVTASSNLEIGFGVALAVALHNIPEGLAVAGPVYAATGSKRTAVFWAGISGMAEILGGVLAWLILGSLVSPVVMAAIMAAVAGIMVALSVDELMPLAKEIDPNNNPSYGVLCGMSVMGMSLVLLQTAGIG

SEQ ID NO: 9065 - protein, 226 aa, Enterobacter cloacae
NHLKIYLSHVNRVSPPQSVYFSSILKLTFTLRINLKKDIFMYMGKKLLLAAAMAAIVSGSAFADDQGSGKIKFKGVVIDAPCSIAPDSVDKEVDLGEVTTAVINANKKSTPVPVDINLENCQLDDPADETDTPITKVEVTFTSAATDATDTSLMSNTFANGAQNVGVRLLDNAEGNITLGQPNVLDLLAGSTTQTLHFKAVMEVPTGKTATAGQVEATANYVLMYK

SEQ ID NO: 9066 - protein, 246 aa, Enterobacter cloacae
DATGQPNGVDTRQCLDNDNITIYTPDQIRQMGWENRICSGNPDDIHITRTFVARLRLFVRIKAMPPHGYVSSLSDYIVVQFDGKGGVNQMADAKNLKYHINGLQNITVLDCGATFTIYPENQEIDFGTFSARDIVNQQTRMRTFSIRTTKVQDAQCSDGFKMDSSFYTTETLSADDTAVLIGNGLKLRILNGTAPYTFNQYKEYADFTGDKMNVEQNYTAELSREEGKAIQSGPFETVVLFKINYH

SEQ ID NO: 9067 - protein, 113 aa, Enterobacter cloacae
HATIGTNTFSSRETTMIDPKKIEQIARQVHESMPKGIREFGDDVEKKIRQTLQAQLVRLDLVSREEFDVQTQVLLRTREKLALLEQRLTELENRNAPEEVKPAPAIPPVDDQA

SEQ ID NO: 9068 - protein, 233 aa, Enterobacter cloacae
FRLMMNPLRSDTDTTTIVPLFMKITTDMLKLRLIGLTLLAFSAATAVHAEEKRYVSDELNTWVRSGPGDNYRLVGTVNAGEEVTLLQTNADTNYGQVRDSSGRTSWIPLKELSTVPSLRTRVPDLENQVKTLTDKLNNIDGTWNQRTAEMQQKVAQSDSVIAGLKDENQKLKNELIVAQKKVNAANLQLDDKQRTIIMQWFMYGGGVLGVGLVLGLVLPHLIPSRKRKDRWMN

SEQ ID NO: 9069 - protein, 433 aa, Enterobacter cloacae
LVFSATLTYHLAKRENGSVGVKSYLVGGAVRDALLGLPVKDKDWVVVGATPEAMIDAGYQQVGRDFPVFLHPKSREEYALARTERKSGSGYTGFTCYAAPDVTLEQDLLRRDLTINALAQDENGHIIDVYGGQNDLRDRLLRHISPAFSEDPLRVLRVARFAARYAHLSFRIADETMALMTAMTDAGELEHLTPERVWKETENALTTRNPQIFFQVLRDCGALKVLFPEIDALFGVPAPAKWHPEIDTGIHTLMTLSMAAMLSPEVDVRFSTLCHDLGKGLTPKELWPRHHGHGPAGVKLVEGLCQRLRVPNDIRDLAKLVAEFHDLIHTFPILKPATIVRLFDNIDAWRKPQRVEQIALTSEADVRGRTGFEASDYPQGRLLREAWDVAKAVPTKEVVEAGFKGPEIREELTKRRIDAVAAWKEKRCPQPKD

SEQ ID NO: 9070 - protein, 244 aa, Enterobacter cloacae
IQYPSRPACFLAKPDTTSGELCVLSTDAENTDTFSKRNSVMSAIAPGMIILAYLCGSISSAILVCRIAGLPDPRESGSGNPGATNVLRIGGKGAAVAVLIFDVLKGMLPVWGAYALGVTPFWLGLIAIAACVGHIWPVFFGFKGGKGVATAFGAIAPIGWDLTGVMAGTWLLTILLSGYSSLGAIVSALIAPFYVWWFKPQFTFPVSMLSCLILLRHHDNIQRLWRRQETKIWTKLRRKKKDAQ

SEQ ID NO: 9071 - protein, 568 aa, Enterobacter cloacae
NMAEISRQAYADMFGPTTGDKVRLADSELWIEVEDDLTIYGEEVKFGGGKVIRDGMGQGQMTADDCVDLVLTNALIVDHWGIVKADIGVKNGRIFAVGKAGNPDIQPGVTIPIGAATEVIAAEGKIVTAGGIDTHIHWICPQQAEEALVSGVTTMIGGGTGPAAGTNATTCTPGPWYIARMLQAADTLPVNIGLLGKGNGSNPDALREQIAAGAIGLKIHEDWGATPAAINCSLEVAEEMDIQVALHSDTLNESGFVEDTLAAITGRTIHTFHTEGAGGGHAPDIITACAHPNILPSSTNPTLPYTVNTIDEHLDMLMVCHHLDPDIAEDVAFAESRIRRETIAAEDVLHDIGAFSLTSSDSQAMGRVGEVIIRTWQVAHRMKVQRGALPEETGDNDNFRVKRYVAKYTINPALTHGIAYEVGSVEAGKLADLVVWSPAFFGVKPATIVKGGMIACAPMGDINASIPTPQPVHYRPMFGSLGAARHATRLTFISQAASANGIPQQLNLQSATAVVKGCRTVKKADMIHNALQPNITVDSQTYEVRVDGELITSEPADVLPMAQRYFLF

SEQ ID NO: 9072 - protein, 157 aa, Enterobacter cloacae
GVMMIYLTQRLDHAHPTTASVTLPIDVRVKSRARVALNDGREAGLMLPRGLLLRGGDLLTTDDGSEVIEVIAAPESVSVVRCADPFLLARACYHLGNRHVPLQIMPGELRYHHDHVLDDMLRQFGLEVTFASLPFEPEAGAYTSDAHSHGHSHAHSH

SEQ ID NO: 9073 - protein, 295 aa, Enterobacter cloacae
YFINNITYSEKQKSRLPRRNKRLYRSMHFLMQHGNRIFKTSGPVLNHRGNLRALFDQVSIFLRNAVQFCHGTGQLCQACRLLGGGVADLRDKLRDVFHLLDNIIHGTSRGVDLIGARLHFAGAGVDQLTNIVSCIRAAAGKMTHFARHHRKAFPLLARACRLNRGVQRQNIGLEGNVIDKRGNRANALGTVGYVIHGFHHGLHHGAPLRGRAAGGHRQLVDFGCGLRVTLHRRRHLVHCCHGLLNVSHGLARAVVEIFIALRQPVATVAHAYHLAGDVVDQPAAHQPQLSDGPQR

SEQ ID NO: 9074 - protein, 547 aa, Enterobacter cloacae
KNDQSHKVSEFPVDNSDRLRNNHIDGVNMFIHDVKIGTKLFLAFGLFIVLMVVSASLSLMSLNRANNGMQTILTSDYPTTVKANQLIDNFQEFISTQQLMLLDEQGTYTAQSEQRLKAISERIAAILSELDNALKDKKSQQVLADIHGVRQQYLDSRYRILQAVQNNDRAGAINEMMTNTLNLQQSYKAKVQALIAIQDHEMQSAGEQVEGDFRTNRLLLILITLFSVAAASLTGWFIVRSITRPLNDAVNFAEAIADGDLTGSITSHGKDETGLLLTALMEMKTRLLEIVQQVQTGSENISSAAAQIVAGNQDLAARTEEQASSVEQTAASMEQITATVKNTASHTGEATNLSADAAAVVKNNGEMMKQVTSKMRLINETSNRMSDIIDLIDAIAFQTNILALNAAVEAARAGEHGRGFAVVAGEVRQLAQKSATSASEIRQLIESSTSQTQDGMNLVEKASGLINGMVGNVEEMDVILREIRQASHEQTEGISQINSAIGLIDATTQQNSALVEESVAAAASLNEQAMHLKELVRVFRVSDGVLA

SEQ ID NO: 9075 - protein, 274 aa, Enterobacter cloacae
QSLSLKIHSDISYSPEKGINMASTRYPQRVRNDLRFRELNVMRTERVSAGFQRIVLGGEALEGFSSRGFDDHTKVFFPAPGTTFVPPVVTDEGIDWGDGVRPQARDYTPLYDDEKHELALDFFVHDGGIASNWAVEAKVGDKLTIGGPRGSLVVPEDYAWQLYVCDESGMPALRRRLEGIAKLPVRPAIHAIVTVGDAAYQDYLAHLSGFNITWVIGHNEQAVADHLAALDVPEEDYFIWLTGEGKVVKRLSRQFETDAIDPQLVRASAYWHAK

SEQ ID NO: 9076 - protein, 129 aa, Enterobacter cloacae
PKSRQVVMDIVFIEQLSVITTIGVYDWEQTIEQKLVFDIEMGWDNRKSAKSDDVNDCLSYADISETVIGHVEGQRFALVERVAEEVADLLLSKFNSPWVRIKLSKPGAVARAANVGVIIERGTNLKGKI

SEQ ID NO: 9077 - protein, 273 aa, Enterobacter cloacae
MSDMHSLLVAAILGVVEGLTEFLPVSSTGHMIIVGHLLGFEGDTAKTFEVVIQLGSILAVVVMFWRRLFGLIGIHFGRLPQREGEGKGRLTLIHILLGMIPAVVLGLVFHDTIKSLFNPINVMYALVVGGFLLIAAEVLKPKTPRAEGLDDMTYRQAFMIGCFQCLALWPGFSRSGATISGGMLMGVSRYAASEFSFLLAVPMMMGATALDLYKSIGFLTVGDIPMFAVGFITAYIVALIAIKTFLQLIKRISFIPFAIYRFIVAAAVYVVFF

SEQ ID NO: 9078 - protein, 503 aa, Enterobacter cloacae
RTMSPRNEYPLDDDTTLMSTTDLHSYMTHTNDTFVQVSGFTLQELLGQPHNIVRHPDMPKAAFADMWYTLQKGEPWSGIVKNRRKNGDHYWVRANAVPMVRNGQMTGYMSIRTRATEDEVAAVEPLYKALNEGRSKKRIHKGLVVRKGWLGKLPAMPLRWRVRSVMAVLFAVMAATLVASAAGWASLVAAAVLMLLGTLVFEQQIVRPVENVARQALRVATGERNSVQHLNRSDELGLTLRAVGQLGLMCRWLINDVSSQVISVRDGSDRLAQGNEDLNDRTRQTVANVQQTVATMNQMAASVQSNSETAAEVDKLSMAASSAATQGGTVMQTVVKTMDDIADSTQRIGSITSLINDIAFQTNILALNAAVEAARAGEQGKGFAVVAGEVRHLASRSANAANDIRKLIDASASKVQSGADQVHAAGRTMDDIVEQVKNVTQLIAQISHSTSEQATGLTELTRAVAELDSITQKNADLVEESAQISAMVKHRAGRLEDAVTVLH

SEQ ID NO: 9079 - protein, 172 aa, Enterobacter cloacae
TGVEMINDILAPGLRVVFCGINPGKSSAHTGFHFAHPGNRFWKVIHQAGFTDKQLKPEEEQQLLDTRCGITMLVERPTVQASEVNLHELRAGGRELIAKIEDYQPAALAILGKQAYEQAFSQRGVKWGKQDITIGVTQVWVLPNPSGLNRATLDKLVEAYRELDEALVVRGL

SEQ ID NO: 9080 - protein, 440 aa, Enterobacter cloacae
RTQKYKAMAQEIELKFIVEKDSADALRQHLNTLSGEHHEPVQLLNIYYETPDNWLRNHDMGLRIRGANGRYEMTMKIAGRVVGGLHQRPEYNIDISKPELELDRFPAEVWPEGMLPATLSAEAQPLFSTDFWREKWLVTEGKSRIEIAFDRGEIKAGEEQEPICELELELLEGDASDVLKLARKLVNQPGLRQGSLSKAARGYHLAAGNAPRVLRETPILRVVPKASVEQGMEAALELALSQWQFHEELWARNVKNAKKQVLAAMGLVRHTLTLFGGIVPRKASTHLRDLLTQTETLMLSDVSAQTAIYSPQNASAKLALTEFLVTRGWRTFLDAKGQAKIAENFKRFADIHLSRHAAELRTTFAHPLGDQYGDQLPRLARNIDSMLLLSGAYEGVKAQAWLENWQGLKHAIETRQQIEIEHFRNEAISQDPYWLHSGKR

SEQ ID NO: 9081 - protein, 958 aa, Enterobacter cloacae
FWQGTPDMPLSSQLQQHWQTVCERLPESLPASSLSEQAKSVLTFSDFVQESVSANPDWLAELESAPPQADEWRHYAGWLQTALAEVADEATLMRVLRQFRRRVMVRIAWAQALELVSEESTLQQLSELAQTLIVAARDWLYAACCKEWGTPCSEEGVPQPLLILGMGKLGGCELNFSSDIDLIFAWPENGSTRGGRRELDNAQFFTRLGQRLIKALDQPTQDGFVYRVDMRLRPFGDSGPLVLSFAALEDYYQEQGRDWERYAMVKARIMGDSDDAYANELRAMLRPFVFRRYIDFSVIQSLRNMKGMIAREVRRRGLKDNIKLGAGGIREIEFIVQVFQLIRGGREPSLQSRSLLPTLSAIDQLHLLPEGDAQTLRDSYLFLRRLENLLQSINDEQTQTLPGDELNRARLAWGMRVDDWAALTQRLEAHMAGVRRIFNDLIGDDETESQDDALSEHWRELWQDALQEDDTTPVLAHLSDDARHRVVALIADFRLELNKRAIGPRGRQVLDHLMPHLLSDVCSRDDAPVPLSRMMPLLSGIVTRTTYLELLSEFPGALKHLISLCAASPMVANKLARYPLLLDELLDPNTLYQPTATDAYRDELRQYLLRVPEEDEEQQLEALRQFKQAQMLRVAAADIAGTLPVMKVSDHLTWLAEAIIDAVVHQAWVQMVARYGQPKHLADREGRGFAVVGYGKLGGWELGYSSDLDLIFLHDCPADVMTDGEREIDGRQFYLRLAQRIMHLFSTRTSSGILYEVDARLRPSGAAGMLVTSTEAFADYQKNEAWTWEHQALVRARVVYGDPQLKTQFDAIRKAVMTTPREGSTLQTEVREMREKMRAHLGNKHRDRFDIKADEGGITDIEFITQYLVLLHAHDKPKLTRWSDNVRILELLAQNDIMDEQEAQALTRAYTTLRDELHHLALQEQPGHVALDCFADERAQVTTSWQKWLVEPCVTKQV

SEQ ID NO: 9082 - protein, 343 aa, Enterobacter cloacae
NEVKQVMRVLGIETSCDETGIAIYDDEKGLLANQLYSQVKLHADYGGVVPELASRDHVRKTVPLIQAALKEAGLSAKDIDAVAYTAGPGLVGALLVGATVGRSLAFAWDVPAIPVHHMEGHLLAPMLEDNPPAFPFVALLVSGGHTQLISVTGIGKYELLGESIDDAAGEAFDKTAKLLGLDYPGGPMLSKMAAQGTEGRFVFPRPMTDRPGLDFSFSGLKTFAANTIRNNDDSEQTRADIARAFEDAVVDTLMIKCKRALDQTGFKRLVMAGGVSANRTLRAKLAEMMQKRRGEVFYARPEFCTDNGAMIAYAGMVRLNAGATADLSVSVRPRWPLAELPEA

SEQ ID NO: 9083 - protein, 482 aa, Enterobacter cloacae
IFLESGMKVTLPEFERAGVMVVGDVMLDRYWYGPTSRISPEAPVPVVKVDTIEERPGGAANVAMNIASLGAHSRLVGLTGIDDAARALSKSLADVNVKCDFVSVPTHPTITKLRVLSRNQQLIRLDFEEGFEGVDPEPLHERINQALGNIGALVLSDYAKGALASVQTMIQLARKASVPVLIDPKGTDFERYRGATLLTPNLSEFEAVAGKCKTEEELVERGMKIIADFELSALLVTRSEQGMTLLQPGKAPLHMPTQAQEVYDVTGAGDTVIGVLAATLAAGNSLEEACYFANAAAGVVVGKLGTSTVSPIELENAVRGRADTGFGVMTEDELKVAVAAARKRGEKVVMTNGVFDILHAGHVSYLANARKLGDRLIVAVNSDASTKRLKGETRPVNPLEQRMIVLGALEAVDWVVSFEEDTPQRLIAGILPDLLVKGGDYKPEQIAGSEEVWANGGEVMVLNFEDGCSTTNIIKKIQKDSQ

SEQ ID NO: 9084 - protein, 221 aa, Enterobacter cloacae
GFFTMNQTLLSSFGTSTQRVEHALDALREGRGVMVLDDENRENEGDMIFAAENMTVEQMALTIRHGSGIVCLCITEDRRQQLDLPMMVENNTSAFGTGFTVTIEAAHGVTTGVSAADRLTTVRAAIADGAKPSDLHRPGHVFPLRAQPGGVLTRGGHTEATIDLVTLAGFKPAGVLCELTNDDGTMARAPECITFARLHNMPVVTIEDLVEYRRAHERKAS

SEQ ID NO: 9085 - protein, 274 aa, Enterobacter cloacae
AYHIDTSSKDITMSSSRMPALFLGHGSPMNVLEDNVYTRAWRQLGETLPRPKAIVVVSAHWFTRGTGVTAMETPKTIHDFGGFPQALYDTHYPAPGSPELAQRLVDLLAPVPVALDKEAWGFDHGSWGVLIKMYPNADIPMVQLSIDSTKPAAWHMEMGRKLASLRDEGIMLIASGNVVHNLRTVRWHGENTPYPWATAFNDYVKDNLAWQGPVERHPLVNYLEHDGGSLSNPTPEHFLPLLYVLGAWDGQEVITTPVDGIEMGSLSMLSVQVG

SEQ ID NO: 9086 - protein, 301 aa, Enterobacter cloacae
TDSLINHLFTAMSLVYDTFETLRQQNAVLRETVALNTGIQLAAWYNKHDTITVKSNHHTLSLYVADGYESYQKTPGGWKNGGGPDRFCLMPEESESTWDIRDDLSFVHLYCTDEHLRDVGEKIWDKRPLSLTLEEKIFGSDPKITALYRQFLLGCDWQQNANQLTLSTASTLLLTHLVQHYSSVQWKLPVVTGGLSPFVLRNVLAFIEENLAQPLTLAELAGQAALSEYHFARMFRQSMGLAPHQYVMQRRMEKAKAMVQHTTTPLTDIALACGFNSASHFSNRFRSMTGITPSQLRAAKA

SEQ ID NO: 9087 - protein, 461 aa, Enterobacter cloacae
ILPLQPGTLFALLKLTLLFLRPGGNGRLRTAFFFRSENMHRRTFIKAFALSASVVAMGFSFGVQAAETIKVGIMHSLSGTMAISETPLKDVALMTIDEINAKGGVLGKKLEPVVVDPASNWPLFAEKARQLLSQDKVAVVFGCWTSVSRKSVLPVFEELNGLLFYPVQYEGEEMSPNVFYTGAAPNQQAIPAVEYLMSEDGGSAKRFFLLGTDYVYPRTTNKILRAFLHSKGVEDKDIEEVYTPFGHSDYQTIVASIKKFSAGGKTAVVSTINGDSNVPFYKELANQGLKATDVPVVAFSVGEEELRGIDTKPLVGNLAAWNYFESVDNPTNQTFVAAYKAYAKAHKLPNADTVVTNDPMEATYVGLHMWAQAVEKAGTTNVDKVRAAMAGQSFNAPSGFTLTMDATNHHLHKPVMIGEIEGNGQFNVVWQTEQPVRAQPWSPFIAGNDKKPDQPMKTASN

SEQ ID NO: 9088 - protein, 363 aa, Enterobacter cloacae
REGDRLMSQPLTLTLARRAPRTAQIFGSLLVAALLVLPFLALLPATHPLAVSTWMLTLIGKILCYAVVAVALDLVWGYAGMLSLGHGIFFALGGYAMGMYLMRQAAGDGLPAFMSFLSWSELPWFWWGTQHFAWALVLIVTIPGLLALVFGWFAFRSKIKGVYFSIMTQALTYAGMLLFFRNETGFGGNNGFTGFTTLLGFSVTATTTRIALFLATVMLLLLALGIGYALAKSKFGRILTAVRDAENRLTFCGYDPRGFKLLVWTLSAVLCGLAGALYVPQVGIINPGEMSPTNSIEAAIWVALGGRGTLVGPVMGAALVNGAKSFFTVAMPEYWQLFLGLIFIAVTLFLPRGVFGLFRKGEN

SEQ ID NO: 9089 - protein, 226 aa, Enterobacter cloacae
GLRCIMLDLIKAVGLGLVVLLPLANPLTTVALFLGLAGNMNSAERNQQSMMASVYVFAIMMVAYYAGQLVMNTFGISIPGLRIAGGLIVAFIGFRMLFPAHKAHESPEAKSKSEELESEPSANIAFVPLAMPSTAGPGTIAMIISSASTVRDGSTFPHWVITVAPPIIFALIAIIVWGSLRSSGAIMRWVGKGGIEAISRLMGFLLVCMGVQFIINGVLEIVKTYH

SEQ ID NO: 9090 - protein, 282 aa, Enterobacter cloacae
RTRLFSLKIKNNTTKTGGNTMQEIDFYLVDAFSASSFGGNPAAVCPLDAWLTDETLLRMAQQHNQSETAFFVCTKGGIELRWFTTLTEVNLCGHATLAAAYILFNELDYPDSRLHFDTASGRLTVSREGDWMTLDFPACPTQAQTPPPELLTALGISHYVEARKGRAWVLVLESREQVEAINPDFSAMTPGEHKVAVTARDEGEYDFISRFFSPGVAVPEDPVTGSAHTMLIPYWSERLGKTQMFARQVSARGGDVRCELKGDRVRMGGQAALYLKGTVFLR

SEQ ID NO: 9091 - protein, 475 aa, Enterobacter cloacae
QSRPQSINCYYVEDIMTYSSATHAHSVNPATGETLAAYPWATSRDVERAIAQADTGFRQWRRESVAHRAQKLRDLGAALRSRAEEMAQTISREMGKPIVQARAEVAKSASLCDWYAEHGPSMLHPESTQVENAVIEYRPLGPILAVMPWNFPLWQVLRGAVPILLAGNSYLLKHAPNVLGSAELIGKVFADAGFPEGVFGWVNATNDGVSQAINDRRIAAVTVTGSVRAGAAIGAQAGAALKKCVLELGGSDPFIVLNDADLDLAVNAAVAGRYQNTGQVCAAAKRFIVEAGVADAFTQRFVDAVKALKMGAPDEEDNYIGPMARFDLRDELHQQVQATLAEGATLLLGGEKLAGSGNYYAPTVLGGVTPQMTAFRQELFGPVAAITVANDAAHALQLANDSDFGLSATVFTANDALAETFSRELECGGVFINGYSASDARVAFGGVKKSGFGRELSHFGLHEFCNVQTVWKDRI

SEQ ID NO: 9092 - protein, 315 aa, Enterobacter cloacae
PEGKEQSVAAVIHNEMLDEILAQVRPLLGQGKVADYIPALASISGNKLGIAICTVDGQRFQAGDALERFSIQSISKVLSLVAAMRQYDEQEIWQRVGKDPSGQPFNSLLQLEIEQGKPRNPFINAGALVVCDMLQSRLSAPRQRMLQIVRQLSGMQDIGYDPVVARSEFEHSARNAAIAWLMKSFGNFHNDVATVLQNYFHYCALKMNCVELAQTFLFLAHQGHAPHLGEDVVSPMQARQINALMATSGMYQNAGEFAWRVGLPAKSGVGGGVVAIVPHEMAIAVWSPELDETGNSLAGVAALEQLTKRLGRSVY

SEQ ID NO: 9093 - protein, 328 aa, Enterobacter cloacae
CSASGDVMKAPQIPVNEAERMNALRESGLLEIDNYPAFDRLTRLATRFFRVPLAMITLVDDHAAIVKSADGRALASQPRDLSFCGHTILGDAPLVVSDTLLDERFADNPQVAGDPGVRFYAGFPLRLRDGACVGSLCLIDYAPREFTAADAAVLADLSALAEDEFAAVSAATTDELTGLFNRRGFNQFAQFALSVSQRRAEPLTLGWLDLDHFKTINDRFGHQEGDKALKAMAALMRSSFREADLLVRFGGDEFAVLFADTDEPGAWIAMQYLVEQTEKYNARQLHPWSLQFSWGLSEFDHHRNDIQAWLKHADAQMYAMKRQHHGEK

SEQ ID NO: 9094 - protein, 487 aa, Enterobacter cloacae
RTSIVNTLNRRDFPGACYPERIIQFGEGNFLRAFVDWQIDLLNEHTDLNAGVVIVRPIQSDFPPSLSTQDGLYTTIIRGLNEQGEAVSDARLIRSVNREISVYSQYDEFLALAHNPDMRFVFSNTTEAGISYHAGDKLDDAPAASYPAKLTRLLFERFTHFNGAADKGWIIIPCELIDYNGDALRELVLRYAQEWALPAAFIAWLNDANTFCSTLVDRIVTGYPRDEVAELEAGLGYHDSFLDTAEHFYLFVIQGPKSLAAELRLDKYPLNVLIVDDIKPYKERKVAILNGAHTALVPVAFQAGLDTVGEAMNDAEICAFVEKAIYEEIIPVLDLPRDELHSFASAVTGRFRNPYIKHQLLSIALNGMTKYRTRILPQLLAGQKATGKLPARLTFALAALIAFYRAERNGERYPVQDDAHWLERYQQLWTQHHDKQVTTRELVSSVLSVSEHWEQDLTLVNGLVKHVALDLDAILSKGMRDAVKPLC

SEQ ID NO: 9095 - protein, 320 aa, Enterobacter cloacae
GGSRLIAALFTFLKLIMIVRLQQHWLQLIFVWHGSVLPKIYTRLLLNFLLSIAVIVMLPWYTSLGIRFTVAPFSILGVAIAIFLGFRNNACYSRYVEARLLWGQLMIAARSLFREVKNTLPDDKHLGEFVRLQIAFANCLRMTLRRETNADQLSRYLAPDDLRKVMDANSPANRILLIMGEWLAVRRRSGHLSDILFHSLNNRLNDMSIVLAGCERIANTPVPFAYTLILHRTVYLFCIMLPFALVVDLHYMTPFVSALISYTFISLDTLAEELEDPFGTEDNDLPLDAICNMMERDLLQMNDEENIPERLMPDKHYQLT

SEQ ID NO: 9096 - protein, 431 aa, Enterobacter cloacae
MTLWPRTLLARLLIIVLLGLLLANALSLTLVMVERMHSARTVMLGNLENDVATSVAILDRLPGKERPEWLERLSRGNYRYILGPGEAGAAPTDKRSRDAIRTLKETLSAQYPLQFTAVPGPISHIQAHLTLRDGAPLTIDLIPRMPPVASWLPVVLVLQLLLVALCSWIAVRQVVRPFLQFTRAVDSLDPAAHSPMTEKGPVEVRQAAHAFNEMQSRIQTYLRERAQILASISHDLQTPITRMKLRIEMADQPELRDKLLSDLDNMSRLVREGIAYARSSESLEETTLKLELNAWVNSIASDYQDIGKNVQFHARNARLPIVTRPQALRRVMTNLLDNALKFGDSAVIEIDEDERQVAIRIMDNGPGIPEAELEAVLQPFYRVETSRNRETGGTGLGLAIAAQLTAQLDGKLHIANRAEGGLAVSVTLPRG

SEQ ID NO: 9097 - protein, 441 aa, Enterobacter cloacae
LYACVSAPRADTQADKIQLFAHGLNTFVRSNNLTAPSQQPYREVVMFLIIAFLGGMISLLSPCTLPVIPLLFAGFQGQRKHILALLSGMIVMFTLVAMVVTVASEWIADATVIGRWIALLILSIAALALFFPQFAQRIARPAVSAGNVLNTHSVQRRGLVSAFLAGLAVGLLWSPCAGPILGAIFSINIAGHSAIATGALLAAYGSGCALMLGLLVAGGRKLITPLRVKSALMARLRQGAGVMMLAAVAFNASGMTSALKGANGIADQLENALLSLAQPSSTQVKLQPVADATPSSQLPSLSGGTGWVNGDPVTSEALRGKVVLIDFWTWDCINCQHTLPHVRDWAKKYESQGLVVIGVHTPEYPWEKPLSSVKNAVNKWQLPYRVVTDNNYKIWSAFGNQYWPAHYYFDAKGQLRYTAFGEGNYDKQEAVIQQLLKEARS

SEQ ID NO: 9098 - protein, 657 aa, Enterobacter cloacae
RRSMRLHSHHLELLSPARDAAIAREAILHGADAVYIGGPGFGARHNASNSLRDIAELVPFAHRFGAKVFVTLNTILHDDELEPAQRLITDLYQTGVDALIVQDMGVLELDIPPIELHASTQCDIRTVEKAKFLSDVGFTQIVLARELNLNQIRDIHQATDATIEFFIHGALCVAYSGQCNISHAQTGRSANRGDCSQACRLPYTLKDDQGRVVAFEKHLLSMKDNDQTANLGALIDAGVRSFKIEGRYKDMSYVKNITAHYRQMLDAIIDDRGDLARVSAGRTEHFFIPSTDKTFHRGSTDYFVNARKGDIGAFDSPKFIGLPVGEVLKVAKDHLDVQVTEPLANGDGLNVMIKREVVGFRANTVEKTGENRYRVWPNEMPADLYKARPNAALNRNLDHNWQQALLKTSSERRIAVDIALGGWEEQLILTMTCEDGISVTHTLDGLFEVANNAEKALNNLKDGVAKLGQTIYYARNIEVNLPDALFVPNSLLNQFRRETAEMLDEVRLANYSRGSRKAEAVPAPVYPDTHLSFLANVYNHKARAFYHRHGVQLIDAAYEAHEEKGDVPVMITKHCLRFAFNLCPKQAKGNIKSWKATPMQLVNGDEVLTLKFDCRPCEMHVIGKMKNHIFKMPPPGSIVASVSPDDLMKTLPKRKGS

SEQ ID NO: 9099 - protein, 139 aa, Enterobacter cloacae
GRFMSYVTEFPAAEPQEAVGHFLRRLSVETDCADVHHAVSSGEQDFVLLHVVGKPEHFARRHLPGALHLPWSQITAERMTAWPEGTLFVVYCAGPHCNGADRAALKLARLGLPVKIMLGGMTGWEDERFAFAGSSSPAL

SEQ ID NO: 9100 - protein, 375 aa, Enterobacter cloacae
RRQTEEISMQRHHAPYRADVVGSFLRPDSVKQARLQFASGEIDAGQLRAVEDEAIRHVVEQQCACGLHVVTDGEFRRAWWHFDFFDGLQGVERYDSQQGIQFNGVQTKAHGVRVTGKLGFGDHPMLEDFRYLKSISGNAQPKMTIPSPSVLHFRGGRKDIDATVYPDLKDYFDDLATTWRDAIRAFYDAGCRYLQLDDTVWAYLCSEDQRRQIRERGDDADELARTYARVLNKALEGKPDDLTIGLHVCRGNFRSTWISEGGYEPVAEVLFGTVNVDAFFLEYDNDRSGDFAPLRFVRPGKQQVVLGLITTKHGELENPEGVKARLEEAARYVAKEQICLSPQCGFASTEEGNSLSEAQQWDKIRLVTQIASDVW

SEQ ID NO: 9101 - protein, 537 aa, Enterobacter cloacae
KPPATKPPPGRDVMNAIRMMIAIVWLTGLLPGMAQASDADDFVAASRSQQTAMLTRWAATPEPARLPLLKALQQENLYTDSQKKAFTRIDGEMVALGAAKSAEGTTKAVRLTNRLRVLTVTALATHQLVSDSVTERRHAARQLQRDAQPDMLGFLQQRANRETDDITRQSLRLALANLQLASPQAETRLNAVELLGQSDDPDVQATLTPFTRAQTEPDARVRAAAAESLDRIQHRLMWGELLGQAFMGLSLGSVLLLAALGLAITYGLLGVINMAHGEMLMLGAYATWMVQQVMAQWMPQWLALYPVVALPVAFCLTAGIGMVLERTVIRHLYGRPLETLLATWGISLMLIQLVRMTFGAQNLEVANPAWLSGGVQVFANLTLPWNRIVVLGFVLMVLFFTWLILNKTRLGLNVRAVTQNRSMAACCGVPTGRVDMLAFGLGSGIAGLGGVALSQLGNVGPELGQGYIIDSFLVVVLGGVGQLAGSVAAAFGLGIFNKILEPQMGAVLGKILILVAIILFIQKRPQGLFALKGRVTD

SEQ ID NO: 9102 - protein, 226 aa, Enterobacter cloacae
YNIPVLIKRNEDFAVAAQPGKIALTLGTLLVSGSLFAHSHGHQMTEAEQKAANGVFEDKDVRDRKLSDWDGTWQSVYPFLLDGSLDPVFEKKAQKGEKSAAEVKAYYRKGYATDVDAIGIENNVMEFHRGKTVSSCRYDYSGYKILTYASGKKGVRYLFECKDNASEAPKFVQFSDHIIGPKASSHFHIFMGNTSHEALLKEMDNWPTYYPNEMYKEQVVEEMLHH

SEQ ID NO: 9103 - protein, 274 aa, Enterobacter cloacae
EEPTMQEIDFYLVDAFSDRAFGGNAAAVCPLEAWLPDETLLKMAKQHNQSETAFFVRTDNGFELRWFTTQDEINLCGHATLAASHVIFEYLDYPHTEITFTTRFVGELTVQRSGDWLTLNFPAWSTEVVDTPPPVLFSALGINAANEVRVGRDYMVVLDSQRQVEALTPDITAMLPLGKMVCVTAPGDEYDFVSRFFCPGEGVPEDPVTGSAHSMLIPYWSEKLGKTQMSARQVSLRGGDLRCELKGDRVLIGGQATLYMKGKIFLRLQDYVQL

SEQ ID NO: 9104 - protein, 550 aa, Enterobacter cloacae
WFCHFRFVDSLAPNVLLQKKIMNLTQIFRRLAPRFIPRQFGLLTGIFCIIGLFSALQLSSSFLLTASLNQAQRNEQRNQLAWQQQSRLDQARISLLAASDLLNRSGVYFMQDKETGSEGSWHSLMDEAQKSLAASQQAWQAWLALNPPQDEGLVNSYQLFFGAISEQAEGLVKTNSIDLFFAVPAQAFQTDFNDNFARYQQRSEKQAIQGRQSLMEQLSGLQRLFLFAPLVLLAIAIAVWFGMAKWVISPLRRLIIHINQLAAGDLSGTPPDVVRFNREISQLCGSITAMQLGLQQLVTQVSEATTAMVENIGSLAQGNQKLYQQSTRQAKELEEVTAHIADLETHVEGNTGYAKLARSRADEARQAAVGGEQMMTAVNGSMQTIVDRSSEMRGIVAMIDSVAFQTNILALNAAIEAAHAGEQGRGFAVVAREVGLLARKSSHSTQTIQALINHSLQGIEEGSQVVNRLEENLQQVTGLVANLSSLLNDISLATLNQGDSIHQMTRQLQALNQVSRQTDVLVSEASNASERLHQQSDLLLQAVSRFRLPA

SEQ ID NO: 9105 - protein, 178 aa, Enterobacter cloacae
GRAMNSPMLIKPLSRQDILTHIDALNDILVNCVNGGASVSFMLPFSAAKAQTFWLGVADSVGRDERTVLGCFDAEQGLVGTVQLITDQPENQPHRADVAKLLVHEKARRKGAAMALMESLEAVAREKALTVLVLDTSTGSGAETFYQRAGWQKAGEISRYALMPNGDMTATSMFYKFL

SEQ ID NO: 9106 - protein, 150 aa, Enterobacter cloacae
CEEHMTLIVRPLQTEDYPQWRPLWDGYIHFYECYLDESVTAATWDRALTDSSPLFCRVVEKDGSVIGFAMCVLHEGTWSTAPVCYLEDLFVDAAERGAGAGKALIDALIDEGKREGWSKLYWVTRMNNPARKLYDHYGEADDYVRYRISL

SEQ ID NO: 9107 - protein, 263 aa, Enterobacter cloacae
ALICAIFNPLPLNQEPAVEHIDHILVVDDDRDIRELIVDYLVKSGYHASGAANGKEMRVVLDKQHIDLVVLDVMMPGDDGLTLCRQLRSSRHKDLPILMLTARNEDTDRILGLEMGADDYVVKPFVARELLARIKAILRRFRTMPPNLQVTEAGRLVVFGEWQLDTVARHLIDNEGMVVALSGAEYRLLRVFLDHPQRVLTRDQLLNLTQGRDAELFERSIDLLVSRVRQRLNEDARTPAYIKTVRSEGYVFTMPVTIVEANE

SEQ ID NO: 9108 - protein, 433 aa, Enterobacter cloacae
GQAMKAISILACGADPTAQRMSTSAIQQAINSAQQNDVIVIPQGRFLTGALFLKSGVSLRLDAGAQLVGSQDLADYPLINTRVAGIDMRWPAGIINIIDCENVSITGTGTIDGQGVIWWQRFWGDDERSGMVGDYSARGLRWVVDYDCQRPRNILVFESQNILLRDFTSRESGFWNIHLCYSRRIAVEGVQISNSAGPSTDGIDVDSCEQVRIERCIVSCNDDNICIKSGRGREAAQKARTARDIVIRGCTLNKGSGITLGSETSGGIERVLIEDNAFNGTGVGFRIKSARNRGGFIRDITVQNLRLTDVRFPVLIQLNWFPQYSYGDQSNLSDKPEHWRKLAEGVEGEAGLTEVSGLTIKNMTARRSDKKYFSRAFFIEGYPERPVAGLTLEGIFIDATEFGKISGVDGLRFQDVQVTAVENTQDCNDSYER

SEQ ID NO: 9109 - protein, 194 aa, Enterobacter cloacae
GITVRYSVQVVCFAATGGTMDITQHLATTLKALRLARGWSLSKLAEETGVSKAMLGQIERNESSPTVSTLWKIATGLNVPFSAFITPESEPQAVFDPQQQAMVVKPLFPWDEQLKFDHFSITLSPGALSESTPHEAGVIEHVVVISGELDMQIDGVWRTIYADSGVRFAGDKPHAYRNSSARTVHFHSLIHYPR

SEQ ID NO: 9110 - protein, 152 aa, Enterobacter cloacae
WRESVFSELACSASGWLPSARQAGLRLPERKRQNRSRVAGSRGHAPRGAPGRALRVRVHPALASRVQQPDPPFQADADRRRPEYGSRPLPGARRHPRSPRRTDTSHRPSPGAASQRFLPPRQTQRYINRHMPARPRAARDVLSLSSFCCFLA

SEQ ID NO: 9111 - protein, 269 aa, Enterobacter cloacae
GRELMQPSEGLFTRQLPGDRYREQTDPVLQLEAINVSFDGFQALTDLSLNIGVGELRCIIGPNGAGKTTLMDVITGKTRPKSGKAIYDQSIDLTALEPAAIARQGIGRKFQKPTVFEALTVGENLEIAMKADRSVWASLRATLSGEQRDRIDEMLVLLRLGSERDRRAGLLSHGQKQFLEIGMLLVQDPHLLLLDEPAAGMTDAETEYTAELFRTLAGKHSLMVVEHDMGFVETIADHVTVLHQGRVLAEGSLREVQANEQVIDVYLGR

SEQ ID NO: 9112 - protein, 197 aa, Enterobacter cloacae
  UNSURE (188)
GEGMLQVSELNQYYGGSHILRGVSFEAVVGEVTCLLGRNGVGKTTLLRCLMGLIPVKAGEVVWQGKTITHSKPHQRVQSGVAYVPQGREIFPRLTVEENLLMGLTRFSAGNARSVPEEIWQLFPVLKEMKHRRGGDLSGGQQQQLAIGRALASRPQLLILDEPTEGIQPSVIKEIGQVIRNLANRGDXAILLGGAIL

SEQ ID NO: 9113 - protein, 311 aa, Enterobacter cloacae
SVYKILIFQGRKMTRKDGLLALLVVVAWGLNFVVIKMGLHNMPPLMLAGLRFLLVAFPALLFVARPKIPLKLLLGYGLTISFGQFAFLFCAIKFGMPAGLASLVLQVQAFFTIILGAFVFGERLQGKQLAGISLAVFGVLVLIEGSLNGQHVALLGFMLTLAAGLSWACGNIFNKLIMQHEARPAVLSLVVWSALIPIVPFMAASFILEGPQAMLKSLVEIDLTTILSLIYLAFVASIIGYGIWGSLLGRYETWRVAPLSLLVPVVGLASAALLLDETLSALQLCGAGLIMAGLYINVFGLRVRRATRVQS

SEQ ID NO: 9114 - protein, 170 aa, Enterobacter cloacae
IRRWRWGRGDCPPRDGDCRLEPGTGRDRKFTGGRSGAGTADQTSWTVRILMSTLDPLFARLARSTFRSRFHLGTKERQYCWDKGAETIDKHAADFVAARLAPAHPVNDGKQTPMRGHPVFIAQHATATCCRGCLAKWHAIPQGVPLSAQQQQYIVNVIHHWLVIEVNRAS

SEQ ID NO: 9115 - protein, 357 aa, Enterobacter cloacae
NRIRTHLLYKRMVLYLRQLNLPGDNIMFNKLAYSAVALTVSLGTVMSCQAEATGKDYASAFNQVKQINAGDLNVGYVDIGPKEGQPVILLHGWPYDIHSYAEVAPALAAKGYRVIVPSLRGYGTTRFISDKTPRNGQPSAMAKDIVNLMDALNIKQAVFAGYDWGARTADIVAALWPERVKSLVSVSGYLISSQAIGKQPLPPKAEVQWWYQFYFATPRGAEGYAKNTHDFARLIWSQASPDWKFSDATFNASAKSLDNPDHVAVTLSNYRWRLGLEKGEQKYDAYEQKLATLPNITVPTITIEGGNNGAPHPVPAAYAGKFTGKYEHRTFGATVGHNPPQEDPQDFVKAVVDADKL

SEQ ID NO: 9116 - protein, 253 aa, Enterobacter cloacae
IMLTSQRKQLILEKLEAEGQVQSTALSLFFSVSEDTIRRDLRELAAEGRLQRVHGGALPASSAIAPFAERQSVKMDAKKRVARRGAQLISPGQVVIIDGGTTTSELITFLPPDLPITVVTHSPGIALGLVGHPSIEVILIGGRLYKHSIVTVGAAAIEGINNIHADLFFMGVTGVHPEAGLTTGDYEEACIKRAFSGRAAETVVLASPEKINTASAFVIGDLSLVNTLVVENTTDERWVSAMKEKGVTVIASQ

SEQ ID NO: 9117 - protein, 222 aa, Enterobacter cloacae
FIPDVARYILYLHDSAVYDAYSTRGEPNVQSKRADIRIINSETLSDNWYNLKKYTFDFQRSDGDWQRQEREVYDRGNGATILLYNRDSKTVILTRQFRFPVFINGHEEDLIEAAAGLLDNLDPESRIKAEAEEETGFKVTRVEKIFEAYMSPGSVTEKLYFYLAEYHPQDRTSAGGGVKAEGEDIDVLEMTLDDALQGIENGQIVDGKTIMLLYHLALKGIL

SEQ ID NO: 9118 - protein, 260 aa, Enterobacter cloacae
TPQHGDAKMADWDPSLYLQYSAERTRPAAELLARVPLADITSAVDLGCGPGNSTALLKQRWPSAQIAGVDNSPAMLEEARQALPDCHFVEADIRHYKPDQPLSLIYANASLQWIPDHYHLLPHLVSLLQLNGVLAVQMPDNWLEPTHALMREVAWEQGYPDRGREPLPGIHAYYDILTEAGCDVDIWRTTYFHQMSSHQAIIDWVSATGLRPWLQELNESEQKNYLKRYLELLEEQYPLQENGQILLAFPRLFMVAQRVP

SEQ ID NO: 9119 - protein, 204 aa, Enterobacter cloacae
FIAKIKSRHRANIVIFLIRCAHLQRLDRVNKALGKGVRYARFHNKAFCRRTNLSGILITSGHRRVDGQIKIRIVQNDKRIGTAQLQHAFLQRRARLRANCRTSPNAAGYGHRRDTPIVNRLADAVIRRVHPAKDPLRETGIREYLPDQLRRAEHIWRMFKQIAVPCQQDRHRTAQHLPEREIPRHHRKNRSQRTVLNHRIFDLG

SEQ ID NO: 9120 - protein, 303 aa, Enterobacter cloacae
YSPPYSRIENGMDLTQLEMFNAVALTGSITQAAQKVHRVPSNLTTRIRQLEADLGVELFIRENQRLRLSPAGHNFLRYSKQILALVDEARMVVAGDEPQGLFSLGALESTAAVRIPESLARFNQRYPRIQFALSTGPSGTMIDGVLEGTLSAAFVDGPLSHPELEGMPVYREEMMLVTPAGHAEVSKATQVSGSDVYAFRANCSYRRHLESWFHADRVTPGRIHEMESYHGMLACVIAGAGIALMPRSMLESMPGHHQVAAWPLAENWRWLTTWLVWRRGAMTRQLEAFIALLNERQPPAPSC

SEQ ID NO: 9121 - protein, 142 aa, Enterobacter cloacae
AFTQENPAVNRKRGMTMSRRNTDAITIHSILDWIEDNLESPLSLEKVSERSGYSKWHLQRMFKKETGHSLGQYIRSRKLTEIAQKLKESNEPILYLAERYGFESQQTLTRTFKNYFDVPPHKYRITSMPGESRYLYPLKHCS

SEQ ID NO: 9122 - protein, 336 aa, Enterobacter cloacae
MRPPMPENSKKMTNLRHPSPRAVVLAYDGLCTFEFGVAVEIFGLPRPEMGDDWYQFAVASVDGGELRATGGIRILADGDLRLLETADLVVVPGWRGLDEPVPEALCQALRAAHARGCQLLSICSGVFVLAASGLLDGRKATTHWRYTQALKTRFPAITVVEDVLYQDEGDILTSAGSAAGIDLCLHVVRRNYGMEAANRVARRLVIPPHRDGSQTQQLSRPVAQLRESQRLGQLFDYLHQHLAVSHTVESLALRVGMSQRTFLRRFQDATGTTPARWLLTARLQRAKDYLENSRLSIDNIAEQTGFGQSATLRHHFRQQFALSPAQYRKHFLQPVR

SEQ ID NO: 9123 - protein, 78 aa, Enterobacter cloacae
MMFRKEFSLLLVISALFSGQIMAEHKGHEFVYVKNADHQLRHEADSDELRSAAEESAEGLREHHAWQKSRKPDTHSAG

SEQ ID NO: 9124 - protein, 401 aa, Enterobacter cloacae
YLIPDVITHNGVSMQSTASLFPAVLAGFVAVLVGYASSAAIIWQAAAAAGASTQQIAGWMTALGLGMGISTLVLSWWYKAPVLTAWSTPGAALLATSLHGVTLAETIGVFIFANTLILLCGVTGLFARLMKLIPHSLAAAMLAGVLLQFGLKAFSNLEGHIFLCGSMLAAWLVAKAVAPRYAIVATLLVGVFVAWAGGDVVTNRMTLSVIMPEFIAPAFTFTSLISIGLPIFLVTMASQNAPGFATMQASGYPLAVSPLIVATGGLALLLSPFGVYSICIAAITAAICQSPDAHPDASKRWLAAAAAGGFYLLAGVFGGSISGLMSALPLSGIQTLAGLALLGTISGSLYQALNHEAERDAAIVTFLMTASGVTLLGIGSAFWGLVLGGICYAVFSRLRRA

SEQ ID NO: 9125 - protein, 158 aa, Enterobacter cloacae
NCNRYVRPVVKNLAGVVDLFSRKVIGWSMQPRMTKEIVLNALLMAVWRRNPQKQVLVHSDQGSQYTSHEWQSFLKSHGLEGSMSRRGNCHDNAVAESFFQLLKRERIKKRIYGTRDEARSDIFDYIEMFYNSKRRHGSSEQMPPAEYENLYYQRLRSV

SEQ ID NO: 9126 - protein, 199 aa, Enterobacter cloacae
KYQNPNKSITLNYGDQRMTIPTLTTERLILRPLIAEDAVQIQQRYPRWEIVRYMVASVPWPYPENGAENYVNNVALPDMAKGIAWFWTIRRREAPDELMGLICLYDVEDNNRGFWLAPEFHGQGYMREASIAATDYWFNTLNKPVLRAPKAAANSRSRRISDSSGMRLIRTEKKAYVSGLLDSELWEITRDEWNARQVS

SEQ ID NO: 9127 - protein, 159 aa, Enterobacter cloacae
AIISAVTKLLARATIVKSTSDLFNDIIPLGRLIHMVNQKKDRLLNDYLSPLDITATQFKVLCSIRCEVCITPVELKKVLSVDLGALTRMLDRLVCKGWVERSPNPNDKRGVLVKLTSDGAAMCEQCHQLVGQTLHQELTKNLTADEVATLELLLKKILP

SEQ ID NO: 9128 - protein, 421 aa, Enterobacter cloacae
SCNNTTKKHKHLSGRKMKPSIRRSTAALLASSLLLTIGRGATLPFMTIYLTRVYDMSVENIGYALTVALTIGVVFSLGFGILADKFDKKRYMLIAIVAFIAGFVAIPLVNNVTLVVLFFALINCAYSVFSTVLKAWFADVLTSSEKAHVFSLNYSFLNIGWTIGPPIGTLLVMYSLQLPFLLAAFCAALPLGFIHFFVQKSIASDSPEEKMPWQPSVLLKDRALFWYTLSGLLASYVGGSFATCISQYVLAAHADSDFAEKVVAVVLPVNAAVVVTLQYALGRKITASNIRPLMTAATLFFILGLGGFMLSGENLIYWGIAAAIFTLGEIIYAPGEYMLIDNIAPPGMKASYFSAQALGWLGAAANPMITGLILTHLPHWSLFIIMMAAIIAAWLMILRGMRVKSEDRVSSSAALTRPGKP

SEQ ID NO: 9129 - protein, 266 aa, Enterobacter cloacae
SAAGPVRCGATASFIGLDDGHRHGKNVAFAANGFNVGRRAGIFIQALSHAAHQEINRTLKQLGITSLRQVQQLIAGQHPLRMIEEYAQKAIFRPAERHNHPLVINQMTRHGIQLPFTEYHQAPCLGHLKIRRHSTKTTQDSFDTRQQFAGHKRFHHIIVGAHLQSQDPVRVLVARGEHQDRQILMPAAAQLSTQRQAIIAGHHHVQHHQVDMLFVEHYAHLFPVRRARGVVAGFHEVIDNQFTNIPVVIDDKDVINMLHRRLLIKR

SEQ ID NO: 9130 - protein, 415 aa, Enterobacter cloacae
GFKIVSSSFRQRIPDIPMTTHTVSRRVAWLRVVTLAIAAFIFNTTEFVPVGLLSDIAASFHMETAQVGIMLTIYAWVVALMSLPFMLLTSQMERRKLLIGLFVVFIASHVLSFMAWNFTVLVISRVGIAFAHAVFWSITASLAIRLAPAGKRAQALSLIATGTALAMVLGLPIGRIVGQYFGWRTTFFAIGMGALITLVCLIKLLPKLPSEHSGSLKSLPLLMRRPALMSIYLLTVIVVTAHYTAYSYIEPFVQVVAGFSANFATVLLLILGGAGIIGSILFGKLGNQHASALVSSAIGLLLACLLLLMPAAGSESHLAILSLFWGVAIMIIGLGMQVKVLALAPDATDVAMSLFSGIFNLGIGAGALVGNQISLHVSMSAIGYLGAIPALIALIWSVLIFRKWPVAMEEQTSHG

SEQ ID NO: 9131 - protein, 77 aa, Enterobacter cloacae
DVTEEIMKFIASAALTLLVLVSGQSFAEQTPSAGQQNNRDTMIMPSTQNQSPWDFNHMGAGSDKSDELGVPYYNHDL

SEQ ID NO: 9132 - protein, 162 aa, Enterobacter cloacae
KCTVRALLLRYACGLSPAKRTPESAYIVRQTPSICISSSPLITTTCSITPASCGVDSLSAPGDRVMEKWSNLSCSSQGKSGFTTIACCCGSNTACGSLSGVINAEKGTFSPVAIFHKVETVGLDSLRSICPSIAFDTPVSSASFDRLQPRARRSAFSVVARC

SEQ ID NO: 9133 - protein, 122 aa, Enterobacter cloacae
HAKANPASQPLFLIPSDNRENLPPKRPRRRLLSLFKEWNMQNTTQPIDRASLLIEANKLIRDHEDTLAGIEATGVEQRNGVLVFSGEYFLDEQGLPTPKSTAVFNMFKYLAHTLSEKYHLVD

SEQ ID NO: 9134 - protein, 527 aa, Enterobacter cloacae
TEYENNNMQTAKPHLELLTCEAAYRHNPTALFHQVCGARPATLLLESADIDSKDDLKSLLLVDSALRITASGDTVTIKALSENGASLLPLLDAALPSGIENERHPDLRILHFPPVSQLLDEDARLCSLSVFDAFRLLQNLVAVPEDEREAMFFGGLFAYDLVAGFENLPETEQGNRCPDYCFYLAETLLVIDHQKKYTRIQASLFTPSESEKNRLAQRIAQLQQQMSEAPPALPVQRVEKMTCEVSQTDDQYGAVVRQMQKAIRAGEIFQVVPSRRFSLPCPSPLAAYDVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSFVMHLVSRVVGELRHDLDVLHAYRACMNMGTLSGAPKVRAMQLIAEAEGRRRGSYGGAVGYFTAHGDLDTCIVIRSAYVEDGIATVQAGAGIVLDSVPQSEADETRSKARAVLRAIATAHHAQEIF

SEQ ID NO: 9135 - protein, 423 aa, Enterobacter cloacae
SPNRALKTPASWHRYLKLCVHIKEEKMTTLLNPYFGEFGGMYVPQILMPALRQLEEAFVSAQKDPAFQAEFTDLLKNYAGRPTALTKCRNLTEGTKTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPFPTIVREFQRMIGEETKAQILEKEGRLPDAVIACVGGGSNAIGMFADFIDETSVGLIGVEPAGHGIETGEHGAPLKHGRVGIYFGMKAPMMQTDEGQIEESYSISAGLDFPSVGPQHAFLNSTGRADYVSITDDEALEAFKTLCRNEGIIPALESSHALAHALKMMKENPEKEQLLVVNLSGRGDKDIFTVHDILKARGEI

SEQ ID NO: 9136 - protein, 349 aa, Enterobacter cloacae
PLFCAVCAAPIKNRAAVWHWKVNLGYPPAAPFTRIAPARVALSRCRERMGRSMRHAIAPAPAMDYRRFTKICFSIQALMLPPACYPVYNCRLINTCNTQGECMSITAKSVYRDTGNFFRNQFITFLLIALLCAFITVVLGHAFSPSDEQIATLSQGDHLAGSAGLFDLVQNMTPEQQQILLRASAASTFSGLIGNAILAGGVLLMIQLVSAGQRVSALRAIGASAPVLPKLFILIFLTTLLVQMGIMLVVVPGVLLAIVLSFAPVMVVQDKLGIFTAMRSSIRLAWANMRLVAPAVISWLLAKTLLLLFAPNFAVLTPNVGAVVANTLSNLISAVLLVYLFRLYMLIRQ

SEQ ID NO: 9137 - protein, 154 aa, Enterobacter cloacae
PYSLQPEIIVASRLKSSVTSLKTMTTNDAPQGELVLRTLAMPADTNANGDIFGGWLMSQMDMGGAILAKEIAHGRVVTVRVDGMTFLRPVAVGDVVCCYARCVKRGTTSVSINIEVWVKKVSSEPIGQRYKATEALFIYVAVDSDGKPRQLPRS

SEQ ID NO: 9138 - protein, 915 aa, Enterobacter cloacae
SFVLLCVTQVGSALTILSDVSSAGLLKEFKHYQESIMAVTNIAELNALVERVKKAQREYANFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFASHGGYLLQGKELKAVQDVILKNGALNAAIVGQPAYKIAELAGFSVPATTKILIGEVKVVDESEPFAHEKLSPTLAMYRAKDFDDAVEKAEKLVAMGGIGHTSCLYTDQDNQPERVAYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSVVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMEMPKSLCAFGGLDAVTHALEAYVSVLASEFSDGQALQALKLLKENLPASYNEGSKNPVARERVHSAATIAGIAFANAFLGVCHSMAHKLGSQFHIPHGLANALLISNVIRYNANDNPTKQTAFSQYDRPQARRRYAEIADHLGLSAPGDRTAAKIEKLLAWLESLKAELGIPKSIREAGVQEADFLAHVDKLSEDAFDDQCTGANPRYPLISELKQILLDTYYARNFTVANSERRSIPN

SEQ ID NO: 9139 - protein, 213 aa, Enterobacter cloacae
NRNDIRCPARPQTGDIAMSEDRHQQRQQRLKEQVDARVAAAQDERGILIVFTGNGKGKTTAAFGTATRAVGHGQKVGVIQFIKGEWPNGERNLLEPHGVEFQVMATGFTWDTQNRETDTAACLAVWEHAKRMLSDPSLNMVLLDEITYMVAYDYLSLEAVLAALKNRPAHQTVIVTGRGCHRDILELADTVSELRPVKHAFDAGIKAQIGIDY

SEQ ID NO: 9140 - protein, 83 aa, Enterobacter cloacae
NSGECRMKEIVPDYRLDMVGEPCPYPAVATLEALPQLKKGEILEVVSDCPQSINNIPLDAKNHGYTVLDIQQDGPTIRYLIQK

SEQ ID NO: 9141 - protein, 187 aa, Enterobacter cloacae
FVSNWDRRMKQFLDFLPLIVFFAFYKLYDIYAGTLALIVATAVVLIYSWVRYRKVEKMALITFLMVAVFGGLTLFFHNDEFIKWKVTVIYGLFAGALLISQWVMKKPLIQRMLGKELTLPQAVWGRLNIAWALFFILCGLANIYIAFWLPQNIWVNFKVFGLTALTLIFTLLSGVYIYRHMPQDDKH

SEQ ID NO: 9142 - protein, 683 aa, Enterobacter cloacae
ALKQQPGVSIITAKDIEKDPPVNDLSEIIRKMPGVNLTGNSATGSRGNNRQIDIRGMGPENTLILIDGVPVTSRNSVRYSWRGERDTRGDTNWVPPEMVERIEVLRGPAAARYGSGAAGGVVNIITKRPTNDWHGSLSLYTNQPENDKEGATKRANFDLSGPLAGDALTMRLYGNINKTDADAQDINTAQNGSYAAGREGVRNKDINALLSWKLTPQQIIDFDYSYSRQGNIYAGDTQYSNSNVSPDGLVSSLYGHETNRMYRQSYGITHNGIWDWGQSKFGVYYEKTNNTRLEEGSTGKVEGMINSDKYDTSRLESYRSTGELNIPFFWLVEQTLTVGAEWNRDELNDPASMQATNVSGEVINGVPGTASERNSKNSADLTGIYLEDNIEARQGTNLIPGIRFDYHNQFGSNWSPSLNVSQDLGDMFKVKAGIARVFKAPNLYQSSEGYLLSTRGNGCPNNVSEGSCYLLGNPDLDPEISVNKEIGLAFALEGYEAGITWFRNDYKNKIVSGTDVLGQTSSGANILQWQNGGKAVVEGLEGNLTVPVIRDTLTWRTNATYMIQSKSKDTGNPLSIIPKYTVNTMLDWEVNSKLSANVSWTMYGRQKPRENAEIRKEENAMSNREIGAYSIVGIGSNYQLTKNLRLNAGISNLFDKQIYRENDGASTYNEPGRAYYAGVTLSF

SEQ ID NO: 9143 - protein, 110 aa, Enterobacter cloacae
RNCHFYRLRSFAVLYVIYAEDVPDSLEKRLSVRPAHLARLQLLQDEGRLLTAGPMPAVDSNDPGAAGFTGSAVIAEFESLEAAQAWAEADPYVAAGVYEKVTVRPYKKVF

SEQ ID NO: 9144 - protein, 503 aa, Enterobacter cloacae
ILMRKLITIRFQKDFLFMTTFYTVVSWLVILGYWLLIAGVTLRILMKRRAVPSAMAWLLIIYILPLVGIIAYLSFGELHLGKRRAERARAMWPSTAKWLADLKACKHIFAEENSSVAASLFKLCERRQGIAGVKGNQLQLMTSSDDVMQALIRDIQLARHNIEMVFYIWQPGGMADQVAESLMAAARRGIHCRLMLDSAGSVAFFRSPWAGMMRNAGIEVVEALKVNLFRVFLRRMDLRQHRKMVLIDNYIAYTGSMNMVDPRFFKQDSGVGQWIDLMARMEGPIATSMGIVYSCDWEIETGKRILPPPPDGNIMPFEEASGHTIHTIASGPGFPEDLIHQALLTAAYSAREYLIMTTPYFVPSDDLLHAICTAAQRGVDVSIIMPRKNDSLLVGWASRAFFSELLAAGVKIYQFEGGLLHTKSVLVDGELSLVGTVNLDMRSLWLNFEITLVIDDAGFGGDLAAVQDDYISRSRLLDARLWAKRPLWQRIAERLFYFFSPLL

SEQ ID NO: 9145 - protein, 113 aa, Enterobacter cloacae
QVVIMEMDLNNRLTEDETLEQAYDIFLELAVDNLDPADVILFNLQFEERGGAELFDPSEDWAEHVDFDLNPDFFAEVVIGLADEDGGEINDIFARVLLCREKDHKLCHILWRE

SEQ ID NO: 9146 - protein, 217 aa, Enterobacter cloacae
SNTESIMGQRHETCQPGLDNHMQLKRVAEAKLPTPWGDFLMVGFEELATGQDHVALVFGDISGQTPVLSRVHSECLTGDALFSLRCDCGFQLEAALSHIAEEGRGVLLYHRQEGRNIGLLNKIRAYALQDQGYDTVEANHQLGFAADERDFTLCADMFKLLGVDEVRLLTNNPKKVEILTEAGINIVERVPLIVGRNPKNAHYLDTKAAKMGHLLSE

SEQ ID NO: 9147 - protein, 256 aa, Enterobacter cloacae
GATVHYQPQKNLLQNRIILVTGASDGIGREAALTYSEYGASLILLGRNEEKLKAVAREIENAGGTPTPWYTLDLLTCTPASCQAIAQRISTHYPRLDGVLHNAGLLGEVRPMDEQDPEIWQQVMQVNVNGTFFLTQALLPLLLNSDSGSLVFTSSSVGRQGRANWGAYAVSKFATEGMMQVLAEEYQSRHLRVNCINPGGTRTKMRASAFPTEDPQKLKTPADIMPLYLWLMGDDSRRKTGMTFDAQPGRKPGISQ

SEQ ID NO: 9148 - protein, 550 aa, Enterobacter cloacae
SARGTARHCYRTPCTGDFLMADILLLDNIDSFTYNLADQLRANGHNVVIYRNHVPAQTLIDRLATMQNPVLMLSPGPGAPSEAGCMPELLTRMRGKLPIIGICLGHQAIVEAYGGYVGQAGEILHGKASSIEHDGQAMFAGLPNPLPVARYHSLVGSNIPAGLTINASFEGMVMAVRHDADRVCGMQFHPESILTSNGGRLLEQTLDWALQKLEQTNTLQPILEKLYQAQTLSQQESHQLFSAVVRGELKPEQLAAALVSMKVRGESPQEIAGAATALLENAAPFPRPDYPFADIVGTGGDGSNSINISTASAFVAAACGLKVAKHGNRSVSSRSGSSDLLAAFGINLDMNAERSREALDDLGVCFLFAPKYHTGFRHAMPVRQQLKTRTLFNVLGPLINPAHPPLALIGVYSPELVLPIAETLRVLGYQRAAVVHSGGMDEVSLHAPTLVAELNHGEVLNYQLEAADFGLTPYHQDALAGGTPEENRDILTRLLQGKGEAAHEAAVAANVAMLMRLHGEEDLKANAQKVLAVLRSGAAYDRVTALAARG

SEQ ID NO: 9149 - protein, 453 aa, Enterobacter cloacae
IMQTVLAKIVADKAIWVEARKQQQPLASFQNDVVPSSRRFYDALQGARTAFILECKKASPSKGVIRDDFDPARIAGIYKHHASAISVLTDEKYFQGSFDFLPVVSGIAPQPILCKDFIIDPYQIWLARFYQADACLLMLSVLDDEQYRQLSAVAHSLNMGVLTEVSNEEELERAIALEAKVVGINNRDLRDLSIDLNRTRQLAPRLGAGVTVISESGINSYAQVRELSHFANGFLIGSAMMEHDDLNAAVRRVLLGENKVCGLTREQDAQAAYEAGAIYGGLIFVESSPRAVNEEQARKVMAAAPLNYVGVFRDADINDVAAKADALSLSAVQLHGDEDQAYIDALRHALAPQVQIWKAQSVGATLPARNLKHVDKYVLDNGQGGTGQRFDWSLLRGEVLDNVLLAGGLSPDNCVEAAKTGCAGLDFNSGVESQPGIKDASKLASVFKTLRAY

SEQ ID NO: 9150 - protein, 286 aa, Enterobacter cloacae
QRYLHRSRYSESTRGNLMERYDNAFAQLKARQEGAFVPFVTLGDPGPEQSLKIIDTLIDAGADALELGIPFSDPLADGPTIQNATLRAFAAGVTPGQCFEMLAAIRQKHPTIPIGLLMYANLVFSRGIDAFYAECARVGVDSVLVADVPVEESAPFRQAAMRHNVAPIFICPPNADDDLLRQIASYGRGYTYLLSRAGVTGAENKAALPLHHLVEKLAEYHAAPPLQGFGISSPDQVTAAIDAKAAGAISGSAIVKIIEKNVDKPQQMLAELHAFVTSMKAATRKA

SEQ ID NO: 9151 - protein, 408 aa, Enterobacter cloacae
VQRLFMSWYSFKQTYLVKFWSPVPAVIAAGILSTYYFGITGTFWAVTGEFTRWGGQLLQLAGVHAEEWGYFKLIHLEGTPLTRIDGMMIIGMFGGCFAAALWANNVKLRMPKSRIRIMQAVVGGIIAGFGARLAMGCNLAAFFTGIPQFSLHAWFFAVATAIGSYFGAKFTLLPLFRIPVKMTKVSAASPLTQKPDQARRRFRLGMLVFFAMVAWAICTAMNQPKLGLAMLFGVGFGLLIERAQICFTSAFRDMWITGRTMMAKAIIAGMAVSAIGIFSYVQLGVEPKIMWAGPNAVIGGLLFGFGIVLAGGCETGWMYRAVEGQVHYWWVGLGNVIGSTLLACYWDDVSPVLATNWDKVNLLKTFGPLGGLLVTYALLLIAFLLVVAQEKRFFRRATAKTETQENAA

SEQ ID NO: 9152 - protein, 144 aa, Enterobacter cloacae
FDAFYFCRCAMSDHNPCMTCGACCAYFRVSFYWAEASDGGGTVPVDLTEPLTPFLRCMRGTNQKQSRCVALEGEPGVSTRCSIYADRPSPCRTFAMSGEDGQVNEACNRARARYGLPPLYKDMLFHTSLDAATSVLSGVQLPAN

SEQ ID NO: 9153 - protein, 116 aa, Enterobacter cloacae
HAVSPWTCSIAELNVIQTLFDFPTYFKFFIGLFALVNPVGIIPVFISMTSYQTAAARNKTNLTANLSWRFIILSSLYLGNAILQFFGISIDSFRYSRRDPGGDDCHVDDQRQAGGG

SEQ ID NO: 9154 - protein, 317 aa, Enterobacter cloacae
HSSGTRQKVRAMLKFILRRCLEAIPTLFILITISFFMMRLAPGSPFTGERTLPPEVMANIEAKYHLNDPITTQYFNYLKQLAHGDFGPSFKYKDYSVNDLVASSFPVSAKLGAAAFILAVVLGVTAGVIAALKQNTRWDYAVMGVAMTGVVIPSFVVAPLLVMIFAITLKWLPGGGWNGGALKFMILPMVALSLAYIASIARITRGSMIEVLHSNFIRTARAKGLPMRRIIFRHALKPALLPVLSYMGPAFVGIITGSMVIETIYGLPGIGQLFVNGALNRDYSLVLSLTILVGALTILFNAVVDVLYAVIDPKIRY

SEQ ID NO: 9155 - protein, 306 aa, Enterobacter cloacae
LEHAMMLSKKNSEALENFSEKLEVEGRSLWQDARRRFMHNRAAVASLVVLVLIALFVTLAPMLSLFTYFDTDWGMMSSAPDMESGHYFGTDSSGRDLLVRVAIGGRISLMVGIAAALVAVIVGTLYGSLSGYLGGKVDSVMMRLLEILNSFPFMFFVILLVTFFGQNILLIFVAIGMVSWLDMARIVRGQTLSLKRKEFIEAAQVGGVSTANIVVRHIVPNVLGVVVVYASLLVPSMILFESFLSFLGLGTQEPLSSWGALLSDGANSMEVSPWLLLYPAGFLVVTLFCFNFIGDGLRDALDPKDR

SEQ ID NO: 9156 - protein, 270 aa, Enterobacter cloacae
RNSVMIVVLSEKGEDMLSIARRTAAGAAVLLVIPLVVWFSGWMWQPGQNETWLKALYWITETVTQPWGIITHVLLCGWFLWCLRFRLRAALVLFAILGGAILIGQGVKSWVKDRVQEPRPFVVWLEKTHHVPVDEFYNLKRKDRGALVKEQLAEQQDIPTFLRKHWQKETGFAFPSGHTMFAASWALLGVGLLWPRRRTLTIAILLVWATGVMGSRMLLGMHWPRDLVVATLISWVLVTLATWLAQRFCGPLTPPPEEKEEIAERESGGT

SEQ ID NO: 9157 - protein, 156 aa, Enterobacter cloacae
VLFISGTPFFSSSASRLIRSGIAGGILVVTIAMSMISGKLGEDKQNKQEKSETAIRESIGVVPLALPLMAGPGAISSTIVWGTRYHSLMHLIGFSVAIALFALCCWGVFRMAPWLVRLLGQTGINVITRIMGLLLMALGIEFIVTGIKSIFPGLVH

SEQ ID NO: 9158 - protein, 340 aa, Enterobacter cloacae
AAGGAGMNAIDEKRNVLLEIADLKVHFDIKDGKQWFWQPAKTLKAVDGVTLRLYEGETLGVVGESGCGKSTFARAIIGLVKATDGKVAWLGKDLLGMKPDEWRDVRSDIQMIFQDPLASLNPRMTIGEIIAEPLRTYHPKMPRQEVRDRVKAMMLKVGLLPNLINRYPHEFSGGQCQRIGIARALILEPKLIICDEPVSALDVSIQAQVVNLLQKLQREMGLSLIFIAHDLAVVKHISDRVLVMYLGHAVELGTYDEVYHNPLHPYTKALMSAVPVPDPDLEKNKTIQLLEGELPSPINPPSGCVFRTRCPIAGPECAKTRPVLEGSFRHAVSCLKVDPL

SEQ ID NO: 9159 - protein, 287 aa, Enterobacter cloacae
CQPLFFEVNVSRLFTSARQRLYHLLFDPETVSGRRFEGLCGLFALISVIIIFIESGAGTQYHMTYEEWHVFVWLELIVTLVFTAEYVLRVISWPNPAKYVFSFWGFIDLATILPLYVMWLWPEISLNYVFAWRAMRAIRVLRILKLLRFMPSLRVFWVAIVSARHQLILFYSFIAIVMIVFGSLMYLIEGPKYGFTTLNASVYWAIVTVTTVGYGDITPHTPLGRIVASVLILIGYSVIAIPTGLITTHMSSAFQNSKQQRKCPKCQQGNHEPGARFCHRCGNALPD

SEQ ID NO: 9160 - protein, 215 aa, Enterobacter cloacae
RCPLNIQAINFCSLFPSAFRDILSPLNVMILKDESLSLDFYCTFGAGCAQGRFRTFVIFLIGRLCFRMGNTLALLKEQRMNGKVMAALFGIAILSGCASSKTSPERHAFYFVSHQSSFTGGNYTSSVQKNYQLNVAQFRELYARGKADRAEGRTQAEASEYAQSIRDQLKENATSQELFAGNTKDKWSSDMDSKDAILFGNELAATYLDGYNGVQ

SEQ ID NO: 9161 - protein, 291 aa, Enterobacter cloacae
LQCKDNNNVKTLIWMPLFCPHVRLNCARTKCLIEYDCYLHLKSRFGFLTLMIMTSMTLDLPRRFPWPTLLSVVIHGAVVAGLLYTSVHQVIEMPAPAQPISVTMVSPADLEPPQVAPPPPQPVVEPEPEPEPEPVPEPPKEAPVVIHKPEPKPKPKPKPKPVKKVEVRPVEPRATQPVENAAPSRPLMNNTTTATKPTVTAPAGPRALSRNQPQYPARAQALRIEGRVRVKFDVTADGRVDNVEILSAQPANMFEREVKSAMRRWRYEAGKPGNGLIVNIVFRLNGGAQME

SEQ ID NO: 9162 - protein, 217 aa, Enterobacter cloacae
NHNDGADMKKLAVAALILSSLSGGAYAHEAGEFFIRAGSATVRPTEGSDNVLGMGGFNVSNNTQLGLTFTYMATDNVGVELLAATPFRHRVGLGPTGDIATVHHLPPTLMAQWYFGDSSSKVRPYIGAGVNYTTFFDEKFNDTGKEAGLSDLSLKDSWGMAGQVGLDYLINRDWLINASVWYMDIDTDVRFKAGGQQQSINTRLDPWVFMFSAGYRF

SEQ ID NO: 9163 - protein, 210 aa, Enterobacter cloacae
REGSMSQFFYIHPDNPQPRLINQAVEIVRKGGVIVYPTDSGYALGCKIEDKGAMERICRIRQLPDGHNFTLMCRDLSELSTYAYVDNVAFRLIKNNTPGNYTFILKGTKEVPRRLLQEKRKTIGMRVPSNPIAQALLETLGEPMLSTSLMLPGSEFTESDPEEIKDRLEKVVELIIHGGYLGQQPTTVVDLTEDAPEVIREGVGDVKPFL

SEQ ID NO: 9164 - protein, 353 aa, Enterobacter cloacae
IKVERVELLSQYGLFLAKIATVVIAVAVIAVLIVNLTQRKRQRGELRITRLSEQYKEMQEEMSLALLDDHQQKLWLKAQKKKHKQDAKAAKAKAKLATPQADAKPRVYVLDFKGSMDAHEVSSLREEVTAVLAVATAQDQVVVRLESPGGVVHGYGLAASQLQRLRDKQIPLTVAVDKVAASGGYMMACVADKIVAAPFSIIGSIGVVAQIPNFNRFLKNKEIDIELHTAGQYKRTLTLLGENTEEGRQKFREDLNETHHLFKDFVHRMRPTLDIEQVATGEHWYGTQAQEKGLVDEVGTSDDLLLNLMDGRELVGVRFTRRKRLLDRFTNSAAESADRLLLRWLQRGQKPLL

SEQ ID NO: 9165 - protein, 946 aa, Enterobacter cloacae
IVKPRHGGVFCFIPRVGPFLNLSIWVVIKTLRHLCVIFNYSPDDCQDIPVFKEELMSLTLREASKDTLQAENKTWRYYSLPLAARTLGDISRLPKSLKVLLENLLRWQDGDSVTEEDIQALAGWLKNAHADREIAYRPARVLMQDFTGVPAVVDLAAMREAVKRLGGDTAKVNPLSPVDLVIDHSVTVDHFGDDDAFGENVRLEMERNHERYVFLKWGQQAFSRFSVVPPGTGICHQVNLEYLGKAVWSELQDKEWVAYPDTLVGTDSHTTMINGLGVLGWGVGGIEAEAAMLGQPVSMLIPDVVGFKLTGKLSEGITATDLVLTVTQMLRKHGVVGKFVEFYGDGLDSLPLADRATIANMAPEYGATCGFFPIDSVTLEYMRLSGRSEEQVALVEAYTKAQGMWRNPGDEPVFTSTLELDMGTVEASLAGPKRPQDRVALSNVPKAFAASNELEVNAAQKDHRPVDYVLNGHQYQLPDGAVVIAAITSCTNTSNPSVLMAAGLLAKKAVELGLKPQPWVKASLAPGSKVVSDYLAQARLTPYLDELGFNLVGYGCTTCIGNSGPLPEPIEVAIRQGDLTVGAVLSGNRNFEGRIHPLVKTNWLASPPLVVAYALAGNMNINLATDPIGHDRKNEPVYLKDIWPSSREIARAVEKVSTEMFRKEYAEVFEGTAEWKAIDVVGSDTYDWQDDSTYIRLSPFFDEMLAEPAPLKDIHGARILAMLGDSVTTDHISPAGSIKADSPAGRYLQSRGVERRDFNSYGSRRGNHEVMMRGTFANIRIRNEMVPGVEGGMTRHLPDTEVISIYDAAMKYQQEGTPLAVIAGKEYGSGSSRDWAAKGPRLLGVRVVIAESFERIHRSNLIGMGILPLEFPQGVTRKTLGLTGEEQIDISGLQNLQPGKTVPVKLTRADGTTEVLDCRCRIDTATELTYYQNDGILHYVIRKMLD

SEQ ID NO: 9166 - protein, 115 aa, Enterobacter cloacae
TRFIRSNHITGSHVKYLLIFLLVLAIFVISVTLGAQNDQQVSFNYLLAQGEYRVSSLLAVLFAAGFVIGWLVCGMFWLKVRVSLVRAERKIKRLEHQLTPASDIPASSGVPVVKE

SEQ ID NO: 9167 - protein, 363 aa, Enterobacter cloacae
SNMLELLFLLLPVAAAYGWYMGRRSAQQTKQDEANRLSRDYVAGVNFLLSNQQDKAVDLFLDMLKEDTGTVEAHLTLGNLFRSRGEVDRAIRIHQTLMESASLTYEQRLLAVQQLGRDYMAAGLYDRAEDMFSQLVDETDFRIGALQQLLQIYQATSDWQKAIDTAERLVKLGKDKQRVEIAHFYCELALQQMGSDDMDKAMALLKKGAAADRNSARISIMMGRVFMANGDYAKAVESLLRVIDQDKELVSETLEMLQTCYQQLGKQDEWVAFLRRCVEENTGATAELMLSDVVEEHEGSDTAQVYITRQLQLHPTMRVFHKLMDYHLNDAEEGRAKESLMVLRDMVFNRGDWPDQRLILAKS

SEQ ID NO: 9168 - protein, 582 aa, Enterobacter cloacae
QEVKKNLTVAKKTPALYRPQQGITQLAKASHYNEWSINTMSIITKKSLVAAGILTALIAGNAAMAADVPAGVQLAEKQTLVRNNGAEVQSLDPHKIEGVPESNVNRDLFEGLLVTDVNGHPAPGVAEKWDNKDFKVWTFHLRKDAKWSDGTPVTAEDFVYSWQRLADPNTASPYASYLQYGHIANIDDIITGKKPVTDLGVKAIDANTFEVTLSEPVPYFYKLLVHPSVSPVPKSAVEKFGEKWTQPANIVTNGAYKLKDWVVNERMVLERNPQYWDNAKTVINQVTYLPISSEVTDVNRYRSGEIDMTYNNMPIELFPKLKKEIPKEVHVDPYLCTYYYEINNQKAPFTDVRVRTALKLALDRDIIVNKVKNQGDLPAYSYTPPYTDGMKLVEPEWFKWSQEKRNEEAKKLLAEAGYTADKPLTFSLLYNTSDLHKKLAIAVASIWKKNLGVNVKLENQEWKTFLDTRHQGTFDVARAGWCADYNEPTSFLNTMLSDSSNNTAHYKSPAFDKLIGETLKVADDAQRADLYAKSEQQLDKDSAIVPVYYYVNARLVKPWVGGYTGKDPLDNISVKNLYIIKH

SEQ ID NO: 9169 - protein, 349 aa, Enterobacter cloacae
CPRPERPLRSAVMTIIETATAPQAQQRTSALLDVKDLRVTFKTPDGDVTAVNDLNFDLRAGETLGIVGESGSGKSQTAFALMGLLASNGVIGGSATFNGKEILNLPEHELNKLRAEQISMIFQDPMTSLNPYLRVGEQLMEVLMLHKGLGKAEAFEESVKMLDAVKMPEARKRMRMYPHEFSGGMRQRVMIAMALLCRPKLLIADEPTTALDVTVQAQIMTLLNELKREFNTAIIMITHDLGVVAGICDKVLVMYAGRTMEYGNARDVFYQPAHPYSIGLLNAVPRLDAEGESLLTIPGNPPNLLRLPKGCPFQPRCPHAMEICNSAPPLEAFVPGRLRACFKPLEELV

SEQ ID NO: 9170 - protein, 212 aa, Enterobacter cloacae
DVFAEFGVLNFWTYVVGAFFIVLVPGPNTLFVLKTGIGHGVKKGYLAATGVFIGDAVLMFLAWAGVAALIQTTPVLFNIVRYLGAFYLLWLGGKMLWSVMTRQKNAHESSAEPASAILKRSLVLSLTNPKAILFYVSFFVQFIDVNAKNTGTSFLILATTLELISFMYMSFLIFSGAFVTRYLKTKKKLAKLGNGLIGLLFVGFAARLASLH

SEQ ID NO: 9171 - protein, 316 aa, Enterobacter cloacae
FQYFTVSRYHRGFGCLQPVMGSALSDTTYAVIYDLHSHTQASDGLLTPEALVHRAVEMRVGTLAITDHDTTDGIPAARAEIVRSGLALDLVAGVEISTVWENHEIHIVGLNIDTEHPAMRAFLQEQKTRRNQRAEMIGERLEKAHIPGALEGARKLANGGAVTRGHFARFLVDAGKATTMANVFKKYLARGKTGYVPPQWCTIKQAIDVIHHSGGKAVLAHPGRYNLSAKWLKRLLAHFAECGGEAMEVAQCQQAPNERSQLATYARQFGLLGSQGSDFHQPCAWIELGRKLWLPAGVEPVWQLWEQPQQIEEREV

SEQ ID NO: 9172 - protein, 294 aa, Enterobacter cloacae
GSSMSEKLQKVLARAGHGSRREIEAIIEAGRVSVDGKIATLGDRVEIVPGLKIRIDGHLISVKESAEQICRVLAYYKPEGELCTRNDPEGRPTVFDRLPKLRGARWIAVGRLDVNTCGLLLFTTDGELANRLMHPSREVEREYAVRVFGQVDENKLRDLSRGVQLEDGPAAFKTIKFTGGEGINQWYNVTLTEGRNREVRRLWEAVGVQVSRLIRVRYGDILLPKGLPRGGYTELDLTQTNYLRDLVGLTPETSSKVAVEKDRRRMKANQIRRAVKRHSQVSSNRRSGSRNNNG

SEQ ID NO: 9173 - protein, 869 aa, Enterobacter cloacae
VKVNMGKALVIVESPAKAKTINKYLGNDYVVKSSVGHIRDLPTSGSASKKSADSTSTKGAKKPKKDERSALVNRMGVNPWQNWDAHYEVLPGKEKVVNELKQLAEKADHIYLATDLDREGEAIAWHLREVIGGDDKRYSRVVFNEITKNAIRQAFEKPGELNIDRVNAQQARRFMDRVVGYMVSPLLWKKVARGLSAGRVQSVAVRLVVEREREIKAFVPEEFWEVDANVTTPGGDALPLQVSHHNDKPFRPENRDQTMAAVALLEKARYQVLDREDKPTSSKPGAPFITSTLQQAASTRLGYGVKKTMMMAQRLYEAGYITYMRTDSTNLSQDAVNMVRGYIEDNFGKKYLPDSPNQYASKENSQEAHEAIRPSDVSVLAESLKDMEADAQKLYQLIWRQFVACQMTPAKYDSTTLTVGAGDFRLKARGRILRFDGWTKVMPALRKGDEDRTLPSVNKGDELSLVDLVPAQHFTKPPARFSEASLVKELEKRGIGRPSTYASIISTIQDRGYVRVENRRFYAEKMGEIVTDRLEANFRELMNYDFTAQMEDSLDEVASHKAEWKKVLDSFFSDFTNQLEKAEKDPEEGGMLPNQMVLTSIDCPTCGRKMGIRTATTGVFLGCSGYALSPKERCKTTINLVPENEVLNVLEGDDAETNALRAKRRCKKCGTAMDSYLIDPKRKLHVCGNNPTCDGYEIEEGEFRIKGYDGPIVECEKCGSEMHLKMGRFGKYMACTNDDCKNTRKILRNGEVAPPKEDPVPLPELPCEKSDAYFVLRDGAAGVFLAANTFPKSRETRAPLVEELYRFRDRLPEKLRYLADAPQQDPEGNKTVVRFSRKTKQQYVAAEKEGKATGWSAFFVDGKWVEGKK

SEQ ID NO: 9174 - protein, 329 aa, Enterobacter cloacae
IGWSGMKLQQLRYIVEVVNHNLNVSSTAEGLYTSQPGISKQVRMLEDELGIQIFARSGKHLTQVTPAGQEIIRIAREVLSKVDAIKSVAGEHTWPDKGSLYIATTHTQARYALPGVIKGFIERYPRVSLHMHQGSPTQIAEAVSKGNADFAIATEALHLYDDLVMLPCYHWNRSIVVTPDHPLAGKGEVTIEELAQYPLVTYTFGFTGRSELDTAFNRAGLTPRIVFTATDADVIKTYVRLGLGVGVIASMAVDPVSDPDLVRLDAHDIFSHSTTKIGFRRSTFLRSYMYDFIQRFAPHLTRDVVDTAVALRSNEDIEEMFKDIKLPAK

SEQ ID NO: 9175 - protein, 63 aa, Enterobacter cloacae
YMAEQHRGGTGNFAEDREKASEAGRKGGQHSGGNFKNDPQRASEAGKKGGQNSHGGGRKSDNS

SEQ ID NO: 9176 - protein, 188 aa, Enterobacter cloacae
IYREHAAGPSARSTFPLFHWSENMNMKTVEDVFIHLLSDTYSAEKQLTRALSKLARAASSEKLSAAFTAHLEETQGQIERIDQIIEQESGLKLKRMKCVAMEGLIEEANEVIESTEKNEVRDAALIAAAQKVEHYEIASYGTLATLAEQLGYKKAVKLLAETLEEEKETDLKLTDLAVGNINQKAQKG

SEQ ID NO: 9177 - protein, 550 aa, Enterobacter cloacae
YRRLSLRITMAGWHTRAIIYQIDTALFYDLNGDGCGDIAGIAAKLRYIRRMGATVIWITPFYLTPFLDEGYDVSDHLQVDPRFGKLNDIIAFIEQARELGMQVIIELLIQHTSDAHPWFQQARRNPQSPYRDYYLWSDTDDDDTPPMFPGVEKSIWTWDDEAGQYYRHMFYHHEPDLNLASPAVLKEVENIIIFWLKLGVSGFRLDAASHLTKQAGRGDEKRGLWILEHLRRLIEQRNPDAILLGEVDVEVEAYKDYFGQNDRLNLVLNFWLNKYFYVSLAEKSARPLRNAVKKMIVPPDSCCFANWLRNHDELDLEGIGKKTKQTVIDAFAPDEEMSVYQRGIRRRLAPMLNGDRKRLAFCHAVLFSLPGVPVMRYGDEIGMGDDLELEERYAVRTPMQWAGSQGGGFSDADPETFIAPMIDRGPYRYQKINVADSLLHRNSLLHCIIDIANTRSEFPEIGVAPFRLINIDSDAVLGIYYETDTRSILTFVNFSDKPVNFTARGIRHATWTACLADKRYNDALVCGKTVALNLSGYGYRWFWTDRTALR

SEQ ID NO: 9178 - protein, 144 aa, Enterobacter cloacae
QQYLISQDIQNEGYQMKLSVISALLILIIPTAWADNNGGLQKGDAPPPPHALDSGYRGTDDARIMTITQAKEMHDGASISLRGNLIDGNGDKYVFQDKTGKIDVIIPKAVFDDRTVEPDNMISISGSLDKKSSPPVVRVSHLQK

SEQ ID NO: 9179 - protein, 190 aa, Enterobacter cloacae
TIKHFGTGASMSIQEHVILVNDQGKVIGTQEKYAAHTSHTPLHLAFSSWLFNANGECLITRRALSKKAWPGVWTNSVCGHPQADEATEQAIIRRCRFEVGAEITDITPIAPEFRYREADPSGIVENEICPVYAARVTNTLAINDDEVMEYQWVELDALFRALDATPWAFSPWMVQEANTAREKLSAFAAQ

SEQ ID NO: 9180 - protein, 177 aa, Enterobacter cloacae
DSYAMNIGLFYGSSTCYTEMAAEKIRDIIGPELVTLHNLKDDAVALMEQYDVLILGIPTWDFGEIQEDWEAIWDQLDSVNFEGKIIAMYGMGDQLGYGEWFLDALGMLHDKLAPKGATFIGYWPTEGYEFTSPKPVIADGQLFVGLALDETNQYDLSDERLQTWCEQILGEMAEQFS

SEQ ID NO: 9181 - protein, 210 aa, Enterobacter cloacae
APCPMQKENNMRALIALLLLSLSTFGFAAPSDDASSDQLAKLLFNDPNSPRTGAASPKLTIVSFTDYNCPYCKQFDPMLEKIVQENPDVQLIVKLLPFKGQSSVNAAKAALSTWQQAPDKFWALHQRLMMKKGYHDDASIAAAKVKTGTDSIKTDDKTMDSLKMNLILAQVLNIQGTPATIIGDQMVAGAIPYDDLEGLVKEQLANARGK

SEQ ID NO: 9182 - protein, 300 aa, Enterobacter cloacae
SEKITKEGETMFRHVKQLQYTVRVAEPNPGLANLLLEQFGGPQGELAAACRYFTQGLSDDDPGRKDMLMDIATEELSHLEIIGTLVGMLNKGAKGELAEGVENEAELYRSMTENGNDSHITSLLYGGGTPLTNSGGVPWTAAYVDTIGEPTADLRSNIAAEARAKIIYERLINVTDDPGVKDALAFLMTREAAHQLSFEKALQSIRNNFPPGKLPPIEEYTNKYYNMSEGGEVRGSWNSDKHFDYVESPQPAVDGGDGGASVTLTTEQATLVKAMCARTKSDPNADPLTGAELGAGKKKP

SEQ ID NO: 9183 - protein, 358 aa, Enterobacter cloacae
YIGHPCPSAVRRRVCSGRGEDLMGVDIPVIWFAIIVFATLMYIIMDGFDLGIGMLFSFVGDAKERDVMVNSVAPVWDGNETWLVLGGAGLFGAFPLAYAVIIDALTIPLTAMLIGLIFRGVAFEFRFKATPSHRKFWDYSFAGGSLLATFSQGIVVGAMINGFDVEGRRFVGSSLDWFTPFNLFCGLGLIVAYTLLATTWLIMKSEGALQNRMRELTRHVLLALIAVIAVVSIWTPLGWQFVAERWFTLPNFFWFLPVPVLVAVFSLWIWRLTRNPDSHARPFLLTLGLIFLGFSGLGISLWPHIIPPHITLWEAAAPPASQLFMLIGTLLIIPVILVYTAWSYYVFRGKVSDTEGYH

SEQ ID NO: 9184 - protein, 309 aa, Enterobacter cloacae
RCNYPSNLTPNKELAMSDNEQRTNAYPTPPFPKQPQTPPGLSSEMEPVPDHGEKSYKGHGRLAGKKALITGGDSGIGRAVAIAYAREGADVAINYLPEEEEDAAEVITLIKAEGRNAVALPGDVRDETFCQNLVEQAVSKLGGLDILVNNAGRQQYRESLEELTTEDFDATFKTNVYAPFWITKAALRHMKAPASIINTSSVQAVKPSAVLLDYAQTKACLAVFTKALAKQLGPKGIRVNAVAPGPYWTVLQPSGGQPQEKVKHFGESTPLGRPGQPVEIAPLYVTLASDECSYTSGQVWCSDGGDGVI

SEQ ID NO: 9185 - protein, 508 aa, Enterobacter cloacae
QITISTNCYIVTFNSALLDSKSISPELRIAKMKKLTLPKDFLWGGAVAAHQVEGGWNKGGKGPSICDVLTGGAHGVPREITQEVIEGKYYPNHEAVDFYGHYKEDIKLFAEMGFKCFRTSIAWTRIFPKGDETQPNEEGLKFYDDMFDELLKYNIEPVITLSHFEMPLHLVQEYGGWTNRKVVDFFVRFSEVVFERYKNKVKYWMTFNEINNQRNWRAPLFGYCCSGVVYTEHDNPEETMYQVLHHQFVASALAVKAARRINPEMKVGCMLAMVALYPYSCKPEDVMFAQESMRERYVFTDVQLRGYYPSYVLNEWERRGFSIRMEAGDEQILREGTCDYLGFSDYMTNAVKAEGGTGDAISGFEGSVPNPHVKASDWGWQIDPVGLRYSLCELYERYQKPLFIVENGFGAYDKVEEDGSINDDYRIDYLRAHVEEMMKAVTWDGVDLMGYTPWGCIDCVSFTTGQYSKRYGFIYVNKHDDGTGDMSRSRKKSFEWYKTVIASNGETL

SEQ ID NO: 9186 - protein, 201 aa, Enterobacter cloacae
IFRVPRRPLSATRWWRAPFRMTTWRGWSKNSWQTPVASKLPRLLRELGVWLLIGVAVSLAVDYFRQPALPQNFSATALHTLDGQPVDLIAMSKERPLLVYVWATWCGVCRYTTPSVAALAADGGNVMSVALRSGDNATLETWMRKKKAMMPTVNDASGELAREWDVKVTPTLVVISHGEVKSITTGWTSGWGMRLRLWLAS

SEQ ID NO: 9187 - protein, 306 aa, Enterobacter cloacae
YAVAITNSLTEQLAKRMTVDTGMRMLVSFGVVLILNLIFLMGRHITIKVMGFLVFPLIAYFLFVSLYLTGSWQPSLLTSQMAFDQHTLHQVWISIPVMVFAFSHTPIISTFAVDRREKYGEEAMGKCKKIMKVAYLIICLSVLFFVFSCLLSIPPSYIVAAKEEGVTILSALSMMPSSPAWLGISGIIVAIIAMSKSFLGTYFGVIEGATEIVKSSLNQVGVKKSRAFNRAVSILGVSLITFAVCCINPNAISMIYAISGPLIAMILFIMPTLSTYLIPSLKPYRSIGNLLTLIVGVLCVSVMFVG

SEQ ID NO: 9188 - protein, 177 aa, Enterobacter cloacae
PDNKSQELIMNHVEHYHDWLRDAHAMEKQAESMLESMASRIDNYPDLRARIEQHVNETKHQITVLEEILDRNDISRSVIKDSMSKMAALGQSIGGMFPSDEIVKGSISGYVFEQFEIACYTSLLAAAKQAGDTASIPAIESILEEERQMADWLLQHIPQTTEQFLLRSDADGVEAKK

SEQ ID NO: 9189 - protein, 483 aa, Enterobacter cloacae
GCLAMPCALSVPEVRSMFELDAFHLARIQFAFTVSFHILFPAITIGLASYLVVLEGMWLRTKNDVWRSLYHFWLKIFAVNFGMGVVSGLVMAYQFGTNWSGFSQFAGSITGPLLTYEVLTAFFLEAGFLGVMLFGWNKVGPGLHFFATCMVALGTLMSTFWILASNSWMHTPQGFSIQNGQVIPEDWLAIIFNPSFPYRLIHMSIAAFLCSALFVGASGAWHLLRGNDTPAIRKMFSMAMWMALMVAPIQAVVGDMHGLNTLEHQPAKIAAIEGHWENPPGEATPLLLFGVPDMEEERTKYGLEIPALGSLILTHSLDKQVPALKDFPKEDRPNSLIVFWSFRIMVGMGLLMITLGVLSVWLRYRRRLYHSRPFHWFALCMGPAGLLALLAGWVTTEVGRQPWVVYGYLRTIDAVSLHSTLQMSISLLAFIVVYCSVFGVGYVYLARLIKKGPQPVGTLTSNTSGTPARPLSAAESVPEEEKI

SEQ ID NO: 9190 - protein, 332 aa, Enterobacter cloacae
AIQDITMAFTPFSPRQPAASARLPLTLITLDDWALATLTGADSEKYLQGQVTADVAQLTEHQHLLAAHCDPKGKMWSNLRLFRRQDGFAFIERRSLRDAQLKELKKYAVFSKVTIALDDEYVLLGVAGFQARAALKNLFAELPDAEKQLVSEGATSILWFEHPAERFLLVTDEATAERVTDALRGEAQLNNSQQWLALNIEAGLPVIDAANSAQFIPQATNIQALGGISFKKGCYTGQEMVARAKFRGANKRALWTLAGHASRVPEAGEDLEMKMGENWRRTGTVLAAVQLDDGRLLVQVVMNNDMEPDSVFRVRDDANTLSIEPLPYSLED

SEQ ID NO: 9191 - protein, 253 aa, Enterobacter cloacae
CPTASLAIVSMFSHSAIASLNNLEMMVYNYVIKNRDKVMYMTIRELADAAGVSTTTILRFCRKLNCDGYSEFRVRFKLYLEQNEPQQANFGASEIISFFKSVNNEEFDALLDKAVDIILSSERIIFVGAGTSGSLAKYGARFFSNIGKFSNHIDDPYFPVTNDMAKNALAIVLSVSGETEEILRFASQFSLHHCKVLSVTSHEHSRLAKLADFNLSWHVPQTRIGGVYDITTQIPVIYILESLGRKLAKKLTE

SEQ ID NO: 9192 - protein, 124 aa, Enterobacter cloacae
IFEANMIKRQRNAILLVALACLVVLICTAQRMAGMHALVMNVTATSQSVQQGQESTDAPVTPCELSAKSLMSVPPVLFEGALIAVTLLLALLAASPPRRERQWPPRVISPPRLRVHLRLCVFRE

SEQ ID NO: 9193 - protein, 670 aa, Enterobacter cloacae
FMFTVFRRLLVCLLWLWLPLSQAADSGWLRAADNQHASVRLRAQPESTGETRLLLDVALQKGWKTYWRSPGEGGVAPAIKWHQPVEAKWRWPVPQRFDVAGITTQGYHGDVSFPITLRGDVPKILSGVLTLSTCSNVCILTDYPFSLNMTASAGAGFDYDFSRAMGTLPLSGGLTSTLNATYAPGKLTVTAQRDAGWQAPSLFIDGMDDVDFGKPALTVRGDSLVATVPVTDSWGEAAPNLSGKTLSLVLADSGQAQESSLSIQPGNAAPTLSLGWVLLMALAGGLILNVMPCVLPVLAMKLGTLMQTERQARGQVRRQFLASVAGIVISFLALALMMTVLRLGNQALGWGIQFQNPWFIGAMAMVMVLFSASLLGLFEIRLPSVASTFLATRGGNGLAGHFWQGAFATLLATPCTAPFLGTAVSVALAAPLPLLWGIFLAMGIGMSLPWLLVAVWPGLAQRLPRPGRWMNVVRVVLGMMMLGSSLWLLSLLTVHIGSLPVITLGVLLILTLLLVTAWRYRWQTALRAGVLAVVVAGAVAFVSGSGGEGSRRDRIHWQPLSEQAIARALAENKRVFVDVTADWCVTCKANKYNVLLRDDVQDALSAPDVVALRGDWSRPSDTISQFLTTRGSAAVPFNQIYGPGLPQGHVLPALLSREAVLSTLSDAKGK

SEQ ID NO: 9194 - protein, 260 aa, Enterobacter cloacae
SEAATRLFYWEKRMAIALVTGASRGIGKATALQLASEGYTVAVNFHHNIKAATEVINQIVDAGGKAFAVRADISDEAQVMAMFASLDREGEPLAALVNNAGILFEQSTIENLSAERINRVLATNVTGYFLCCREAVKRMSHKHGGKGGAIVNVSSAASRLGAPGEYVDYAASKGAVDSLTTGLALEVAAHGIRVNCVRPGLIYTDIHASGGEPGRVDRVKSMLPMQRGGQPEEVAQAIAWLLSDKASYVTGSFLELAGGK

SEQ ID NO: 9195 - protein, 228 aa, Enterobacter cloacae
SSFVFPELSMVSRPLIAQGYSLAEEVANSISHGIGLVFGIVGLVLLLVQAVDTNASAMAITSYSLYGGSMILLFLASTLYHAIPHQRAKIWLKKFDHCAIYLLIAGTYTPFLLVGLNSPLSRGLMIVIWSLALLGILFKLTIAHRFKVLSLVTYLTMGWLSLIVVYQLAIKLAVGGVTLLAVGGVVYSLGVIFYVCKRIPYNHAIWHGFVLGGSVCHFLAIYLYVGQV

SEQ ID NO: 9196 - protein, 290 aa, Enterobacter cloacae
TTALIYAWCRCCLDTAIFQRRKYTPMSRRNACGSYTNSTTLARECRRIVTGTYMKKSLALFTLLAASVSGFAHADDAAIKQSLTKLGVASSEIQPAPVAGMKTVLTNSGVLYVTEDGKHIIQGPMYDVSGAQPVNVTNQLLMKNLNALEKEMIVYKAAQEKHVITVFTDITCGYCHKLHEEMKDYNALGITVRYLAFPRAGVQSQPEQDMKAIWCAKDRNKAFDDAMNGKGVKPASCDIDIANHYALGVQFGVSGTPAIVLSNGYVVPGYQGPKEMKAFLDEHQKQMGGK

SEQ ID NO: 9197 - protein, 358 aa, Enterobacter cloacae
KTAFRTSRSALTFLGGIFDYDAKKERLEEVNAELEQPDVWNEPERAQALGKERSSLEAIVDTLDQMAQGLEDVSGLLELAVEADDEETFNEAVAELDVLEEKLAQLEFRRMFSGEYDSADCYLDIQAGSGGTEAQDWASMLMRMYLRWAEARGFKTEIIEESEGEVAGIKSVTIKIIGDYAYGWLRTETGVHRLVRKSPFDSGGRRHTSFSSAFVYPEVDEDIDIDINPADLRIDVYRASGAGGQHVNRTESAVRITHIPTGLVTQCQNDRSQHKNKDQAMKQMKAKLYELEMQKKNAEKQAMEDNKSDIGWGSQIRSYVLDDSRIKDLRTGVETRNTQAVLDGSLDQFIEASLKAGL

SEQ ID NO: 9198 - protein, 508 aa, Enterobacter cloacae
GTNMSEQQAQGADAVVDLNNELKTRREKLAALREQGVPFPNDFRRDHTSDQLHADFDGKENEELEALNVEVSVAGRMMTRRIMGKASFVTLQDVGGRIQLYVSRDDLPEGIYNEQFKKWDLGDILGAKGKLFKTKTGELSIHCTELRLLTKALRPLPDKFHGLQDQEARYRQRYLDLISNDESRKTFKIRSQIMAGIRQFMVNRDFMEVETPMMQVIPGGASARPFITHHNALDLDMYLRIAPELYLKRLVVGGFDRVFEINRNFRNEGISVRHNPEFTMMELYMAYADYKDLIELTESLFRTLAQDILGTTQVPYGEEVFDFGKPFEKLTMREAIKKYRPETNMADLDNFDSAKAIAESIGIKVEKSWGLGRIVTEIFEEVAEAHLIQPTFITEYPAEVSPLARRNDENPEITDRFEFFIGGREIGNGFSELNDAEDQAQRFQDQVNAKAAGDDEAMFFDEDYVTALEHGLPPTAGLGIGIDRMVMLFTNSHTIRDVILFPAMRPVK

SEQ ID NO: 9199 - protein, 211 aa, Enterobacter cloacae
LYQVNGIFMKKTVIALIVANVFTATSAFAAADAGTWYSGAKFGWSHYFDTNMGSKAFENTHSDHFDFDHDNVSGGVYTGYQITPWLAVEGGYDYLGNMQIKGQHGAGAQMKTQGLQLSLKASYALTNDWDIYGRTGAMGYRAESDVSGHNRFETGVRPLAAVGTEYAFNKNWAGRLEYQWVSNVGNVNQIGVSSDLSSVTAGLSYRFGQYD

SEQ ID NO: 9200 - protein, 344 aa, Enterobacter cloacae
SKYSPAGITSETRGKAMAVIVITGGTAGVGKATALHFAKAGYDVGIIARDEQSLRSTEEELCRFGINACAVQADVADSKAVTDAANEIEYRLGAIDVWVNNAMGGMLAPFRTMSPEEFRRVTEVTYLGYVNGTRAALELMTPRDRGTIIQVGSALAYRSIPLQSAYCGAKAAIRGFTDAVRTELMHENSRVQIAMVQMPGLNTPQFEWARNKFSWAMRPVPPVFQPEVAASAIFKVAQKPVRELWVGSSTVQSIVGQFLFPGFLDRLMVKKAWEGQMTDTLNADDRQDYLDQPVNDLHKIHGHFTDEAKERATSVTSGMPGKVLLGSLAVTGAIVARLMLSRRR

SEQ ID NO: 9201 - protein, 98 aa, Enterobacter cloacae
RGQADRLRVCFFCHHNNYRGNIMDQELLDAGYRAYTGEKIDVYFNTGICKHSGNCVRGSAALFDLKRKPWIAPDEVDAETVVRVIDTCPSGALKYRQK

SEQ ID NO: 9202 - protein, 93 aa, Enterobacter cloacae
CRKQNMDINNKARIHWACRRGMRELDISIMPFFEYEYDSLSDDDKRLFVRLLESDDPDLFNWLMNHGKPADTELQRMVQLIQTRNQERGPVAI

SEQ ID NO: 9203 - protein, 256 aa, Enterobacter cloacae
CAIHADRGAVLFAGSLTRNPIIAVFCLTLTLLVAGCSGSKSSDMGSYSGAVYTVKRGDTLYRISRATGTSVKELARLNNISPPYTIEVGQKLKVNGGSSSGKKSSTRKTAKVTPSYQVPKSSWPPVGQRCWIWPASGKVVAPYSLSEGGNKGIDIAAARGTPVYASGAGKVVYVGNQLRGYGNLIMIKHGEDYITAYAHNDTMLVNNGQNVKAGQKIATMGSTGTDTVKLHFQIRYKATAIDPQRYLPAQGSKPKC

SEQ ID NO: 9204 - protein, 233 aa, Enterobacter cloacae
RQCKRNHEERNMAATNGMIDTDDAVILLIDHQSGLFNTVRDVPVPDLRNYVTAIAKVATLLNIPVITTASVPDGPNGPLIPEIHKYAPHAVYVPRTGQINTWDNPAFVKEVEKTGRKTLIIAGTLTSVCMAFPAVSAVHEGYKVYCVVDASGNWSKIATDTTIARVAQAGAIPTDTFAIVAELMRTWNREEGSRFAEILAEHVCPEYKCLIESFGKAQEIARTGPETNLEHYK

SEQ ID NO: 9205 - protein, 151 aa, Enterobacter cloacae
ESNMDMVFRALAIYLFLVIVFKVAGRRALLQMTSFDLILLLIISEATQQALLGEDFSITGAMITITTLVVVDIIFGLLKKYFSTVENILDGTPVILVENGVPLADKLKKVDVSCDDILVSARQNHGITELKEIKYAILERNGHISIIPDEN

SEQ ID NO: 9206 - protein, 92 aa, Enterobacter cloacae
GTMEILEGHNKFYVNDAEGNQVAEIVFVPTGEHLSIIEHTDVDPSLKGQGVGKQLVAKVVEKMRGENRKIIPLCPFAKHEFDNTREYDDIRA

SEQ ID NO: 9207 - protein, 985 aa, Enterobacter cloacae
SLGCAASGGLREGRGRNHIHCTFQEPSLMTQTLSQLENRGAFIERHIGPDAQQRQEMLKTVGADSLNALIGQIVPKDIQLATPPQVGESTTEFAALAELKAIAGLNKRYKSYIGMGYTNVQLPPVILRNMLENPGWYTAYTPYQPEVSQGRLEALLNFQQVTLDLTGMDIASASLLDEATAAAEAMAMAKRVSKLKNANRFFVAADVHPQTLDVVRTRAETFGFEVIVDDAEKVLDHQDVFGVLLQQVGTTGEVHDYGALIAELKSRKIIVSVAADFMALVLLTAPGKQGADIVFGSAQRFGVPMGYGGPHAAFFGAKDEFKRSMPGRIIGVSKDAAGNTALRMAMQTREQHIRREKANSNICTSQVLLANIASLYAVFHGPAGLKRIASRIHRLADILACGLQQKGLRLRHEHYFDTLCVEVADKAAVLARAEAAQINLRSDIHNAVGITLDESTTRDDILTLFNVLLGDAHGLDVDTLDKEVALDSRSIQESMLRDDAILTHPVFNRYHSETEMMRYMHSLERKDLALNQAMIPLGSCTMKLNAAAEMIPITWPEFSELHPFCPAEQAEGYHMMINQLSDWLVKLTGYDALCMQPNSGAQGEYAGLLAIRHYHESRNEGHRDICLIPSSAHGTNPASAQMAGMEVVVVACDKNGNIDLADLRAKAEQAGDKLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIATRLKDAYPVLYTGRDGRVAHECILDIRPLKEETGISELDIAKRLIDYGFHAPTMSFPVAGTLMVEPTESESKVELDRFIDAMLAIRSEIDRVKGGEWTLEDNPLVNAPHTQNELVAEWNHGYTRELAVFPAGVANKYWPTVKRLDDVYGDRNLFCSCVPMSEYQ

SEQ ID NO: 9208 - protein, 143 aa, Enterobacter cloacae
FKHGIRNVVLWQSDLRVSWRSQWMSLLLHGLVAAMVLLVPWPLSYTPLWLLLLSFVVFDSVRSQRRINARQGEIKLLMDSRLRWQGKEWEMMGTPWMLNTGMMLRLRRVEDNRRQHLWLAADSMDPAEWRDLRRLIVQQPTQE

SEQ ID NO: 9209 - protein, 308 aa, Enterobacter cloacae
WPDCRTKGADVEKDLALIEQFLDALWLEKNLAENTLSAYRRDLTLLVEWLAHRGLTLESAQSDDLQGLLAERMEGGYKATSSARLLSAMRRLFQHLYREKIRADDPSALLASPKLPQRLPKDLSEAQVERLLQSPAVDLPLELRDKAMLELLYATGLRVSELVGLTMSDISLRQGVVRVIGKGNKERLVPLGEEAVYWLETYLEHGRPWLLNGVSIDVLFPSQRAQQMTRQTFWHRIKHYATLAGIDSEKLSPHVLRHAFATHLLNHGADLRVVQMLLGHSDLSTTQIYTHVATERLRQLHQQHHPRA

SEQ ID NO: 9210 - protein, 580 aa, Enterobacter cloacae
IIRVKAPIKLRRRDAGETADLPDTLPLLLKRLYASRGVRTASDLERSVKGMLPWQALSGIEQASEMLYDAFREGTRIVVVGDFDADGATSTALSVLSLRALGCDNVTYLVPNRFEDGYGLSPEVVDQAHARGAQMIMTVDNGISSHAGVDHAHALGIPVLVTDHHLPGETLPAAEAIINPNLRDCDFPSKSLAGVGVAFYLMLALRTLLRDKGWFESRGIAVPNLAEYLDLVALGTVADVVPLDTNNRILTWQGLSRIRAGKCRPGIKALLEIANRDPLKLAASDLGFALGPRLNAAGRLDDMSVGVALLLCDNIGEARVLASELDALNQTRKEIEQGMQAEALTLCEKLERSGDTLPGGLAMYHPEWHQGVVGILASRIKERFHRPVIAFAPAGDGTLKGSGRSIQGLHMRDALERLDTLHPNLMIKFGGHAMAAGLSLEEAKFDEFQRLFGELVTEWIDPALLQGEVVSDGELSPAEMTMEVAQMLRDAGPWGQMFPEPLFDGRFRLLQQRIVGERHLKVMVESVGGGPLLDGIAFNVDTSIWPDNGVREVELAYKLDINEFRGNRSLQIIIDNIRPI

SEQ ID NO: 9211 - protein, 419 aa, Enterobacter cloacae
FKIKPSFFLRNQSPLLYLSANFLFPGPQMKTRLLLCAGVLAVSSAHASALYFYEAGTEDTALAGAGQAARAKDASTIMTNPAGMTRLPDHMVTGGLQVMDGSIDNQLDNDAHQSPGDVMKTIPNASAFYSQKINDDLYAGIGLYGNYGLGIDYGSWAGDRLIKKSTMVAMTLSPSLAYKLNDRLSIGASANVNYGYFSLTRSVNDDDYQRRDEDLAMSYRLGLLMQLTDQTRAGITWNSETDYSFNIDGNARLQNGTYDLPLSAQISAPQQIMLSLVHDINPRWSVMGDLGWQDWSQFGAPQIVVGDQQLNNVSRLKDTWHGAVGVQYRPTPQWRLNAGVAFDSSPYESQSDVALTLPTGDEWRFGTGAQYQITPASNIGIAVSYLHMQSSHVKSPVAFAGSYDHPYLWFASVNYSYQF

SEQ ID NO: 9212 - protein, 215 aa, Enterobacter cloacae
MSEGCTMHILPPVRPEKSIERLTAILEPIAEKVHVVPRKRLTWLRKGKQQMYLFLEGELSLLRASDGLVVVTVYEPHLFGIAEMIQPTQGHLLRAERESTILRLDADKAAELFRAEGVWEDVAALLSYHTAYLIFRDAQVLQQRTYSVIRNHLQEMILLPEETRLRTTILEYIQDRTLLSRSSILNVLSALKQGEYISFKRGGYLLEVRHLPESF

SEQ ID NO: 9213 - protein, 677 aa, Enterobacter cloacae
PPFPPCTASVNITPRGSMKFKTLVSAMAVAGLLLVSLTSLPVLAQKEGKGATAHTKEMNDALYGQLPFFDKTDFRNAHKGFIASLPPAVIKDEKGAVIWNPQKYAFIKEGQKAPDTVNPSLWRQAQLNNIGGLFEVTEGIYQIRNLDLSNMTIIEGKEGITVIDPLLSAETAKAGMDLYVQHRGKRPVVAVIYTHSHVDHYGGVRGVVDEAGVMTGKVKVYAPAGFMEEAVSENIMAGNAISRRASYIYGNLLKANVKGQIGAGLGTTTSAGTVTLIAPTHAITKDGQKEIIDGLTYDFMLAPGSEAPSEMLWYVEEKKLIQAAENVTHTLHNTYSLRRAKIHDPLAWSKYINNALDRWGDKAEIIIAQHHWPTWGNKKVVKLMKSQRDIYRYINDQTLRLANKGLTRDEIAANFALPYGLAKSWAGRGYYGSVSNNVKATYVYYLGWFDGNPATLDELPPVEAAKKYVDYMGGARAILEKARVDYARGNYRWVAQVVSKVVFADPNNKAARELEADAFEQLGYHAESGPWRNAYLTGAQELRNGVKIKPTPKTASPDAVRAMSTEMIFDYFGVHLNGVRAANARGIFNVDLGREGGRYKLELENGVLNHSANIQAEDPDATITLSRETLNKIILKETTLKKAQQAGEVTIVGNAAKVDEMLRCMESFSFWFPVVTP

SEQ ID NO: 9214 - protein, 194 aa, Enterobacter cloacae
NTLFLSVMVIFLLFLTKIKGNAMSNLIHDSNSTISELTKKLATQLTDRGLRLTTAESCTGGNLAVALCAEENTAEFYDVGMVVFSDAAKERILGVRHETIERFTAVSEQTVTEMAAKIREIAEADIGLAISGYAGPEGGDDGTAAGTVCFGWNIRGQTETRTVLFSGECQDVVDKAVRYSLSELIEILSGWDNV

SEQ ID NO: 9215 - protein, 363 aa, Enterobacter cloacae
PPLTHRARLLHISEAKLPCSFFTATNSLQSSPLPANNNGDLMGTTKHSKLLILGSGPAGYTAAVYAARANLQPVLITGMEKGGQLTTTTEVENWPGDPNDLTGPLLMERMHEHAAKFETEILFDHINKVDLQNRPFRLTGDSGEYTCDALIIATGASARYLGLPSEEAFKGRGVSACATCDGFFYRNQKVAVIGGGNTAVEEALYLANIASEVHLIHRRDTFRAEKILIKRLMDKVASGNIVLHTNRTLEEVTGDQMGVAGLRIRDTQNTDNVETLEVAGLFVAIGHSPNTAIFEGQLELENGYIKVQSGIHGNATQTSVPGVFAAGDVMDHIYRQAITSAGTGCVAALDAERYLDGLAEQGK

SEQ ID NO: 9216 - protein, 598 aa, Enterobacter cloacae
FLITSPAKYAMEKTRQQELTRWLKQQSVLSRRWLMISRVLGFISGLLIVAQAWLLARILNHMIMENIPREALLLPFIVLVLVFVLRAWVVWLRERVGFHAGQHIRYEIRRKVLDRLSEAGPAWIQGKPAGSWATLILEQIDDMHDYYARYLPQMALAVFVPLMIVIAIFPVNWVAALILLGTAPLIPLFMAMVGMGAADANRRNFLALGRLSGHFLDRLRGMETLRIFGRGEAETENIRLASQDFRQRTMEVLRMAFLSSGVLEFFTSLSIALVAVYFGFSYLGALDFGHYGTAVTLSAGFLALILAPEFFQPLRDLGTFYHAKAQAVGAADSLKTFMETPLAHPERGEVTLNTNDPVTIEAQDFSVLSPEGKVLAGPLNFTLPAGQRVVLVGTSGSGKSSLLNALSGFMAYTGSLRINKTELRELDPDAWRKQLSWVGQNPQLPAPTLRENVLLARPDARDDELQSVLDRAWVSEFLPLLAQGIDTVIGDQSAGLSVGQAQRVAVARALLNPSSLMLLDEPAASLDAHSEQRVMDALNAASRQQTTLMVTHQLEGIADWDQIWVMENGHIVEQGDYAALVAAQGPFATLLANRQEDI

SEQ ID NO: 9217 - protein, 272 aa, Enterobacter cloacae
IYLSGEGMLMVSKYWLFESSSLYGDITRAQEWARTFIIEVVMFRKLAAECFGTFWLVFGGCGSAVLAAAFPELGIGFVGVALAFGLTVLTMAFAVGHISGGHFNPAVTLGLWAGGRFPAKDIIGYIIAQVIGGIIAAAVLYVIASGKAGFDAAASGFASNGFGEHSPGGYSMLSAIVIEIVLTAGFLLVIHGATDKYAPAGFAPIAIGLALTLIHLISIPVTNTSVNPARSTAVAIFQGGWALEQLWLFWVMPIIGGILGGVLYRTLLEKRD

SEQ ID NO: 9218 - protein, 313 aa, Enterobacter cloacae
CLWRLTDTQKDRLFMFSGLLIILLPLIAGYLIPLRHESALKLINRFLSWIVYVILFFMGISLAFLDNLATNLLSILHYSAVTVVVILLCNIAALFWLERTIPWKNHHHQEKLPSRIAMALESLKLCGVVVLGFLLGLTGWAFLQHATEASEYTLIFLLFLIGIQLRNNGMTLKQIVLNRRGMMVAVIVVASSLAGGVINAFILDLPLKTSLAMASGFGWYSLSGILLTESFGPVIGSAAFFNDLARELLAIMLIPGLVSRSRSTALGLCGATSMDFTLPVLQRSGGLEMVPAAIVHGFILSLLVPILMAFFSA

SEQ ID NO: 9219 - protein, 558 aa, Enterobacter cloacae
NITLTGVIMFCVQCEQTIRTPAGNGCSYAQGMCGKTAETSDLQDLLIAALQGLSAWAFKAREYGIVDHYVDSFAPRAFFSTLTNVNFDSPRIVGYAREAIALREALKAQCLNADASARVDNPMAELQLVSDDLGELQRQAAEFTPNKDKAAIGENILGLRLLCLYGLKGAAAYMEHAHVLGQYDNAIYAQYHKIMAWLGTWPSDMNALLECSMEIGQMNFKVMSILDAGETSTYGHPTPTQVNVKATEGKCILISGHDLKDLYNLLKQTEGTGVNVYTHGEMLPAHGYPELRKFKHLIGNYGSGWQNQQVEFARFPGPIVMTSNCIIDPTVGAYDDRIWTRSIVGWPGVSHLEGDDFGPVIAQAQQMAGFPYSEIPHLITVGFGRETLLGAADSLIDLVSREKLRHIFLIGGCDGARGERNYFTDFATRVPEDCLILTLACGKYRFNKLDFGNIEGLPRLVDAGQCNDAYSAIILAVTLAEKLGCGVNDLPLSLVLSWFEQKAIVILLTLLSLGVTNIVTGPTAPGFLTPDLLAILNEKFGLRSVTNVEDDMKQLLSA

SEQ ID NO: 9220 - protein, 247 aa, Enterobacter cloacae
VKTAPMSIKLNGINWFYGAHQALFDITLSCPEGETLVLLGPSGAGKSSLLRVLNLLEMPRSGTLAIAGNHFDFAKTPSDKAIRELRQNVGMVFQQYNLWPHLTVVQNLIEAPCRVLGLSKDQAMARAEKLLERLRLKPYSDRYPLHLSGGQQQRVAIARALMMEPAVLLFDEPTAALDPEITAQIVSIIRELAETNITQVIVTHEVEVARKTASRVVYMENGYIVEQGDASCFTNPQTDAFKNYLSH

SEQ ID NO: 9221 - protein, 249 aa, Enterobacter cloacae
CVREIIMKKVLIAALLASVSLSATAAQTIRFATEASYPPFESIDANNKIVGFDVDLANALCKEIDATCTFSNQAFDSLIPSLKFRRIDAVMAGMDITPEREKQVLFTTPYYDNSALFIGQKGKYASVDLLKGKKVGVQNGTTHQKFIMDKHPEITTVPYDSYQNAKLDLQNGRIDAVFGDTAVVTEWLKANDKLAAVGDKVTDKDYFGTGLGIAVRQGNTELQQKFNAALEKVKKDGTYETIYKKWFQK

SEQ ID NO: 9222 - protein, 227 aa, Enterobacter cloacae
  UNSURE (5)
  UNSURE (23)
  UNSURE (73)
TETRXMWDYLPELMKGLHTSLTXTVASIIVALILALIFTFVLTLKTPVLVWIVRGYITLFTGTPLLVQIFLIXYGPGQFPSLQEYPVIWHLLSEPWLCALIALSMNSAAYTTQLFYGAIRAIPEGQWQSCGALGMSKKDTLAILLPYAFKRALSSYSNEVVLVFKSTSLAYTITLMEVMGHGQLLYGRTYDVMVFGAAGLVYLVVNGLLTLMMRLIERKALAFERRN

SEQ ID NO: 9223 - protein, 72 aa, Enterobacter cloacae
MAKEDNIEMQGTVLDTLPNTMFRVELENGHVVTAHISGKMRKNYIRILTGDKVTVELTPYDLSKGRIVFRSR

SEQ ID NO: 9224 - protein, 95 aa, Enterobacter cloacae
TAPTPPPVHSILIYKIYEGCRSMEMGTVKWFNNAKGFGFICPEGGGEDIFAHYSTIQMDGYRTLKAGQSVRFDVHQGPKGNHASLIVPVEAETVA

SEQ ID NO: 9225 - protein, 329 aa, Enterobacter cloacae
NSDIPPEAGSNMSSIVDTPYSTLPQPKSGWQLFKSLTSGSLTPGLAWQNPAYRRKFMLRSLATPFTTARLLGNLAKQPRLMQILRVQPGLPCRLHRPWLTVNMGRQNTLDALNDHYQMMSRHLPASLLNGYLSSQGITLVTLTGKEEQQFSVRLSADAFLDKEGEATLTFCDHQNTVLAELTFTLCKYQGKSTLFIGGMQGAKAHVPHEHIQLATKACHGLFPKRLLVEAVMTLAGAFPVEQILAVSNATHIYRSWRYRKKKEGKLLADYDSFWRSLGGQQQDNGNFALPLTMPRKPMEEIASKKRSEYRRRYTLLDSLIQQVSQATDR

SEQ ID NO: 9226 - protein, 323 aa, Enterobacter cloacae
LMTMPTSQCPWRMQVHHIHQETPDVWTLSLLCHDYYPYRPGQYALVSVRNSANTLRAYTLSSTPGVSEYITLTVRRIDDGAGSEWLTRDVKRGDYIWLSDAQGEFTCDDKTEDKFLLLAAGCGVTPIMSMRRWLAKYRPQADVQVIFSVRSPEDVIFAEEWRNYPVTLVAEHNATHGFVAGRLSRELLQSVPDIANRTVMTCGPAPYMEIVEKEVKALGVTRFFKEQFFTPVAAAATSGMKFTKLQPAQTFFGRVGTTLLEALESNNVPVAAACRAGVCGCCKTKVVSGEYTVTSTMTLTDAEIAEGYVLACSCHPQGDLVLA

SEQ ID NO: 9227 - protein, 336 aa, Enterobacter cloacae
GHAMIDLRSDTVTRPSRAMLEEMMAAPVGDDVYGDDPTVNELQRYAAELSGKEAALFLPTGTQANLVALLSHCERGEEYIVGQGAHNYLYEAGGAAVLGSIQPQPIDAAPDGTLPLDKVAAKIKADDIHFARTKLLSLENTHNGKVLPREYLKAAWDFTRERKLGLHVDGARIFNAVVEYGCELKAITQYCDSFTICLSKGLGTPVGSLLVGSADYIRRANRWRKMTGGGMRQAGILAAAGLYALKNNVSRLKDDHDNAAWMAAQLREIGADVMRHDTNMLFVRVGDEHAAALGDFMKARGVLINASPVVRLVMHLDVNREQLTEVVKHWQAFLQR

SEQ ID NO: 9228 - protein, 369 aa, Enterobacter cloacae
LNKTLNLSPFPLQHIVIHERMRTKFFSTQWIVMKVLVTGATSGLGRNAVEFLRNKGISVRATGRNEAMGKLLQKMGAEFVHADLTELVSSQAKVMLAGIDTLWHCSSFTSPWGTQEAFDLANVRATRRLGEWAVAWGVRNFIHISSPSLYFDYHHHRDIQEDFRPARFACEFARSKAAGEEVIDLLAQSNPHTRFTVLRPQSLFGPHDKVFIPRLAQMMHHYGSVLLPRGGDALVDMTYYENAVHAMWLASQPECDKLVSGRAYNITNGEPCTLRSIVQRLIDELKIDCRIRSVPYPMLDMIARSMERFGSKSAKEPALTHYGVSKLNFDFTLDISRAENELGYKPIVSLDEGIVRTAAWLRDHGKLHR

SEQ ID NO: 9229 - protein, 231 aa, Enterobacter cloacae
QAPPGMNVGLAVCALIIGLVLAMFFAVWESVKWRPVAWLGSALVTVLRGLPEILVFLFIYFGSSQLLLTLSDGFTINLGFAQIPVQMQIENFDVSPFLCGVIALSLLYSAYASQTLRGALKAVPQGQWESGQALGLSKAAIFFRLVMPQMWRHALPGLGNQWLVLLKDTALVSLISVNDLMLQTKSIATRTQEPFTWYIVAAAIYLVITLLSQYVLKRIDLRATRFERRPG

SEQ ID NO: 9230 - protein, 591 aa, Enterobacter cloacae
ARRLRRACCRAGAVCDPAGEPSGGYLMRALLPYLALYKRHKWMLTLGIVLAIVTLLASIGLLTLSGWFLSASAAAGFAGLYSFNYMLPAAGVRGTAITRTAGRYFERLVSHDATFRVLQHLRIYTFSKLLPLSPAGLARFRQGELLNRVVADVDTLDHLYLRVISPMVGAFVVIVVVTLGLSFLDVPIALTLGGIMLMTLIILPPLFYRAGKTTGENLTRLRGEYRQQLTAWLQGQAELTLFGASKRYRARMENTELNWHEAQRRQSELTAFSQALMMLIGGIAVIAMLWMASGGVGDNAQPGPLIALFVFCALAAFEALAPVTGAFQHLGQVIASALRITDIAEQEPEVKFSAGQTAVPEQVALTLSNVTFAYDKPAQNALEDITLSVDAGQRIAILGRTGCGKSTLLQLLTRAWDPQQGEIRFNDVPLSGFSEAALRKTVSVVPQRVHLFSATLRDNLLLAAPDASDDTLRAMLEHVGLHKLLEDDGLNSWLGEGGRQLSGGELRRLAIARALLHDAPLMLLDEPTEGLDATTESQILDLLANVMKGKTVLMVTHRLRGLVNFDQIIVMDNGHIIEQGIKQELLAKQGR

SEQ ID NO: 9231 - protein, 249 aa, Enterobacter cloacae
TIFVASSLAYWSSVVMRLVQLSRHNIAFPSPEGALREPNGLLALGGDLSPARLLMAYQRGIFPWFSPGDPILWWSPDPRAVLWPGQFHLSRSMKRFHAKSPFRVTLNHAFGQVIEGCAEDRHEGTWITRDIIIAYHQLHELGYAHSIEVWKEDNLVGGMYGVAQGTLFCGESMFSRATNASKTALLVFSEEFARRGGRLMDCQVLNEHTASLGAVEISRRHYIEHLEQCRKETLPRDFWVPRALFMPNA

SEQ ID NO: 9232 - protein, 577 aa, Enterobacter cloacae
RRRTTMKQTVAAYIAKTLEQAGVKRIWGVTGDSLNGLSDSLNKMKTIEWMPTRHEEVAAFAAGAEAQLTGELAVCAGSCGPGNLHLINGLFDCHRNHVPVLAIAAHIPSSEIGSGYFQETHPQELFRECSHYCELVSSPEQIPQVLAIAMRKAILNRGVSVVVLPGDVALKAAPETATTHWYSAPQPTITPAEEELKKLAQLLRYSSNIALMCGSGCAGAHKELVEFAGKLKAPVVHALRGKEHVEYDNPYDVGMTGLIGFSSGFHTMMNADTLILLGTQFPYRAFYPTDAKIIQIDINPGSIGAHSKVDMALIGDIKSTLAALLPLLEEKTDRKFLDKALSDYRDARKGLDDLAKPSEKAIHPQYLAQQISHFADGDAIFTCDVGTPTVWAARYLKMNGKRRLLGSFNHGSMANAMPQALGAKATAPERQVVAMCGDGGFSMLMGDFLSVAQMKLPLKIVVFNNSVLGFVAMEMKAGGYLTDGTELHDTNFARIAEACGITGIRVEKASEVDDALQRAFAIDGPVLVDVVVAKEELAIPPQIKLEQAKGFSLYMLRAIISGRGDEVIELAKTNWLR

SEQ ID NO: 9233 - protein, 491 aa, Enterobacter cloacae
NTGRRFYSVKEHTVPQRILVLGASGYIGQHLTTALSQQGHQVLAAARNTERLQKLHLPGVTCHNVDLNWPKALPALLEGVDTLYYLVHSMGEGGDFIAHERQVAMNVRDALRQTPVKQVIFLSSLQAPENEQSDHLRARQLTAETLRSARIPVTELRAGIIVGAGSAAFEVMRDMVYNLPVLTPPRWVRSRTTPIALENLLHYLVALLDHPAEQHRVLEAAGPEVLSYQAQFEHFMRVSGRRRWLIPIPFPTRWISVWFLNVITSVPPTTAKALIQGLKHDLLADDRALRALIPQELIRFDDAVRNTLKEEEKLVNSSDWGYDAQAFARWRPEYGYYPKQAGCTVKTTASLAALWEVVNQIGGKERYFFGNILWQTRGALDLLVGHRLAKGRPAHPWLKVGDTVDSWKVIIVEPEKQLALLFGMKAPGLGRLCFTLKDKGDHRELDVRAWWHPHGMPGLFYWLLMIPAHLFIFRGMAKRIALLAEEKRENN

SEQ ID NO: 9234 - protein, 605 aa, Enterobacter cloacae
PLRGITLLSAAVAIPNQRRSVVMYQSHFNFKNPPFRTITRLSGDFLVPYHQDVFNLLKEKTQLAGIIGLFCDDAPLLSHFIDALKASSNTVIAINAFPKLSASSLLYKLNPGTKAIKDRMQAVDAVLRQWQEGKAKSRVLTIAHSEAMKESCREVLGTLLTRAQELNFRLAVVLTGAAEQERLLKQPELREYTHTHHVLRPLTCREYLSYVQAQCEEHDCEHSPLPPARVRKMHTLTKGNISKLNALAHLSMLAAWTERAAQVSPRHLRLAAGEILPAKKHGKRLATVGLFASVLFAACGWYFTSSIGARLPIQLPVPVSWKQQTPKPEAAVVPVIDNEIVNQPDAMHQLYLMWGYDASADDALCQNAAKVNLMCKQGNASPETLAQEGYPWVSELKTSGHLNYAVVARVGDTSIDLLMNNRTWQVSRSWFNRHATGNFTQLHRLTPEGKDAIGTASDSKDMAWLDQQLSIALSQPETHARIWTAEMMKRTREFQQKMHLHVDGIPGEETLMQLMRVTNSTPGVLIQATRTTPDAKMQEEDSLMSTICLAAQRSYTTGESVWFSYRLPSLEKRIRQNSVMAGRPLRHAGCRPVYARLLEPAPPGT

SEQ ID NO: 9235 - protein, 179 aa, Enterobacter cloacae
LINKEINMRYSALTLLVPCALVLSACTTPVTPAFKDIGTRSGPCIEGGPDAVAQQFYDYRIQHRGNDLTALRPYLSDNLAKLLTDASRDPQHNALLSSDPFSSRATLPDSADVASASTIPNTDARNIPLRVKLTQGTQTWQDEVLMIREGQCWAVDDVRYIGGSVHAPAGTLRQSIENR

SEQ ID NO: 9236 - protein, 224 aa, Enterobacter cloacae
MPRPSYFKKSHLKSGITMLSIYGKKLRPQYEMERIISATAGVEEKTLKKWQKISTTDSGYIHVIVSGEVEFRRESDELCMFTVTGQCLFGLSSMYYNATHMYGLVRTNTVVRSIKKEVFAQLMTEKNLWPDLTKVLSWYICVMSKRDDVLVARSAYSVVREFLYEINDLTVHQQRDINVYDYIQEYTNLARSTIIKILSDLKKGQYIVVEKGRLLNLTALPEKY

SEQ ID NO: 9237 - protein, 430 aa, Enterobacter cloacae
KRAAEGDRRRDVSGRSHARHRRAWGGCIMAFYAWTATDAAGKTQRGTLQAEGQKQVRQWLREQKLMPVSITETRETAAGGKAKTGVKLSTPVLSMFTRQLSTLVNAALPLESALKAISKQTEDKKLAAMVVEIREKVVEGHTLFDAFSQFPRTFDKLYCTLVMAGEKTGHLGDVLEKLAEYNEQRQKMKSKLTQAMVYPITLTVVAIAVISILLVAVVPQVIEQFTHMKQQLPITTRTLIAVSDFLQAWGIYIVGILGGGFIGFKTWLRNAKNRFRWHSWLVNGSPIKKLVCAINSARYIRTLSILQASSVPLLEGMYIAMDGIENRYARQVLEQAADTVRQGASLYAALEQAKLFPPTMLYMIASGEESGELGNLMDRAAENQESALQHRITLTLSVFEPALVVSMATIVLFIVLSILQPLLQLNNMVG

SEQ ID NO: 9238 - protein, 150 aa, Enterobacter cloacae
IMALKRKNLARQAGFTLLELMVVIVILGVLASMVVPNLMGNKEKADTQKATSDIVALEGSLDMYKLDNHRYPTTEQGLQALVTKPEIAPIPNGYRTDGYIRRLPQDPWGNDYLLVSPGEHGAVDVFSAGPDGEANTADDITNWSLDKKEK

SEQ ID NO: 9239 - protein, 128 aa, Enterobacter cloacae
KTMANGNKKQKGMTLLEVMVALVIFSTAALALMNSVSLNVRFTHGLADTLQASWVAENQLAEAQLTKTDFPDAEQQGTEIMGGRRWNWRKQRVKTADNVWANTIRVYAEGDESQPVISLHIIPPGESK

SEQ ID NO: 9240 - protein, 161 aa, Enterobacter cloacae
MKERIAQLKARYQNYSAREKIILKICAVAIVGAAVYYTGVIPLDNMIKNSKSTLKRQKETLNWMRSEIDKNHLQIQLVKTDNPRTVVENSAHEINLSLTDVRQEGQTLSFVVNRVNVYELKSWLREINQTTGVRLQKINLTPVDHLSDVKAQVQLTWAKNA

SEQ ID NO: 9241 - protein, 906 aa, Enterobacter cloacae
IYQEIKMKFMKPKYLALFIAAATSSAFAAAPGAPTIGYGNDKFALVEVDQAAQDYNNLVKVHNDGVDVKVEWNVWSGDAPTSAKVLLDGQTVWTGAAGATGSATFKVKKGGRYQEQVEVCNASGCAKSASKLIIVADTDGSHLLPLNTSLQENNKAFAKHTDKVVAAYFPEWGVYDRNFPVDKIPAANLNHILYGFIPICGGDGINDGLKTIEGGNSFRVLQNDCKGRPDFTVAIHDPWAALQKPQAGVSNWDDPYKGNFGQLMALKKAHPGLKVLPSIGGWTLSDPFFHMGDPAIRARFVSSVKDFLQTWKFFDGVDIDWEFPGGGGVTENLGNPQQDKATYTALMHDLRTMLNELSAQTGRTYELTSAIGAGRDKIEDVDYTTAQQYLDHIFLMSYDFYGGWSNTVLGHQAALRAPAWRPDTDYTTENGVNALLAQGVQPGKIVVGAGMYGRGWTGVHGYTGDNPFTGTATGMVKGTWEPGVVDYRQIVNEYKGKPGWEYGYDTTAEAPYVFNKSTGDLISYEDARSTTAKGKYVLANKLGGLFAWSIDSDTGDILNAMNESLLGGDSTPVDPVVTNHAPIASSADQNVSGPATVTLDGSASSDPDGDAITYKWTQVSGPSVTINNSTKAKATFNVAAATTDQTMTFRLTVTDAKGLSNAIDVQVVNKAPKANQAPVLNPMEAITLESGETYALHAQAADPDGDALTYAWSVPADMHATGTDSANVNITAPEVSSTSTYTLSVVVSDGKTSVQSNVQVTVNPKAAPAPVPADEDTNPVDDVTPPADDVTPPSDKGSCDAPVDANASKYAAWESSKIYNGGDTVSFDHLVWKAKYWTQGNQPGFGVDAWELVSNVKMNWRSDLVYNGGDTTTYEGNVYRAKWWTRGDNPANSDVWVKEGASTDCK

SEQ ID NO: 9242 - protein, 562 aa, Enterobacter cloacae
RKKWPNCGGCMLLERVEIVGFRGINRLSLQLEQNNVLIGENAWGKSSLLDALTLLLSPEENLYHFVHDDFWFPPGDVNGREKHLHIILTFRESEPGRHRVRRFRPMSACWVPCEDGFQRIFYRLEGEMAQNDGVLTLREFLDEKGNPIPLDNIDELARHLIRLSPVLRLRDARFMRRIRNGTVPNMPEVEVTARELDFLARELVSRPQNLTDGQIRQGLSAMVQLLEHYFSEQGTGQARHRLMRRRSHDEQRSWRYLDIINRMIDRPGGRTHRVILLGLFSTLLQAKGTVRLDRDARPLLLVEDPETRLHPIMLSVAWHLLNLLPLQRVTTTNSGELLSLTPVEYVCRLVRESSRVTAYRLGPGGLNAEDGRRIAFHIRFNRASSLFARCWLLVEGETETWVINELARQCGHHFDAEGIKVIEFAQSGLKPLIKFARRMGIEWHVLVDGDEAGKKYAATVRSLLNNDREEEREHLTALPAMDMEHFMYRQGFDDVFHRVAMIPVDVPMNMRRVIAKAIHRSSKPDLAIEVATEAGRRGVESVPTLLRKMFSRVLWLARGRAD

SEQ ID NO: 9243 - protein, 70 aa, Enterobacter cloacae
RVQALNSDVHRVQAGVGKEYRETIIMVDSKKRPGKDLDRIDRNILNELQKDGRISNLELSYLHSRGNTRW

SEQ ID NO: 9244 - protein, 302 aa, Enterobacter cloacae
YRLRNGRERCQHADGERKRYGGENPSMKRSLSTLLLAILLAGCASEEGIVDKGAYELDTRHQAQAAYPRIKVLVIHYTADDFDTSLATLTDKNVSSHYLIPAKPPAPQGKPRIWQLVPESELAWHAGISFWRGTNRINDTSVGIELENRGWRQTDGVKTFTPFEPGQIAALIPLARDIIARYDIKPQNVVAHSDIAPQRKDDPGPMFPWRELAQQGIGAWPDPARVNFYINGRPHYQQVDTAALLDLLARYGYEVPENSTPAQQKRIIIVFQMHFRPQLWNGVADVETMAIAEALLEKYGQG

SEQ ID NO: 9245 - protein, 258 aa, Enterobacter cloacae
KMRFSFLSRWITPCIMFVLLIFSGQQGYLTLKDYKKVTNKLAKADLQPPKKTREDKPFTLFTAAVRQENLADAAKAPLAAEIEGIVRSDDAWLSFAVIKTPGGQRSYREGEPLAGFNDAFIQEINKDNVVVNYEGATQVLALNKPDYFKGGVDSGPVTQSTKDAGAESLHLDDYLVLKPIIEKGRLEGYRINPRNASAFYSQSGLEKGDVAVQVNSVDMTDEAKAKSIIANWSKMKEADVVVRRHAHLENIRVNVLNN

SEQ ID NO: 9246 - protein, 499 aa, Enterobacter cloacae
RVRRRDTVDELSKSLCSSNYAKDNGVLLYNNDVYIREDTPALALLEVRRVLGRAFVPITLAPEAFDEMLAKIWQQSSGVSQQLVDDMDADIDLMALTEEIPDNEDLLDNDENSPVIRLINAILGEAVKDGASDIHIETFERTLSIRFRVDGVLRPVLQPARKLAPLLVSRIKVMSKLDIAEKRLPQDGRISLRIGRKAIDVRVSTIPSQYGERVVMRLLDKSNLKPDINKLGLIDEELEKLKGLIDRPHGIILVTGPTGSGKSTTLYAILSALNGHERNILTVEDPIEYELEGVGQTQVNPRVDMTFARGLRAILRQDPDVVMIGEIRDGETAQIAVQASLTGHLVMSTLHTNSAAGAITRLRDMGLESFLIGSSLLGVIAQRLVRRLCTHCRTTSPLDANEKALFSFMDAPPEAIYRAVGCEHCRQSGYQGRAGIHEFLVVDSAMRRAIHEDKDEMSLETQLFKQAYSLRENGLLKVIGGVTSLEEVMRVTAERGGDA

SEQ ID NO: 9247 - protein, 371 aa, Enterobacter cloacae
YAGGGRCRGARESRRRAWDAPGCSPCACPFAGDQTMKRIRQQQGVALLVVLILLVMMSALAAKISQQFCRNLQKTHYQVSQQQLRWAMQAQEKVVKDRLQTDASGESKPLALDGDWHQPLETQGEDYTVVSQVEDAQDCFNVNNLLTADIAPQGQSAPAVAETPRKARIVEQLLTESGLSPGTAEAVYFQLVDYLDGDSTTAKEGAESDAWAGVVPARQPANQMMRSIAEIKLLPAFPVTAYPKVSKLLCALPDAASKVDVNTLQPEQAAVLAAMFPGKLTQDDAVRLLDSRPESGWENMEAFSKALEQAFPQLKDDLQQVVDQFSINSRYFRVNYTGNTDELTLRVVSQLQVNNEAGEIVTWQRRYRMIE

SEQ ID NO: 9248 - protein, 379 aa, Enterobacter cloacae
NVMKQVLFVRPDSREGGKIMWCESGSERVEVVDSLEMLSEHPLATRVCLLLPASDMIFRHFRLPKKVASQGMAFSWMAEETLIGDVDNLHWTVLHKKGADVDAVAIDADRLRATLTRCQEAGLNVIQALPDAWLLPVTAGGSTLVAQDDGYWLRLSPHVAGEMEATLLPLLMQKAGVGEVWCYGDAPAKVHVDVQHAWQHPLALIQPQWQTCRVNLLHGEFSLKAGHGRAAKRMKAAMVAAGVLSVGLLLGPRIAMAWMLVQQENRVQQEIVQVYQHHFPSMRQQTNIKYHFGQSLKKQSKGFFLQLEELEKARQSVPAMEIDLLEYDAQQNTLTLSVSAQNQPALQAFVNQTSENFDFTLQPVSTTEPYTAMIAGKHK

SEQ ID NO: 9249 - protein, 614 aa, Enterobacter cloacae
FETNRKTEMNKRTLLSVLIAGACVAPFMAQAANLKETSSEPYTIKASDLAKKEKELTDFPLMASVKETIQTLDNAQVELIEPGRAANPDNVKRVEGIVKASDWEYLFPLRAQAYTYSNFLKAVGKFPALCKTYNDGRDSDAICRKELATMFAHFAQETGGHESWRPEAEWRQALVHVREMGWSEGQKGGYNGECNPDVWQGQTWPCGKDKDGDFLSYFGRGAKQLSYNYNYGPFSEAMYGDVRTLLDKPELVADTWLNLASAIFFFAYPQPPKPSMLQVIDGTWQPNDHDKANGLVPGFGVTTQIINGGVECGGPTEIAQSQNRIKYYKEFANYLKVPVPANEVLGCANMKQFDEGGAGALKIYWEQDWGWSADTPDGKTYSCQLVGYQTPFSAFKEGDYSKCVQKFFNVKIVNDDGSSVTPDETPVTPTPTPSGDETPAPTPTPDETPVEPVVVNHAPVAQIAGPIGAVEAGAQVSLSAEGSTDPDGNKLTYTWRSQDGQTVTGQDKAVVTFTAPESATAQQYEVSLTVSDGELSSTTSYLLNVKAKAATPSGEDTSYPAWSANSKYNAGDIVNNHGKLFQCKPFPYSGWCNNSPTYYEPGAGLAWAEAWTAL

SEQ ID NO: 9250 - protein, 659 aa, Enterobacter cloacae
RSGHQRNPARSRAMTALLELNDIRRSYPSGDGPVEVLKGISLRVEAGEMVAIVGASGSGKSTLMNILGCLDKPTSGTYRVAGTDVSTLDGDALAKLRREHFGFIFQRYHLLSHLSAAQNVEVPAVYAGVERKKRLERAKALLTRLGLAERVDYQPSQLSGGQQQRVSIARALMNGGQVILADEPTGALDSHSGEEVMAILHQLRDQGHTVIIVTHDPQVAAQAERIIEIHDGELVSNPPPRQSRAAAAKEALPVSTGWGQFSSGFREALTMAWLAMAANKMRTLLTMLGIIIGIASVVSIVVVGDAAKQLVLADIRAIGTNTIDVYPGKDFGDDEPQYQQALKYDDLAAIQKQPWVNSATPAVSQNLRLRYGNIDVAASANGVSGDYFNVYGMTFSEGATFNAEQLAGRAQVVVLDANSRRQLFPNKTRVVGEVILVGNMPATVIGVAEEKQSMFGSSKILRVWLPYSTISGRIMGQSWLNSITVRVKEGYDSALAEQQLERLLTLRHGKKDFFTWNMDGLLKTAEKTTRTLQLFLTLVAVISLVVGGIGVMNIMLVSVTERTREIGIRMAVGARASDVLQQFLIEAVLVCLVGGAMGIALSMMIAFALQLFLPGWEIGFSPMAILTAFLCSTFTGILFGWLPARNAARLDPVDALARE

SEQ ID NO: 9251 - protein, 112 aa, Enterobacter cloacae
IRRESMQFSTTPTLEGQPITEYCGVVTGEAILGANIFRDFFAGIRDIVGGRSGAYEKELRKARDIAFKELGEQAKALGADAVVGIDIDYETVGKDASMLMVSVSGTAVKTRR

SEQ ID NO: 9252 - protein, 647 aa, Enterobacter cloacae
TINKCADMKKFPWACVALTALSLYSSSLLAANFSASFKNTDIREFIDTVGRNLNKTILVDPSVQGTVSVRTYNVLTEDEYYQFFLSVLDLYGLSVIPLDNGMVKVVRSSVARTAGAPLADSKNPGKGDEIITRVVRMENVPVRELAPLLRQLNDATGIGNVVHFEPSNVLLLTGKASVVNRLVDLVQRVDKDGIQRREIIPLRFASAKELSDMLNNLNNEEQKGQNAPQLATKVVADDETNSLVISGSEDARARTRSLIHQLDREQNNEGNTRVFYLKYASATKVVPVLTGIGEQLKDKPGAAKAKTASASTDLNITADESTNSLVITAQPNVMNSLEKVIDKLDIRRPQVLVEAIIAEVQDGNGLDLGVQWTSKHGGVQFGSTGLPISQIKNGTMKGASFTGLATGFFNGDFGALVTALSTNGKNDILSTPSVVTLDNKEASFNVGQDVPVLSGSQTTSGDNVFNSVERKTVGTKLKIVPQINDGDMIHLKIEQEVSSVDNSATEDSSLGPTFNTRTINNEVMVHSGQTVVLGGLMENVTKQSVSKVPLLGDIPLVGQLFRYTSQDTSKRNLMVFIHTTVLRDDDNYSAASKEKYDQIRVRQMQRVEEKKLGIVEPSDNAVLPAFPSASPHVAPVKTSAARNPFKE

SEQ ID NO: 9253 - protein, 165 aa, Enterobacter cloacae
EREIMKNQRGFTLLEIILALVIFASCAMMVVSTIPSRSGADIFGQQLKALVDYGSDRAVMDGNIVGLVIATDKYQLVTIADENGERHWVPLSAGRISTKGDFPEEMHVSLSPQRLAATVTSEPQVIFLPDGEISRFTLTLQSYDKQHHFRVVSQGAAPVSVENDG

SEQ ID NO: 9254 - protein, 235 aa, Enterobacter cloacae
EPAGYFPAYHSAGREQVKKMRRQRGFTLLEIMIALTIFAVISTLAWQILDGAMRTSSATDASAAKLNQLQRAWSLMERDFFQLQARAPRNEPELFRQAGDALELTTLNGVSGTVQLERERWRLEEGRLYRDVWPVIDGPAEVKPDEVPIVSGVKSLQWRFYRQGWLKSWSDAAHLPDGVEVTLTMENGDTWRWVFTTPGDMPEVAAAAAPEKAADAPGTPPDAAPAPAPSPETRP

SEQ ID NO: 9255 - protein, 282 aa, Enterobacter cloacae
PPQRCESAGATHLGKKRMNTFALMRDAFPVGFPIMSAILGGIVGSFLGVVAERVPGMVMDEEGSGNLLIPASHCPVCQHALAAWENIPLLSWLLLRGRCHQCGSAIPLRLFLVELISALFFGITAWCMPDVQALFSLWLLAAFLLPLAMIDWQHQLLPDCLTQPLLWAGLLLHVFDHTLPLRDALFGAVAGYLSLWLLYWAFRLITGREGLGYGDFKLLAALGAWCGWQALPSIELAAALSGIVGYFAVNNLNKNNLSISFGPYLAFAGIGVFISQQIAFTF

SEQ ID NO: 9256 - protein, 178 aa, Enterobacter cloacae
PINHSPFRGGVIQNSFYRMLVRRNNRNCQQVKMKKLILLLLIISQSALANCWDKAAHYYHVDPYLLYAIANVESGMNPYAVGQNRDGTRDVGLMQINSSHFTALESRGIDEYRLITEPCTSIMVGASILSGMIRVYGYNWEAVGAYNAGLKKENYPQRMKYAHKVWAKYQQLKLAARY

SEQ ID NO: 9257 - protein, 379 aa, Enterobacter cloacae
PEQLFGIFMNLKGKRRKLFLLLAVVVLAGGFWLWKVLNAPVPQYQTLIVRPGELQQNVLATGKLDALRKVDVGAQVSGQLKTLSVEIGDKVKKGQLLGVIDPEQAQNQIREVEATLMELRAQRAQAQAERNLAQVTLTRQQALAKTQAISKQDLDTAATELAVKQAQIGTIDAQIKRNQASLDTAKTNLDYTQIVAPMAGEVTQITTLQGQTVIAAQQAPNILTLADMSTMLVKAQVSEADVIHLKPGQKAWFTVLGDPQTRYEGVLKDILPTPEKVNDAIFYYARFEVPNPQGVLRLDMTAQVHIQLTGVKNVLTVPLSALGESAGDNRYKVKVLRNGETREREVVIGARNDTDVVVVKGLEEGEEVVTSETLPGAAQ

SEQ ID NO: 9258 - protein, 130 aa, Enterobacter cloacae
QTSRMTVIDDCYLTSEVDSKWLCIMGKTNDWLDFDQLAEDKVRDALKPPSMYKVMLMNDDYTPMEFVIDVLQKFFSYDVERATQLMLTVHYRGKAICGIFTAEVAETKVAMVNDYARENEHPLLCTLEKA

SEQ ID NO: 9259 - protein, 767 aa, Enterobacter cloacae
GIKLGEVPMLNQELELSLNMAFARAREHRHEFMTVEHLLLALLSNPSAREALEACSVDLVALRQELEAFIEQTTPVLPASEEERDTQPTLSFQRVLQRAVFHVQSSGRSEVTGANVLVAIFSEQESQAAYLLRKHEVSRLDVVNFISHGTRKDEPNQASDPSGQINSNEEQAGGEDRMENFTTNLNQLARVGGIDPLIGRDKELERAIQVLCRRRKNNPLLVGESGVGKTAIAEGLAWRIVQGDVPEVIADCTIYSLDIGSLLAGTKYRGDFEKRFKALLKQLEQDTNSILFIDEIHTIIGAGAASGGQVDAANLIKPLLSSGKIRVMGSTTYQEFSNIFEKDRALARRFQKIDVTEPSVDETVQIINGLKTKYEAHHDVRYTAKAVRAAVELAVKYINDRHLPDKAIDVIDEAGARARLMPASKRKKTVNVADIESVVARIARIPEKSVSQSDRDTLRTLGNRLKMLVFGQDKAIEALTEAIKMARAGLGHDHKPVGSFLFAGPTGVGKTEVTVQLSKALGIELLRFDMSEYMERHTVSRLIGAPPGYVGFDQGGLLTDAVIKHPHAVLLLDEIEKAHPDVFNILLQVMDNGTLTDNNGRKADFRNVVLVMTTNAGVRETERKSIGLIHQDNSTDAMEEIKKIFTPEFRNRLDNIIWFDHLSTEVIHQVVDKFIVELQVQLDQKGVSLEVSQEARNWLAEKGYDRAMGARPMARVIQDNLKKPLANELLFGSLVDGGQVTVGLDQAKNELTYDFQSAAKHKPEAAH

SEQ ID NO: 9260 - protein, 205 aa, Enterobacter cloacae
QSFPEMKKPTRAPAGQIRIIGGQWRGRKLPVPDSPGLRPTTDRVRETLFNWLAPSMVDANCLDCFAGSGALGLEALSRYAASATLLEMERGVAQTLQQNLATLKATNAKVVNTNTLSFLAQQGTPYNVVFVDPPFRKGLLEETLSLLEQNGWLADDALIYVESEVENGLPPVPVHWDLHREKVAGQVAYRLYHRQAQGGSDASTD

SEQ ID NO: 9261 - protein, 226 aa, Enterobacter cloacae
SKRYNMNSFTQSQRVKALFWLSLFHLLVIISSNYLVQLPISIFGFHTTWGAFSFPFIFLATDLTVRIFGAPLARRIIFAVMIPALFVSYAISSLFYMGSWQGFEALTHFNLFVARIATASFMAYALGQILDVHVFNRLRQNHRWWMAPTASTLFGNVSDTLAFFFIAFWRSPDAFMAEHWMEIALVDYAFKVLISLVFFLPMYGVLLNMLLKRLADKSEISALQAG

SEQ ID NO: 9262 - protein, 199 aa, Enterobacter cloacae
TNEPLWPFIERKKSMRNLVKYVGIGLLVVGLAACDNSDTKTPAQGASAESNATGQPVSLMDGKLSFSLPADMTDQSGKLGTQANNMHVYSDATGQKAVIVIVGDDTSEDLGVLAKRLEDQQRSRDPQLQVVTNKSVELKGHTLQQLDSIISAKGQTAYSSVVLGKVDNKLLTMQITLPADNQQKAQTAAENIINTLVIQ

SEQ ID NO: 9263 - protein, 370 aa, Enterobacter cloacae
RSRRSPSGALQLTRPPEKGILMTASPPDKAGLHILLKLACLVVILAGIHAAADIIVQLLLALFFAIVLNPLVTWFLRRGISRPVAITIVVMVMLVVLTALFGVLAASLSEFSTMLPQYNKELTRKLVDLQRMLPFVNLHISPERMLRRMDSEKVMTYATTLMTGLSGAMASILLLVMTVVFMLFEVRHVPYKLRFALNNPQIHIAGLHRALKGVSKYLALKTLLSLWTGVIVWLGLVLLDVQFALMWGVLAFLLNYVPNIGAVLSAVPPMIQAFLFNGFYECMLVGALFLIVHMVLGNILEPRMMGHRLGMSTMVVFLSLLIWGWLLGPVGMLLSVPLTSVCKIWMETTKGGSKLAILLGPGRPKSRLPG

SEQ ID NO: 9264 - protein, 451 aa, Enterobacter cloacae
RKTMLNPLPLSQWLSAPRPDDTPVAWQDDHLWTLGDLRHDVTQLVDTLRREDGERWALCIENGYLFIVALLATLHAGKTPVLPGHSRAAQLNEQRALFSGVLSDTTLDFQGQQLRVASAQRAGHPFSPLPAIGEMRTIELYTSGSTGTPQRVSKPVVSLDREARLLAAHFGERLAGCHVVASVVLHHLYGLTFRVVLPLALGLPLHASLLNYAEQLSALPDDKRYLFISSPAFLKRLDASLTPPPVNLLFSAGGALPWQEVAAVQAWLNVWPDEIYGSTETGVMAWRYRQEESTRWQPFPGVTFHGDRVMSPLIPEVEGVVLDDILHFTADGQFSLVGRRGRVVKIEDKRISLDDIERRLLALDGIREAAALTVTRGGRQGIGVLLVLNEAVRQQHEQGKKAQELAWRRALRPWLEPVAVPRYWRIVDEIPVNSMNKRVTAQLQELFHEDP

SEQ ID NO: 9265 - protein, 575 aa, Enterobacter cloacae
RAPHRQQREDSLMSVTFRPCVLIPCYNHGAMMASVLARLAPFDLPCLVVDDGSDETTRRTLEALAADRPQVTLLRLAENSGKGAAVMQGLKDCADRGFTHAVQVDADGQHAIEDIPKLLALAERHPDALISGQPVYDDSIPRSRLYGRWITHVWVWIETLSLQLKDSMCGFRVYPIAPVLRLAATTPLGRRMDFDTEVMVRLYWQGNNSYFLPTRVTYPPDGVSHFDALKDNVRISLMHTRLFLSMLPRIPSLLMRRRSQHWAQQQEVKGLWGMRLMLRVCQLLGRKAFTALLWPVTAVYWLTARAARQASQQWLTRVKTVMAQRQMPQPARLNSFSHFLRFGHAMLNKVASWRGEMKLHRDLVFAPGAQEALGLDDPQGKLLLASHLGDVEACRALAQREGAKTINALVFSDNARRFKQVMEEMAPQAGIHLMPVTDIGPETAILIKEKLDRGEWVAIVGDRIAVTPQRGGSWRVIWSEFMGQPAPFPQGPFILASILRCPVVLIFALCQQGKLTLHCEPFADPLLLPRGERQQALQQTVDRYAERLEHYALLSPLDWFNFFDFWQLPEINEKE

SEQ ID NO: 9266 - protein, 141 aa, Enterobacter cloacae
RVLTDPRFTAEVEITVPFHDVDMMGVVWHGNYFRYFEIAREALLNQFDYGYRQMKASGYVWPVVDTRVKYRDAVTFEQRIRIRAHIEEVENRLRIAYQIFDAQTGKRTTTGYTIQVAVEEASREMCFVSPAILFERMGIAP

SEQ ID NO: 9267 - protein, 416 aa, Enterobacter cloacae
TVTAGANRLALCSTLFTTTSPFNIWVTEMIYLSAVGMVNALGNSADEIAANLIAGVAPGMRQRAGWLQGLPEAVLGGVEGELPPVPESFSAHRSRNNQLLLAALAQIWPAVDAAIARVGRDRVAVVLGTSTSGLDEGDEYVRRAQNGERSPQWQYPQQELGDPSRFLASWLALDGPAYTISTACSSSARAIISGRRLIDAGLVDVAIVGGADSLSRMPVNGFNSLESFSPTLCEPFGRNRRGITIGEAAALMVLTREPGEVALLGAGESSDAYHISAPHPQGEGAIRAINQALNEAGITAADVGYINLHGTATPLNDRIEAQVIHDLFGDRVPCSSTKHLTGHTLGAAGITEAALSWLILTRSLPLPPQDFSRYAPDDTLPAFGLLHQSAPLNKPVILSNSFAFGGNNASLLLGRV

SEQ ID NO: 9268 - protein, 109 aa, Enterobacter cloacae
RHSSLHYADDRHPQGRADHHPVVGVRHYGQPWAGELQRGESRDHRRHQSARHRAGKTQNHRQLHRAGADRYRHDRDGRSCAARGDVDYPDAAYGPGRGGRGAGELPDVG

SEQ ID NO: 9269 - protein, 413 aa, Enterobacter cloacae
RRHAMTRRVVITGMGGVTAFGEDWPTISRRLREYENAVRTMTEWQAYDGLQTLLAAPIEDFTLPAHYTRKRIRAMGRVSLLSTRATELALEQAGLIDDAVLTNGQTGIAYGSSTGSTGPVSEFASMLTEKHTHNITGTTYVQMMPHTTAVNTGLFFGLRGRVIPTSSACTSGSQAIGYAWETIRHGYQTVMVAGGAEELCPSEAAVFDTLFATSQRNDAPKTTPSPFDVQRDGLVIGEGAGTLVLEALDHARARGATIYGEIVGFATNCDAAHITQPQRETMQVCMEQSLAMAGLGPQDIGYISAHGTATDRGDIAESQATAAIFGDSVPISSLKSYFGHTLGACGALEALLSLHMMREGWFTPTLNLRQPDEQCGALDYIMGETRPIDCEFIQSNNFAFGGINTSIIIKRWA

SEQ ID NO: 9270 - protein, 143 aa, Enterobacter cloacae
IEYTGPTLFDLDKQLMKLTIVRLVTFSDQDHIDLGKIWPEYSPSSLAVDENHRIYAARFNERLLAAVRVTLSGTEGALDSLRVRDVTRRRGVGQYLIEEVIRENPSVTSWWMADVGVEDRGVMAAFMQALGFTAQANGWEKRC

SEQ ID NO: 9271 - protein, 135 aa, Enterobacter cloacae
FTLKAKWKMVCRPFPFTGICTARRSPARWLIVCITVRHKEDPMPVLINVGRLLMLGVWAFLILNLVHPFPRPLNIFINVALIFTAFMHALQMVMLKNGLPKDSPPMTGWQQLRVFIFGVFELLVWMKKFKAQVKK

SEQ ID NO: 9272 - protein, 250 aa, Enterobacter cloacae
KIPSDYAEFRIPRLPRHCQTTARVTTLDQELIIQPQQLQGVNMLWSFIAVCFSAWLYVDASYRGPAWQRWLFKPVTLLLLLLLAWQAPMFNAVSYLVLAGLCASLIGDALTLLPRQRLLYAVGAFFLSHLLYTIYFASQMTLSFFWPLPLVLLVIGALLIAVIWSRLEEMRLPVCTFIAMTLVMVWLAGELWFFRPTAPAMSAFFGAALLLLGNIVWLGSHYRRRFRADNAISAACYFAGHFLIVRSLYI

SEQ ID NO: 9273 - protein, 306 aa, Enterobacter cloacae
RARAAAKPPVPAPLPAGRAPVHPAGRAPAVAMDAPMRGLRSRLDRLWRMLMTGLCFALFGLGGLTLSLVWFNLLLIFQRDRTQRRRLARRTISASFRLFLAVVRGAGVLDYRFNNLDVLRAERGCLVIANHPSLLDYVLLASVMNETDCLVKSALLRNPFVSGVIRAADYLINSEADTLLAASQQRLSQGDTLLIFPEGTRTRVGEAMTLQRGAANIAVRCNSAVRVVVIHCSERMLDKQSSWYNVPPNKPVFTVDVRERINIHDFYDASQHEPALAARQLNRHMQHQLTTGLQSLSGTKDASALS

SEQ ID NO: 9274 - protein, 109 aa, Enterobacter cloacae
RDASALLFRCHARGFYPSTTRLRMTAMTEQQTIYQEVSALLITLFEIAPEDITPEARLYEDLDLDSIDAVDMVVHLQKKTGHKIKPETFKAVRTVQDVVDVVEQLQRDA

SEQ ID NO: 9275 - protein, 270 aa, Enterobacter cloacae
CLPRHGPREHLPAERGRINHTFQPGNTIMRSVLVTGASKGIGRAIALQLAADGFTVGVHYHRDEAGAQETLEAIVQAGGAGRLLTFDVGNREQCRTVLEQEIADHGAWYGVVSNAGITRDGAFPALSDDDWDSVIHTNLDSFYNVIHPCIMPMIGTRKGGRIITLSSVSGIMGNRGQVNYSAAKAGIIGATKALATELAKRKITVNCIAPGLIDTGMIEMDEAALHAAMSIIPMQRMGQAEEVAGLASYLMSDKAGYVTRQVISINGGML

SEQ ID NO: 9276 - protein, 265 aa, Enterobacter cloacae
TMKIDLTGKVALVTASTGGIGFAIARGLAESGAEVIVNGRSVDSVNKGIQALQQVVPGVQVRAAIADLSSQEGVDELLRVATHVDILVNNAGIYGQQDFYSTDDETWERYWQTNVMSGVRLSRALLPGMVQKGWGRVVFISSESACNIPADMIHYGVTKTAQLSLARGLAKFVAGSGVTVNSVLPGPTMSDGFAAMMKDEIERTGKSLEQLAKAFVMENRPSSVIQRAATVEEVANMVVYVCSMQASATSGAALRVDGGVVDDIV

SEQ ID NO: 9277 - protein, 747 aa, Enterobacter cloacae
RLTLESTPECMLRLMRKLSLPETAMSTPETPKKVPQFSALKLSPVPPKEDCCCEGACETQTEALPESGNRYSWVVNGMDCAACARKVENAVKQVPGVNHVQVLFATEKLLVSAENDVSRQVEAAVSKAGYTLRSETAPAEKTSPLKENLPLITLIIMMALSWGLEQINHPFGNLAFIATTLVGLFPIARQALRLMRSGSWFAIETLMSVAAIGALFIGATAEAAMVLLLFLIGERLEGWAASRARKGVSALMALKPETATRVIDGQRETVAINTLRPGDVIEVPAGGRLPADGALVTATASFDESALTGESIPVARAAGEKVPAGATSVDRLVQLTVLSEPGDSAIDRILRLIEEAEERRAPVERFIDRFSRIYTPAIMLVALLVTVVPPLCFGAPWEGWIYKGLTLLLIGCPCALVISTPAAITSGLAAAARRGALIKGGAALEQLSQIRHVAFDKTGTLTVGKPQVTGVYPQDVSEDDLLTLAAAVEQGSTHPLAQAIVREAQSRGLNIPPATAQRALVGSGIEAVVEGKKVLIAAADSRSTPQVEALEQAGQTVVAVMQDGVPMGMLALRDTLRDDAKDAVDALHRLGVQGVILTGDNPRAAAAIAGELGLAFKAGLLPADKVSAVTELNSNAPLAMVGDGINDAPAMKASTIGIAMGSGTDVALETADAALTHNRLTGLAQMIDLARATRANIRQNIGIALGLKGIFLVTTLLGMTGLWLAVLADTGATVLVTANALRLLRQR

SEQ ID NO: 9278 - protein, 96 aa, Enterobacter cloacae
QPVFNLCQERKMQALYLEIKNLIISTLNLEELTPEDIDTDAALFGDGLGLDSIDALELGLAVKNQYGVVLSAESDEMRQHFYSVATLAAFIHQQRA

SEQ ID NO: 9279 - protein, 127 aa, Enterobacter cloacae
RPAPGAAVGRGMPDPAGRAAVAAAWRAAEQQRARHAAETDARRDPSRSQRRIYAAPRPPAHLAGQPRQTAGPARGAAVVNPAATQPGAECRKRSAGCRRATGLGRFLLAAPQWPGRSGHPRPPAKRR

SEQ ID NO: 9280 - protein, 180 aa, Enterobacter cloacae
TGDPVKLLRVWRQQRQPSAGESMMHYLPPGDYLPHDTPMLLLESVESVTDDRAVCSVTVNERGVLAPFLDADGNLPGWFALELMAQTVGVWSEWHRMQKGLPHCALGMVLGARELVCDAGHFAAGSTLTITIERLMQDERFGSFECTIHADSVSLATGRVNTFQPSEEELTTLFNQGTPS

SEQ ID NO: 9281 - protein, 202 aa, Enterobacter cloacae
TLGVTMYQFVLGKISTLSADPLASTLADMAPQGARHASWLAGRTLLARTLSPSPLPEIIYGEQGKPAFANGHPLWFNLSHSGDDIALLMSDEGEVGCDIEVIRPRENWQALANAVFSLTEHDELEREAPEEQLSAFWRIWTRKEAIVKQRGGSAWQIVSIDSTAQSLPVSQLRFGSLSLAVCTPTPFTLTAEAVTYSGIPAA

SEQ ID NO: 9282 - protein, 308 aa, Enterobacter cloacae
ITLCLNQIHPKFRLIMHKTTLEQWALLERVIEAGSFAKAAEETYRSQSSVSYNLSLLQERLGVALLMTEGRRAVLTPAGELLLNQVKPLLKAFAYVETRAATLRSGMRTRIDLMVDSIFPRSRLFAILRQFQQLYPQTQVRLTEVLENSRADALNDEADVMVLTRRQDITGLGEWLMNIDFVAVAHHAHPLFSLDTPLNDEMLRPWPRIQIADSQPTTHPTGESWTFSTIDAAIEAVMYQVGYGWLPEERIQTPLQQGILKTLPLSHGVRRATPLHLIVKRSLSPLDEQVETLLRLFKQEPSSSTATL

SEQ ID NO: 9283 - protein, 105 aa, Enterobacter cloacae
GEAFAYALNQWDALCYYCDDGLAEPDNNAAERALRAVCLGKKNYIFFGSDHGGERGALLYGLIGTCRLNGIDPEGYLRHILSVLPEWPINKVAELLPWNVDLTNK

SEQ ID NO: 9284 - protein, 155 aa, Enterobacter cloacae
LFGYVNTGDPTMKKILVSFVAIMAAASSAMAAETMNMHDQVNNAQAPAHQMQSSAEKSAIQGDSMTMMDMSSHDQAAMSHDMMQNSNSAAHQDMAEMHKKMMKAKPGATNETAKSFSEMSEHEKAAAVHEKANNGQSSVVHQQQADKHRSQITQN

SEQ ID NO: 9285 - protein, 232 aa, Enterobacter cloacae
GTICPRGLTMIRFEHVSKAYLGGRQALQGVTFHLQPGEMAFLTGHSGAGKSTLLKLICGIERPSAGKIWFSGHEISRLKNREVPFLRRQIGMIFQDHHLLMDRTVFDNVAIPLIIAGASYDDIRRRVSAALDKVGLLDKAKNFPIQLSGGEQQRVGIARAVVNKPAVLLADEPTGNLDDALSEGILRLFEEFNRVGVTVLMATHDMGLISRRSYRMLTLSDGHLHGGHGEQA

SEQ ID NO: 9286 - protein, 447 aa, Enterobacter cloacae
RPLWRIPCPWQTLTDALSRRLSEGDRVKNNELNDRRLQATPRGIGVMCNFYADKAENATVWDVEGNEYIDFAAGIAVLNTGHRHPKVIAAVEKQLHAFTHTAYQIVPYEGYVSLAERINQRVPIEGPAKTAFFSTGAEAVENAVKIARAYTRRSGLITFGGAFHGRTFMTMALTGKVAPYKLGFGPFPGSVYHAQFPNSLHGVSTAEALKSLERIFKADIAPDQVAAIIIEPVQGEGGFNVAPADFMQALRALCDTHGILLIADEVQTGFARTGKLFSMENHCVKPDLITMAKSLAGGMPLSAVSGRAEVMDAPAPGGLGGTYAGNPLAIAAAHAVLDVIDEDDLCTRAAHLGHHLVEVLNKAKDGCPYIADIRGQGSMVAVEFTDPQTGQPSPEFTRQVQERALNEGLLLLSCGVYGNVIRFLYPLTIPEAQFRKALDIISASLTR

SEQ ID NO: 9287 - protein, 112 aa, Enterobacter cloacae
KYRMLFNHNKTKYKHDITNGDSEMKRNAKTLIAGMVALSISHAAMADDIKVAVVGAMSGPVAQWGDMEFNGARQAIKDINAKGGIKGDKLVGVEYDDACDPVLTPGARINAS

SEQ ID NO: 9288 - protein, 365 aa, Enterobacter cloacae
RDASLTGPRFLLCAWCFVFLKGLSMSAAHLGFPTETVVVFVVMAVGAMFIDLFMHRHDKPISLKSAVMWSIFWVMMAMAFAGFLYVHHGAEMASLFLTGYALEEVLSVDNLFVMMAIFAWFGVPDRYRHRVLYWGVLGAIVFRGIFVAIGTSLLSLGPYVEVIFALVVGWTAVMMLKRNEESDEVEDYSNHLAYRLVKRFYPVWPKISSHAFILTQKEVDAELEKPENKDVMVGRVKKAKRYATPLLLCVAVVELSDVMFAFDSVPAIIAVSREPLIIYSAMMFAILGLRTLYFVLEALKQYLVHLEKAVVLLLFFVAFKLGLNATDHFWHHGYNIGATASLFVVLGVLALGIIASVMFPGKREA

SEQ ID NO: 9289 - protein, 181 aa, Enterobacter cloacae
RGTIVSSKQRRHRMSTFDKHDLSGFVGKHLVYTYDNGWNYEIYVKNENTLDYRIHSGLVGNRWVKDQQAYIVRVGESIYKISWTEPTGTDVSLIVNLGDRLFHGTIFFPRWVMNNPEKTVCFQNDHIPLMNSYRDAGPAYPTEVIDEFAAITFVRDCGANDDSVINCAASELPANFPENLK

SEQ ID NO: 9290 - protein, 81 aa, Enterobacter cloacae
TAVTGHSRAVNALRPSSWQTRSIRRMPHNPFTSCCCAQCCERRRISREGMRGSMLRNRRVCINEMRTLSFRASKWDTPSGG

SEQ ID NO: 9291 - protein, 94 aa, Enterobacter cloacae
RGVNYSRFYLNEKKMTDLFSSPDHTLDAQGLRCPEPVMMVRKTVRNMQSGETLLIVADDPATTRDIPGFCTFMEHELVAQQTETLPYRYLIRKG

SEQ ID NO: 9292 - protein, 333 aa, Enterobacter cloacae
RLSHYPGVDLMKTTLKPLLAALCLTAFACTVSAQTIKAADVHPEGYPNVVAVQHMGEKLKQQTDGKLEIKVFPGGVLGDEKQMIEQAQMGAIDMIRVSMAPVAAILPDIEVFTLPYVFRDEDHMHKVIDGDIGKQIGDKLTANPKSRLVFLGWMDSGTRNLITKEPIVKPDDLKGKKIRVQGSPVALATLKAMGANSVAMGVSEVYSGMQTGVIDGAENNPPTFIAHNYMPVAKNYTLSGHFITPEMLLYSKVKWDKLSADEQQKILTLAREAQFEQRKLWNAYNDQALAKMKAGGVQFHDIDKTVFIKATEPVRAQYGDKHQDLMKAIADVQ

SEQ ID NO: 9293 - protein, 173 aa, Enterobacter cloacae
AGVRMSELYLKWMDRLYLLAMVVAGLSLLVMTIVIPIGIFSRYVLNRGESWPEPIAIICMVTFTFIGAAVSYRAGSHIAVNMLTDRLPASLQRVCARVVDLLMLLISGLMCWYSYWLCVELWEQPVAEFPLLTSGESYLPLPVGSAILILFVLERLLFGSQENRPVVLIGNHS

SEQ ID NO: 9294 - protein, 488 aa, Enterobacter cloacae
SQMAKQKKRGFFSWLGFGEKEQETEQKTEEQQVVEEQSQPETPVETAAVVEAEEPAHSKEEIESFAEEVVEVTEQVQESEKPEPVIVETLTEAPQAAIEHEALPLPEEVKAEEVSAEEWQAEAETVEIVEAVEEEAALEPELTDEELEAQALAAEAAEEAVIVVPVEEQAEEEIVQEQEKPTKEGFFARLKRSLLKTKENLGSGFISLFRGKKIDDDLFEELEEQLLIADVGVETTRKIIANLTEGASRKQLRDAEALYGLLKDEMGEILAKVDEPLNIEGKMPFVILMVGVNGVGKTTTIGKLARQFEQQGKSVMLAAGDTFRAAAVEQLQVWGQRNNIPVIAQHTGADSASVIFDAIQAAKSRNVDVLIADTAGRLQNKSHLMEELKKIVRVMKKLDEDAPHEIMLTIDASTGQNAISQAKLFHEAVGLTGITLTKLDGTAKGGVIFSVADQFGIPIRYIGVGERIEDLRPFKADDFIEALFARED

SEQ ID NO: 9295 - protein, 360 aa, Enterobacter cloacae
AMGICTEATVNKRDAMNQIRQFSNRFDRFRKPQGGGDGNRNAPKRAKATPKPNSRKTNVFNEQVRYAFQGALQDLKSKPLATFLTVMVIAISLTLPSVCYMVYKNVNQAASQYYPSPQITVYLDKALDDNAAAQVVGQIQAEQGVEKVNYLSRDEALGEFRNWSGFGGALDMLEENPLPAVAVVIPKLDFQGTDSLNTLRDRITRINGIDEVRMDDSWFARLAALTGLVGRVSAMIGVLMVAAVFLVIGNSVRLSIFARRDTINVQKLIGATDGFILRPFLYGGALLGFSGAFLSLILSEILVMRLSSAVTEVAQVFGTKFDISGLGFDECLLLLLVCSMIGWVAAWLATVQHLRHFTPD

SEQ ID NO: 9296 - protein, 429 aa, Enterobacter cloacae
TMDAFVLLFTLAILLALGMPVAFAVGLSAVAGALWIDLPLEALMIQITSGVNKFTLLAIPFFILAGAIMAEGGIARRLVNFAYVFVGFIRGGLSLVNIVASTFFGAISGSSVADTASIGSVMIPEMEKKGYPREYAAAVTASGSVQAILIPPSHNSVIYSLAAGGTVSIATLFIAGVLPGLLLGVSLMVLCLCFARKRGYPKGDKIPFRQALKIMLDALWGLMTVVIILGGILSGIFTATESAAVACLWAFFVTMFIYRDYKWSELPKLMCRTVKTVTIVMILIGFAAAFGAVMTYMQLPMRITEFFTSLSDNKYVILMYLNIMLLLIGTLMDMAPIILILTPVLLPVTNSLGIDPVHFGMIMMVNLGIGLITPPVGSVLFVASAVSKQKIEHVVRAMLPFYGMLLVVLGMVTYIPAISLWLPGLLGMQ

SEQ ID NO: 9297 - protein, 122 aa, Enterobacter cloacae
WDFSMSKMPLFFIIVVAIIVIAASFRFVQQRREKADNDAAPLMQKRVVVTNKREKPLNDRRSRQQQVTPAGTTMRYEASFKPETGGLEMTFRLEAQQYHQLTVGEKGTLSYKGSRFVGFRAE

SEQ ID NO: 9298 - protein, 285 aa, Enterobacter cloacae
MTKEMQTLALAPVGNLESYIRAANTWPMLTAEEEKELAEKLHYQGDLEAAKTLILSHLRFVVHVARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVSSKDVREMESRMAAQDMTFDMSADDDASDSQPMAPVLYLQDKTSNFADGIEEDNWEDQAANKLTFAMEGLDERSQDIIRARWLDEDNKSTLQELADRYGVSAERVRQLEKNAMKKLRAAIEA

SEQ ID NO: 9299 - protein, 387 aa, Enterobacter cloacae
NKALHNNITTIVITIIMGNLRMNMKGKALLAGCIALAFSAMAQADIKVAVVGAMSGPVAQYGDQEFTGAEQAVADINAKGGIKGEKLQIVKYDDACDPKQAVAVANKVVNDGIKYVIGHLCSSSTQPASDIYEDEGILMITPAATAPELTARGYKLILRTTGLDSDQGPTAAKYIVEKVKPQRIAIVHDKQQYGEGLARAVQDNLKKANANVVFFDGITAGEKDFSTLVARLKKENIDFVYYGGYHPEMGQILRQARAAGLKTQFMGPEGVANVSLSNIAGESAEGLLVTKPKNYDQVPANKPVVDAIKAKKQDPSGAFVWTTYAALQSLQAGLNQSADPAEIATWLKANSVETVMGPLSWDEKGDLKGFEFGVFDWHANGTATDAK

SEQ ID NO: 9300 - protein, 797 aa, Enterobacter cloacae
GTFMLRYSLLTAGLMLGASAFAAPAGDLPLMPWPAKVERPTTQGALELNNQLTVSVSGDDLGDAVNRLRQRIALQTGWTLQPQAEKPDKPTIRIAIAKKVKPQPLPDSDESYKLTVDANGVNISANTRFGALRAMETLLQLMQNGAENTSIPWVTIEDSPRFPWRGLLLDSARHFLPIPDIKRQIDGMAAAKLNVLHWHLTDDQGWRFSSKRYPKLTQLASDGLFYTPEQMREIVRYAAERGIRVVPEIDMPGHASAIAVAYPELMSALGPYAMERHWGVLKPVLDPTKEATYTFADAMVSELAAIFPDPYLHIGGDEVDDSQWKANAAIQRFLRDNKLADSHALQAYFNRKLETILEKHHRQMVGWDEIYHPDLPKSILIQSWQGQDALGQVAQNGYKGILSTGFYLDQPQSTAYHYRNEIVPQGLNGVDVIADTDSVQSWAFSMPRLKGKPVEGSFTLVKGDAGWRGFIDFAGKSRRAVDNIQWRDDNQVTFTVDTWMGETRPVVSVENDKLSGYFLVGNARYPISGTRLDAVPKGIPPVVPDPANEANLLGGEAALWAENVVAPVLDIRLWPRAFAVAERLWSAKDVNDIDNMYTRLQAMDSWSTVSAGLQQHTQQQVQFTRLANNADTLPLQILTQALEPAQYYTRQHLKFQAGNYHQFEPLNRLADALNAESATVRQMNKWADRLVSDAEDTESADALRHVFNRWQNNTSDALALSENSYQLKAIKPVIQEVDKLAAIGLRLTDLVARQGTLDDKEIASIQSELDNAAKVQDEVVIAAVYPLETLLRATRNQ

SEQ ID NO: 9301 - protein, 155 aa, Enterobacter cloacae
SEGCIMIIGNIHHLQSWLPEELRQAIEHVKAHVTDATPTGKHDINGNSLFYLVSEDMTQPFAERRAEYHARYLDIQIVLKGQEGMTFSTLPHGTPDTDWLADKDIAFLPEGEQEKTVVLSEGDFVVFWPGEVHKPLCAVGAPAKVRKVVVKMLVE

SEQ ID NO: 9302 - protein, 142 aa, Enterobacter cloacae
AMANPELLEEQREETRLIIEELLEDGSDPDALYTIEHHFSADDFDALEKMAVEAFKLGYEVTEPEELEVEEGDTVICCDILSEGALKAELIDAQVEQLMNLAEKFEVEYDGWGTYFEDPNGEDGEEGDDEDYVDEDDDGVRH

SEQ ID NO: 9303 - protein, 1109 aa, Enterobacter cloacae
VTGWGMDSNTQGFTSYWRNTLADAESGKGAFERKDEESFTQWMNVDRGRLDEEIVQAFFEGEDEQVKTVEVMLRPQVWIRLLKHGKERTAGAPGIVTPLVTSALLNREGFLFPASPATIPRDLLEPLPKGTFSIGEMTEYDRYKTTHDSVTFGPGDEDEKREETDEQRAERYARYKQLWQTYLKETNELLKSVAGKWLDAPEQYEPAGYGYVIKANQSGGASIHILPMYDHLLSCKKEVPLLARFASKDKSPVEPLLASNAMFTERLGHSGDKFPLAVAQRDALSHYLTQQPGDILAVNGPPGTGKTTLVLSIIATEWARAALNKTEPPVVIATSTNNQAVTNIIEAFGKDFATGSGPMAGRWLPDVKSFGAYFPSSSRKAEAAKKYQTEDFFNRVESLEYVEDARFFFLEKASAAFPTVECHSPEQVVDLLHQRLVELSAELEQIEPAWDALNAIREERSAVSDDLEQYIEDKRTSLLNSTNEISLLTQGKKQWEQYRAGESFMFALFSWLPAVRTKRHYQMKLFLEATFGERMTAFQGALPDGIDAFINGLIEQARKEQAGYQQQMDLAEDISRRESEAAMRWHHITHSLGNPGETELSLHEADELADTQLRFPMFLLATHYWEGRWLMDMAAIDNIQKEKGRTGAKSTKARWQRRMKLTPCVVMTCFMFPYHMKTSEFVGGNKKFDDNYLYNFADLLIVDEAGQVLPEVAAASFALAKKALVIGDTEQIAPIWNSLPGIDIGNMVEENILPGGTQEELTESYALVCDSGKSAASGSVMKIAQFNSRYQYDPDFARGMYLYEHRRCFDNIIGYCNTLCYHGKLQPKRGEEKETIFPAMGYLHIDGKGMQASGGSRYNAFEAETIAAWLAAHKEEIERHYGEPLHKVVGVVTPFSAQVSTIKSSLRKLDINCSGDENSLTVGTVHSLQGAERAIVLFSPVYSKHEDGSFIDSDSSMLNVAVSRAKDSFLVFGDMDLFEIQPGSSPRGLLAKYLFASTDNALQFEFQERQDLSTSQTQISTLHGVEQHDAFLNQTFDAINQSITIVSPWLTWQKLEQTGFLASMSQARARGIDITVVTDKTFNTEHTDFEKRKEKHQLTCSPLISTPRC

SEQ ID NO: 9304 - protein, 97 aa, Enterobacter cloacae; identical to SEQ ID NO: 5897

SEQ ID NO: 9305 - protein, 924 aa, Enterobacter cloacae
QVRLCHACGKDCVRLCGCGGMTMLKNITRQLQALLSRHLPHRLIARDPLPNANTMAGAAIPASLTERCLNVAAMDENEVWRAFGGHPEGLNAQEVSKIRAEHGDNQIPAQKPSPWWVHLWLCYRNPFNLLLTVLGIISYATEDLFAAGVIALMVGISTLLNFIQEARSTKAADALKAMVSNTATVSRVINDLGENAWIELPIDQLVPGDLVKLAAGDMIPADLRIIQARDLFVAQASLTGESLPVEKVARTRDPQQMNPLECDTLCFMGTTVVSGTAQAIVTATGGNTWFGQLAGRVSEQESEPNAFQKGIGRVSMLLIRFMMVMTPIVLLINGYTKGDWWEAALFALSVAVGLTPEMLPMIVTSTLARGAVKLSKQKVIVKHLDAIQNFGAMDILCTDKTGTLTQDKIVLENHTDIAGKTSERVLYSAWLNSHYQTGLKNLLDVAVLEGVDEESARMLSGRWQKVDEIPFDFERRRMSVVVSEQPDVHQLICKGALQEILNVSTQVRHNGEIVLLDETMLRRIKRVTDNLNRQGLRVVAVASKFLPAREGDYQRIDESDLILEGYIAFLDPPKETTAPALKALKASGITVKILTGDSELVAAKVCHEVGLDAGDVVVGSDIELLSDDELADLAQRTTLFARLTPMHKERIVTLLRREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLMYDVSQVAIPFDNVDDEQIQKPQRWNPADLGRFMLFFGPISSIFDILTFCLMWFVFHANTPEHQTLFQSGWFVVGLLSQTLIVHMIRTRRIPFIQSRAAWPLIVMTGIVMALGIALPFSPLASYLQLQALPLSYFPWLVAILAGYMVLTQMVKGFYSRRYGWQ

SEQ ID NO: 9306 - protein, 674 aa, Enterobacter cloacae
GAAENPAATAQALLSWTITMTIEKIFTPQDDAFYAVITHAAGPQGTLPLTPQMLMESPSGNLFGMTQNAGMGWDANKLTGKEVLIIGTQGGIRAGDGRPVALGYHTGHWEIGMQMQAAAKEITRNGGIPFAAFVSDPCDGRSQGTHGMFDSLPYRNDAAIVFRRLIRSLPTRRAVIGVATCDKGLPATMIALASMHDLPTILVPGGATLPPTVGEDAGKVQTIGARFANHELSLQEAAELGCRACASPGGGCQFLGTAGTSQVVAEALGLALPHSALAPSGQAVWLEIARQSARAVSELDNRGITTRDILTDKAIENAMVIHAAFGGSTNLLLHIPAIAHAAGCTIPDVEHWTRVNRRVPRLVSVLPNGPDYHPTVRAFLAGGVPEVMLHLRDLGLLHLDAMTVTGQTVGENLDWWQASERRKRFRQCLREQDGVDPDDVILPPEKAKAKGLTSTVCFPTGNIAPEGSVIKATAIDPSVVGEDGVYRHTGRARVFVSEAQAIKAIKREEIKQGDIMVVIGGGPSGTGMEETYQLTSALKHISWGKTVSLITDARFSGVSTGACFGHVSPEALAGGPIGKLRDNDIIEIAVDRLTLTGSVNFIGTADNPLTPEEGARELAMRQTHPDLHAHDFLPDDTRLWAALQSVSGGTWKGCIYDTDKIIEVINAGKKALGI

SEQ ID NO: 9307 - protein, 574 aa, Enterobacter cloacae
AHRCPRGGHQPAADQAPRGAGRGRSRRCDSRIPLTGGTMEITNPILTGFNPDPSLCRQGEDYYIATSTFEWFPGVRIYHSRDLKNWSLVSTPLDRVSMLDMKGNPDSGGIWAPCLSYADGKFWLLYTDVKIVDSPWKNGRNFLVTAPSIEGPWSEPIPMGNGGFDPSLFHDDDGRKYYLYRPWGPRHHSNPHNTIVMQAFDPQTGTLSPERKTLFTGTPLCYTEGAHLYRHAGWYYLMVAEGGTSYEHAVVVLRSKTIDGPYELHPDVTMMTSWHLPENPLQKSGHGSLLQTHTGEWYMAYLTSRPLRLPGVPLLASGGRGYCPLGRETGIARIEWRDGWPYVEGGKHAQLTVKGPQMAEQPVSIQGNWREDFDGSTLDPELQTLRIPFDDTLGSLTARPGYLRLYGNDSLNSTFTQSTVARRWQHFAFRAETRMQFSPVHFQQSAGLTCYYNSKNWSYCFVDYEEGQGRTIKVIQLDHNVPSWPLHEQPIPVPEHAESVWLRVDVDRLVYRYSYSFDGETWHAVPVTYEAWKLSDDYIGGRGFFTGAFVGLHCEDISGDGCHADFDYFTYEPA

SEQ ID NO: 9308 - protein, 311 aa, Enterobacter cloacae
TWPRSLRWNTTAGEPTSKIRTVKTAKRATTKITSTKTTTACVTKRFRRWRAPPLFQGRTMDYPQILAPVLNFLQCPTPQAWIDKARDPANLPLLLTDHMVCELKAAQTALLLVRKYVADESGADALLEWLKPYEQFTFRDGPEPDFIALHRQIGKSVMPKTDDPWGQALIDSMVLLIKEELHHFWQVREAMLARDIPYVKITASRYAKGMLKDVRTHEPLTLIDKLICGAYIEARSCERFAALAPFLDDDLQKFYLSLLRSEARHYQDYLTLAQQVSDDDISPRIQLFGEIEATLISTPDNEFRFHSGVPV

SEQ ID NO: 9309 - protein, 162 aa, Enterobacter cloacae
GISMSAPAHLWLEDENGSPIVGCCAMPLRLGSIELKSFSHGVTIPVDPSWGKLTGTRVHRPITIVKEFDQTTPLLYRAVCEGRTMKKATIKMYRILESGIEAEYFKIILENVKFTTVAPYLSPGSMTSTHLETLELRYEAITWKYTEGNILYRDSWNDRCCA

SEQ ID NO: 9310 - protein, 73 aa, Enterobacter cloacae
NNQLSLMLSCEFAMGKVWFTFGLFAGRYNTARLVTNGMDKSLYCAPIPNFLLTGGHMDPDPTPLLTRRKPSYR

SEQ ID NO: 9311 - protein, 305 aa, Enterobacter cloacae
GDHMPQSALFTGIIPPVSTIFTADGQLDKQGTAALIDDLIKAGVDGLFFLGSGGEFSQLGAEERKTIAQFAIDHVDCRVPVLIGTGGTNARETIELSQHAQQAGADGIVVINPYYWKVSEANLIRYFEQVADSVTLPVMLYNFPALTGQDLTPALVKTLADSRSNIVGIKDTIDSVAHLRSMIHTVKAAHPHFTVLCGYDDHLFNTLLLGGDGAISASGNFAPQVSVNLLKAWRDKDVAKAAEYHQTLLQIPQMYQLDTPFVNVIKEAIVLCGRPISTHVLPPASALDEPRKAQLKTLLQQLKLC

SEQ ID NO: 9312 - protein, 470 aa, Enterobacter cloacae
FSTLHKGVILMTQLTMKDKIGYGLGDTACGFVWQATMFLLAYFYTDVFGLSAGIMGTLFLVSRVLDAVTDPLMGLLVDRTRTRYGQFRPFLLWGAIPFGIVCMLTFYTPDFSAQGKIIYACATYILLTLVYTFVNVPYCAMPGVITADPKERHALQSWRFFLAAAGSLAISGIALPLVSIIGKGDEQVGYFGAMCVLGMTGVVLLYVCFFTTKERYTFEVQPGSSVAKDLKLLLGNGQWRIMCAFKMMATCSNVVRGGATLYFVKYVMDHPEMATQFLLYGSLATMFGSLCSSRLLGRFDRVTAFKWIIVAYSLISLLIFFTPAEHIALIFALNILFLFVFNTTTPLQWLMASDVVDYEESRSGRRLDGLVFSTYLFSLKIGLAIGGAVVGWILAYVNYSASSSVQPVEVLTTIKILFCVVPVVLYAGMFIMLSFYKLTDARVEAISQQLIKHRAAQGEAVPDAATAASH

SEQ ID NO: 9313 - protein, 62 aa, Enterobacter cloacae
RGASGGSWAKVLTTDQKREAVMLMCDATGLSQRRACRLTGLSLSTCRYEAHRPAADAHLSWR

SEQ ID NO: 9314 - protein, 495 aa, Enterobacter cloacae
VWKENMSISSVIKSLQDIMRKDAGVDGDAQRLGQLSWLLFLKIFDTQEEELELEQDDYQFPIPQRYLWRSWAANSEGITGDALLEFVNDDLFPTLKNLTAQIDKNPRGFVVKQAFSDAYNYMKNGTLLRQVINKLNEIDFSSSQERHLFGDIYEQILRDLQSAGNAGEFYTPRAVTRFMVNRIDPKLGESIMDPACGTGGFLACAFDHVKEHYVKTTEDHKTLQKQIHGVEKKQLPHLLCTTNMLLHGIEVPVQIRHDNTLNKPLSSWDEQVDVIVTNPPFGGTEEDGIEKNFPAEMQTRETADLFLQLIIEVLADKGRAAVVLPDGTLFGEGVKTKIKKLLTEECNLHTIVRLPNGVFNPYTGIKTNILFFTKGQPTKDVWFYEHPYPDGVKNYSKTKPMKFEEFQAEIDWWGNEADGFASREENNQAWKVGIGDIIARNFNLDIKNPYQGETISHDPDELLAKYQKQQTDISELRNQLRDILGAALAGNKGAN

SEQ ID NO: 9315 - protein, 316 aa, Enterobacter cloacae
AAHWNATEFKGAIMERKPTLVVALGGNALLKRGEPLEADIQRQNIEQAARTIAGLTEQWRVVLVHGNGPQVGLLALQNSAYDKVTPYPLDVLGAESQGMIGYMLQQALKNNLPQREVSVLLTQVEVDAADPAFSNPTKYIGPVYSEAQAKTLAAEKGWVFKADGSYFRRVVPSPQPKRIVESDAITALIQRDHLVICNGGGGVPVVENANGYRGIEAVIDKDLSAALLARQIEADALLILTDADAVYLDWGKPTQRPLAQVTPELLRGMQFDAGSMGPKVAACREFVEACGGIAGIGALNDGAEILAGEKGTLIRN

SEQ ID NO: 9316 - protein, 516 aa, Enterobacter cloacae
RKRSSNHRTPSSSTKQRTACTPLKRSWWRHSATNHRPARRGVRRVQENIMGKFKFPSAYTILFFLIAVVAVLTWIVPAGQYHMAMNEALGKEVPVAGTYAQVASHPQGLVSVLMAPIAGLYDPESGQAGAIDVALFILIIGGFLGIVTKTGAIDAGIERVTTRLRGREEWMIPILMALFAAGGTIYGMAEESLPFYTLLVPVMLAARFDPVVAASTVLLGAGIGTLGSTINPFATVIAANAAGIPFTNGIALRLALLVIGWIICVAWVMRYARKVRKDPSLSIVADKQEENLAHFLGNKGEQSLEFTPVRKLILVIFALAFAVMIYGVAVLGWWMAEISAVFLASAIIVGLIARMSEEELTSTFINGARDLLGVALIIGIARGIVVIMDKGMITHTILHSAEGMVTGLSTVAFINVMYWLEVVLSFLVPSSSGLAVLTMPIMAPLADFANVNRDLVVTAYQSASGIVNLITPTSAVVMGGLAIARVPYVRYLKWVAPLLGILTVVIMVALSLGALL

SEQ ID NO: 9317 - protein, 99 aa, Enterobacter cloacae
WLFSHALYSTRSLVFPAISVWFSSTILSWVRVPVLSVQRMSIAPKFWMASRCLTITFCLESLTAPRASVEVTIIGSISGVKPTATESANSAASHQSPLV

SEQ ID NO: 9318 - protein, 821 aa, Enterobacter cloacae
SYFVESSAMVGENKTHLTETDIITKYILPAVKTAGWDVMSQVRQEVKLRDGKIVVRGKLASRIKVKSADIVLYHKPNLPLAVIEAKANKHAISKGMQQGLDYASLLDVPFVFASNGDGFIFHDKTNPQQLESEIALSDFPTPEQLWQKYCAWKGFTQEQLPVISQDYYDDGSGKSPRYYQMQAINRTVDAVSAGKNRILLVMATGTGKTYTAFQIIWRLWKAKNKKRILFLADRNILVDQTKNNDFQPFGTAMTKVTGRTIDPAYEVHLALYQAITGPEEHQKAYKQVDPNFFDLIVIDECHRGSASEDSAWREILEYFGSATQVGLTATPKETEDVSNIDYFGEPVYTYSLKEGIEDGFLAPYKVVRVDIDVDVQGWRPVKGQLDKYGEEIEDRIYNLKDFDRKLVIDERTMLVAQTITDYLKRTNPMDKTIVFCNDIDHADRMRHALVVLNPEQVLKNEKYVMKITGDDDIGKAQLDNFINPKKAYPVIATTSELMTTGVDAQTCKLVVLDQNIQSMTKFKQIIGRGTRINERHGKLWFTILDFKKATELFADPRFDGLPEKVLVVKPGDISDESSDFNERLDEETTNDDGDNPHNEMREDAAEYHVNRDNHSGNGEFHSDDADKVRKFYVNGVAVKVLAKRVQYYDSDGKLVTESFQDYTRKTMLKDSEYASLDSFVRKWQEAPRKQAIIEELAQLGILWDVLAEEVGKDLDPFDLLCHVVYGQPPLTRQERAANVRKRNYFTKYAEPAQQVLNTLLDKYADEGVQEIEDVQVLKLKPFDALGRPIEIIKTRFGDKKAYEQAVNELENEIYQLPPRSA

SEQ ID NO: 9319 - protein, 304 aa, Enterobacter cloacae
CSRLCCRMALRPDALTPALSHGERENTGSISLIFHPEKGTFSPSFQRGHASIMPIIQSVERALQILDLFNEQATELKITDISKLMGLSKSTLHSLLKTLQLHGYIDQNPENGKYRLGMKLVERGHFVVGSIDIRQKAKGWLTELSQRTGQTTHLGILDGSEGVYIEKIEGKLAAIAYSRIGRRLPVHATAIGKVLIAWLGEAELNALLEGYHYTTYTPSTLASREALMAALTQTREQGYALDSEENEQGVRCVAVPVWNHESRVIAALSLSTLTSRVDDAELANFREQLQQAGLQLSRALGYPA

SEQ ID NO: 9320 - protein, 337 aa, Enterobacter cloacae
KFSRWSWLSSSSAELELLQQGFQLRLTRLVQRRGGRQHVGRNRTTAEHNRLFNNVHKRRIQLIHLRDLQQGLMILSRFRHVFIPPGFQKIYRHLWGKVATGRDRPVAAEQQGIKQMIVVAAEHGEVRMGGFDGVDHAAQVGNGVDGVFDADDVAARVGQGFDQRRGQILPGQRREVIEHHRQRDAVRHLLEIADQVRFRHFPVVRVDHHDTVRPCLLRVLAQLNGFPGVGAAGADQDRHATIDMIDRKLGNGFTLFGAELGELAAAAQEKQAVDACFDQIVDQRGGALLIELAIGGKNGGDRGNDTREQRGLRHVISLLNHFVLHCRTVFIKLTIIL

SEQ ID NO: 9321 - protein, 330 aa, Enterobacter cloacae
TYSQSPSFEGLFFARRQEINMNPLYQKHIISINDLSREELELVLETAAKLKANPQPELLKHKVIASCFFEASTRTRLSFETSMHRLGASVVGFSDSSNTSLGKKGETLADTISVISTYVDAIVMRHPQEGAARLATEFSGGIPVLNAGDGANQHPTQTLLDLFTIQETQGTLENLNIAMVGDLKYGRTVHSLTQALAKFNGNRFFFIAPDALAMPQYILDMLDEKGIAWSLHASIEEVMGNVDILYMTRVQKERLDPSEYANVKAQFVLRAGDLEGARDNMKVLHPLPRIDEITTDVDKTPHAWYFQQAGNGIFARQALLALVLNRELAL

SEQ ID NO: 9322 - protein, 157 aa, Enterobacter cloacae
GETTMTHDNKLQVEAIKRGTVIDHIPAQVGFKLLTLFKLTETDQRITIGLNLPSGEMGRKDLIKIENTFLTDEQVNQLSLYAPDATVNRIDEYEVVGKSRPSLPERIESVLVCPNSNCISHAEPVSSSFAVKKRANDIALKCKYCEKEFSHYVVLAN

SEQ ID NO: 9323 - protein, 597 aa, Enterobacter cloacae
PAARYSWCSSGRQQGGELMTVEKLITDHIDIWSSALQTRSTAGRGSNGKIDLYGIKKLRELILELAVRGKLVPQDPSDEPASELLKRIATEKAELVKQGKIKKQKPLPEISEDEKPFELPEGWELNRLGDLINVINGRAYKKHEMLQAGTPLLRVGNLFTSNEWYYSDLELEPEKYIDNGDLIYSWSASFGPFIWNGGKVIYHYHIWKMDIFDTQSLDKHFMKLYLESVSASIKASGNGIAMIHMTKERMEKLVIPLPPRAEQLRIVAKVNELMSLCDQLEQQSLTSLDAHQQLVETLLSTLTDCKNAEELAENWARISQNFDTLFTTEASIDVLKQTILQLAVMGKLVPQDPNDEPASELLKRIDQEKAQLVKEGRIKKQKPLPPISDDEKPFELPEGWEWCRLETITELITKGSSPKWQGVSYTDNPNDVLFITSENVGSFKILLDSEKYVEKKFNEIEPRSILTHNDILMNIVGASIGRTAIFNMNRNANINQAVCLIRVINNSMLLSYLLNFFNSDICLSYMFDKQVDNARANLSMGNIAKFVLPIPPLNEQKRIVEHIDNLMSICDKLQSHLQSVQQIQLHLADALTDAALN

SEQ ID NO: 9324 - protein, 345 aa, Enterobacter cloacae
FNKWHSPCEDKMSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYAGVPVWNGLTNEFHPTQLLADLLTMQEHLPGKAFNEMTLVYAGDARNNMGNSMLEAAALTGLDLRLVAPKACWPEESLVAECSALAEKHGGKITLTENVAAGVKGADFIYTDVWVSMGEAKEKWAERIALLRGYQVNAQMMALTGNPDVKFLHCLPAFHDDQTTLGKQMAKEFDLHGGMEVTDEVFESAASIVFDQAENRMHTIKAVMVATLGE

SEQ ID NO: 9325 - protein, 70 aa, Enterobacter cloacae
SIANWAMVLRSSAPSWENSPPLPRKNRPSTPALIRSSISAAVPCLSSWPSAVKMVETGGMIPVNNADCGM

SEQ ID NO: 9326 - protein, 424 aa, Enterobacter cloacae
TPHMAHALFILKKVKGIIMEKHYVGSEIGQLRSVMLHRPNLSLKRLTPSNCQELLFDDVLSVERAGEEHDIFANTLREQGVEVLLLTDLLTQSLDIAEAKAWLLETQISDYRLGPTFAADVRGWLADMPHRELARRLSGGLTYGEIPAAIKNMVVDTHTANDFIMKPLPNHLFTRDTSCWIYNGVSINPMAKPARQRETNNLRAIYRWHPAFADGEFIKYFGDENINYDHATLEGGDVLVIGRGAVLIGMSERTTPQGVEFLANSLFKHRQAERVIAVELPKHRSCMHLDTVMTHIDVDTFSVYPEVVRKDAQCWTLTPDGRGGLLRTQETDLLHAIEKALGINQVRLITTGGDAFEAEREQWNDANNVLTIRPGVVIGYERNVWTNEKYDKAGITVLPIPGDELGRGRGGARCMSCPLERDGI

SEQ ID NO: 9327 - protein, 341 aa, Enterobacter cloacae
QFKKDFPMTINLKNRNFLKLLDYTPAEIQYLIDLAIELKAAKKAGREKQTLVGKNIALIFEKTSTRTRCAFEVGAFDQGAQVTYLGPSGSQIGHKESMKDTARVLGRMYDGIEYRGYGQAIVEELGEYAGVPVWNGLTDEFHPTQILADLMTMLEHSPGKTLPELSFAYLGDARNNMGNSLMVGAAKMGMDIRLVAPKSFWPEAGLVEQCRAIAKETGARITLTDDVEEGVQGTDFLYTDVWVSMGEPKEAWAERVSLMKPYQINAQVMKATGNPNVKFMHCLPAFHNEHTKVGREIEMAYGLKGLEVTEEVFESPNSIVFDEAENRMHTIKAVMVATLGD

SEQ ID NO: 9328 - protein, 235 aa, Enterobacter cloacae
PDHSHLCRRDGRAGYRPRALRALSEMGRAAAGDFNGGDYGGVKPGRFVVICRMALRLSGLRIGAVPPVISGTDMGTMMDYEEYSPKEQLQLTVCQRLIAEKSYLSQEEIRRDLQERGFETISQSTVSRLLKLLGVIKIRNAKGLKIYSLNPQLRPAPDAARTVSEMVVSVEHNSEFILIHTVAGYGRAVARILDYHQLPEILGVVAGSSIVWVAPRIVKRTALVHKQINYLLRTH

SEQ ID NO: 9329 - protein, 135 aa, Enterobacter cloacae
RCNSGEKMSKVLATENAPAAIGPYVQGVDLGSMIITSGQIPVNPKTGEVPADVAAQARQSLENVQAIVESAGLKVGDIVKTTVFVKDLNDFATVNATYEAFFTEHNATFPARSCVEVARLPKDVKIEIEAIAVRR

SEQ ID NO: 9330 - protein, 482 aa, Enterobacter cloacae
MKLSKIALAVTTLTVASSALAHGYIESPASRAYMCKLGQNIDCGSVQYEPQSVEKTSGFPTGAMPPDGQLASAGIASYSQLDKQSLNAWTKNPMTAGPHEFVWHHTAPHKTTNWRYYITKQNWDPNKPLTRDQFELTPFCTINGNGQAPAMTKSMTCNVPERTGYQVIYGVWEIADTANSFYQAIDVDFGNGGNVTPDDTPAVISQWSKTLSGQIAGNNLNTGDRVIARFFDANGEVAALRTELTIGSVAQGDTNQWSYDLAQKINAAYSDVRVGVKDEAGEISPVHGANSVFVKDGSALQSVAISYEEQKAEVNETIAVSNPHYSKIENGKASVTFHVNTKGDVNVEAHVMNHSGAEKGYLKQEMNNASQDVTMTLTDVTAGHHMLKYYATNKDGTLFAQDVLDLMLESDAADSNGPHDFIFPDNVASYKAGTVVLQPKDGKTYECRPVPFSGYCVQYSPTANQFEPGVGAHWREAWVLKD

SEQ ID NO: 9331 - protein, 325 aa, Enterobacter cloacae
LFYRCYREYSMQNRLTIKDIARLSGVGKSTVSRVLNNESGVSERTRERVEAVMNQHGFSPSRSARAMRGQSDKVVAIIVSRLDSLSENLAVQTMLPAFYEQGYDPIMMESKFSAQMVEEHLGMLQRRNIDGVVLFGFTGLKEDVLKPWQPSLVLLARDASGFASVCYDDEGAIVILMQRLYEQGHRHISYLGVPHADITTGKRRHEAYLAFCKKHNLPAVAALPGLGMKQGYEQVASVLTPQTTALVCATDTLALGASKYLQEQRIGELQLASVGSTPLMKFLHPEIISVDPGYAESGRQAAAQLIEQINGRAEPRQIVIPARLS

SEQ ID NO: 9332 - protein, 423 aa, Enterobacter cloacae
LSQEMRMLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLQPGDTVLGMNLAQGGHLTHGSPVNFSGKLYNIIPYGIDESGKIDYEDMAKQAKEHKPKMIIGGFSAYSGIVDWAKMREIADSIGAYLFVDMAHVAGLIAAGVYPNPVPHAHVVTTTTHKTLAGPRGGLILAKGGDEELYKKLNSAVFPSAQGGPLMHVIAAKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDDAVIERVKGKVLDICARFPVYA

SEQ ID NO: 9333 - protein, 401 aa, Enterobacter cloacae
RANDLLKSGINARLSPPFREGFMVLHSTRWLALSYFTYFFSYGIFLPFWSVWLKGIGLTPETIGILLGAGLVARFLGSLLIAPRVSDPSLLIKAVRILALLTLVFAVCFWVSHQFAWLMVVMVGFNLFFSPLVPLTDALANTWQKQITMDYGRVRLWGSIAFVIGSALVGKLVSLYDYRAILALLTLGIASMLLGMLLRPSVMPQGESRHQESAGWPAWRSLVAQSWRFLACVCLLQGAHAAYYGFSAIYWQGAGYSASAVGYLWSLGVVAEVIIFALSQKLFRRFGARDLLLLSAVCGVARWGIMGWTTELPWLIVAQILHCGTFTVCHLAAMRYIAAREGGDVIRLQAVYSAVAMGGSIAVMTVFAGFLYQHLGHGVFWVMALVALPAIVIRPKVAART

SEQ ID NO: 9334 - protein, 110 aa, Enterobacter cloacae
GLSMSITLSDSAAARVSSFLANRGKGFGLRLGVRTSGCSGMAYVLEFVDEPASDDTVFEDKGVKVVVDGKSLHFLNGTQLDFVKEGLNEGFKFTNPNVKDECGCGESFHV

SEQ ID NO: 9335 - protein, 631 aa, Enterobacter cloacae
TTRRKAARFLISEAIMALLQISEPGLSAAPHQRRLAVGIDLGTTNSLVATVRSGQAETLADEQGRHLLPSVVHYQQQGHAVGFDARANAARDPANTISSVKRMMGRSLADIQTRYPHLPYQLQASENGLPMIATAAGLLNPIRVSADILKALAERATATLGGDLDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYIREQAGISDRSDARVQRELLDAAIDAKIALSDAQSVSVNVAGWQGEITRDRFRELIAPLVKRTLLACRRALKDAGVEANEVLEVVMVGGSTRVPLVRERVGEFFGRTPLTSIDPDKVVAVGAAIQADILVGNKPDSEMLLLDVIPLSLGLETMGGLVEKVIPRNTTIPVARAQEFTTFKDGQTAMSIHVMQGERELVQDCRSLARFALRGIPALPAGGAHIRVTFQVDADGLLSVTAMEKSTGIESSIQVKPSYGLTDGEIASMIQDSMSYAEQDVKARMLAEQKVEAARVLESLNGALAADAALLSAAERQVIDDAAARLSAVAEGNDADAIEEAIKNVDKQTQDFAARRMDKSVRVALKGQSVDEV

SEQ ID NO: 9336 - protein, 1660 aa, Enterobacter cloacae
PTGPSGQGHRMKPFRLAAISLALLTTFTLVGCDNSDDKPQAAAPAASTASEQKTPATPDPEKLAKLAAQSQGKALTLLDASEVQLDGAATLVLTFSVPLDPSQDFAKTVHVVDKKSGKVDGAWELAPNLKELRLRHLEPNRNLVVTVERDLLALNKATFGIDYEKAITTRDVEPTVGFASRGSLLPGKVVEGLPVMALNVNNVDVNFYRVKPESLASFVSQWEYRNSLTNWESDNLLKMAELVYTGRFDLNPARNTREKLLLPLKDIKPLQQSGVYIAVMNQAGHYNYSNAATLFTLSDIGLSAHRYHNRLDIFTQSLENGAAQSGVTITLLNDKGQTLAEANSDADGHAKLETDKEAALILASKDGQTTLLDLKLPALDLAEFDIAGNPGYSKQFFMFGPRDLYRPGETVILNGLLRDSDGKPLPDQPVKLDVLRPDGQVARTVVVQPENGLYRFNYSLDSGAQTGMWHIRANTGDNQQRMWDFHVEDFMPERMALNLTGQKTPVSPQEDVDFNVVGYYLYGAPANGNSLQGQLFLRPLRDAVPALPGFQFGDIAEENLSRSLDEVQLTLDEQGRGQVTTESQWKEAHSPLQLILQASLLESGGRPVTRRAEQAIWPAAELPGIRPQFASKAVYDYRTDTTVNQPIVDENGNASFDIVYADASGAKKAVSGLQVRLIRERRDYFWNWSESEGWQSQFDQKDLVEGEQELNLKADETGKVTFPVEWGSYRLEVKAPDDMVSSVRFWAGYSWQDNSDGTGAARPDRVTLKLDKPSYQPGDTIQLHIAAPAAGKGYAMIESSEGPLWWKEIDVPANGLDLAIPVDKAWKRHDLYLSTLVVRPGDKSKSATPKRAVGLLHLPMGDENRRLNIALDNPQKMRPNQTLSVKVKASVKEGAVPQKVNVLVSAVDSGVLNITDYVTPDPWQAFFGQKRYGADIYDVYGQVIEGQGRLAALRFGGDGDELKRGGKPPVNHVTIIAQQAQPVTLDANGEGTITLPIGDFNGELRLMAQAWTEDDFGSSESKIIVAAPIITELNTPRFLASGDTSRLTLDLTNLTDQPQTLSIALTAAGKLSLEGAQPEPVKLPPGARSTLFIPVRALEGYGDGEVTAQVTGLQLPGETFAPQQKSWKIGVRPAFPAQTVNTGTMLNPGESWSAPAQHIEGFSPATLQGQLLLSGKPPLNLARYIRELQAYPYGCLEQTTSGLFPSLYTNAAQLKALGIKGDTDDKRRAAIDIGISRLLQMQRDDGGFALWDKNGPEEYWLTAYVTDFLVRAGEQGYSVPAEAVNNANSRLLRYLQDPGMMSIRYSDDTQASKFAVQAYASLVLARQQKAPLGALREIWERHAQAASGLPLMQLGMALKLMGDAPRSQQALDLALKTPRNDSRNWMADYGSQLRDNALMLSLLEEYKLLPDAQNRLLNALSEDAFSQRWLSTQESNALFLAGRSLQTLSGAWQATTSLSEQTQSSDKAQVENLNGDQIGALKMTNTGTTPLWVRLDTTGYPEYAPQPSSNVLQIERHILATDGSSKSLSSLKSGELVLVWLEVKASQNVPDALVVDLLPAGLELENQNLASSSASLQDSGSEVQNLLNQMQQSDIQHMEFRDDRFVAAVPVNEGQPVTLVYLARAVTPGTYQVPVPMVESMYVPQWRATGAASGPLIVVP

SEQ ID NO: 9337 - protein, 179 aa, Enterobacter cloacae
  UNSURE (179)
IICPSERDPMQLRKLLLPGLLSVTLLSGCSLFSGEEDVVKMSPLPTVENQFTPSTAWDTSVGDGIGDFYSNLHPAFADGVVYAADRKGTVKALNADDGKEVWSINLAEKDGWFSRKPALFYGGLTVTGGHVYVGSEKAQVYALNASVGSVAWQTTVAGESLSRPVFTTGNEHRRLHLHX

SEQ ID NO: 9338 - protein, 335 aa, Enterobacter cloacae
TVRAGGDVTMSVISSPVSKPRRWLHLWPLALFLLLAVGGALWLWQAWPQVMVKSVLWQREVNQQMSVLLKAVAENPTKAGGALLAFSFIYGVLHALGPGHGKIVITTWLATHPSKLKSSIGLTLASSLLQGGVAIALVVVVLSLLQLPARQLHMSSFWLEKGSYALVGVLGLILCWRALKKLRALLQKPKFKAFTPHHVHHENCGCGHQHLPTQEQLQNGDDWRARLMIVLSMGMRPCSGAIMVLLFSKVTGVFGWGMLSALAMAAGTSLTISSLALLVHSFRQLAVKLSGNKTPVLWRQVGWTTLALAGGVILLVAAVTMWMSALPVGRGLRPF

SEQ ID NO: 9339 - protein, 178 aa, Enterobacter cloacae
QATPEIVMDYFTLFGLPAQYPIDLQALTVRFQDLQRQYHPDKFASGTQAEQLAAVSHSATINQAWQTLRHPLARAEYLLSLHGFDLASEQHTVRDAAFLMEQLELREELDEIEQAKDEARLESFITRVKGMFDTRHQQMVEQLNNETWDVAADTVRKLRFLDKLRSSAEQLEEKLLDF

SEQ ID NO: 9340 - protein, 120 aa, Enterobacter cloacae
KASPWTRFNMPKIVILPHADLCPDGAVLEAKTGETILDVALRAGIEVEHACEKSCACTTCHCIVREGFDSLAESTEDEDDMLDKAWGLEPDSRLSCQAAVTDEDLVVEFPRYTINHAREH

SEQ ID NO: 9341 - protein, 780 aa, Enterobacter cloacae
SLFRKMRIARLIRSRWLWLAGALLVSGGLIVVADRVWPLPLKEVNPARVVVDEQGVPLWRFADSEGIWRYPVTIKEVSPRYLEALIQYEDRWFWDHPGVNPLSVLRAAWQDLTSGRVVSGGSTLTMQVARLLDPHPRTFGGKIRQLWRAMQLEWHLSKREILTLYLNRAPFGGTLQGVGAASWTYLGKPPSQLSYSDAALLAVLPQAPSRLRPDRWPERAEAARNKVLDRMLTQGVWSEKQVKESREEPVWLAPRQMPQLAPLFSRMMLSKSRDTKIVTTLDAALQRQLEELAMNWKSRLPARSSLAMIVVDHTSMKVRGWVGSVDINDDSRFSHVDMVNAIRSPGSVLKPFIYGMALDDGLIHPASLLQDVPRKTGDYRPGNFDSGFHGPVSMSEALVRSLNLPAVQVLEAYGPKRFAGMLSNAGLPLILPAGAQPNLSLILGGAGARLADIAAAYSAFARQGKAGRLRLQPGDPLIERPLLSQGAAWIIRRILANEAQPLPDSALPQVAPLAWKTGTSYGYRDAWAIGLNARYVIGIWTGRPDGTPVAGQFGFASAVPLLNQVNNMLQSRSMVDEARLPRDPRPASVGRGVICWPGGQSLPEGSENCRRRLSTWLLEGSEPPTLLLPEQEGIRGIRFPVWLDKEGKRVAADCPDATEKVLDVWPLPLEPWLPAAEKRAARLPARSAICPPLDNHNAAPLMLSGVREGAVIKRLPGEKNITLNVSTSGGEGQRWWFLNGEPLDGHQKNYSLQLYLPGKYQLIVLDETGQTATVNFELDR

SEQ ID NO: 9342 - protein, 210 aa, Enterobacter cloacae
SMSQFKHYAPVSDKQLGFYIDSSRCSGCKACQVACKDKNNLEVGRRFRRVYEVNGGNFIPTGQGGVSNNVFAYTLSISCNHCADPICTKNCPTTAMHKRPGDGIVRVDTDKCVGCGYCAWSCPYGAPQLNEQTGQMSKCDFCVDLQAKGEQPVCVATCPLEAIKFGPIDELRAKYGAVCDVKGLPDSSITKPNLVIKAHQGAEKEGKRHA

SEQ ID NO: 9343 - protein, 303 aa, Enterobacter cloacae
ADAALCFLQYWLMGGLTFAPAMDVTHACVRRRFRHSSCLACADVCPVQAFSFTDSGVSVDDSRCIECGDCLFVCPAGAITGITPRKRFLSGDTLVGPFTDRAPGVNELLLWHAQYHVRFISIDAEQNPDWLLAIARLNLALRRRGEAAWAFKHIPVNEVNTARRALMHVPREDVRVCSVVPGQRDLRRAFSAFSEAEITLDTESCVLCGACWRSCTENAIRFQNTELVVETGRCTGCGGCVAVCQHAAINVTQTEGTAKSVTIPAYEAVCLTCHRHFWSFTSDEKQCPLCFHHQHGMRNTSCC

SEQ ID NO: 9344 - protein, 389 aa, Enterobacter cloacae
CRTISSTVTDGQCGRFYMHNQAPIQRRKSKRIYVGNVPIGDGAPIAVQSMTNTRTTDVEATVNQIKALERVGADIVRVSVPTMDAAEAFKLIKQQVSVPLVADIHFDYRIALKVAEYGVDCLRINPGNIGNEERIRMVVDCARDKNIPIRIGVNAGSLEKDLQEKYGEPTPQALLESAMRHVDHLDRLNFDQFKVSVKASDVFLAVESYRLLAKQIDQPLHLGITEAGGLRSGSVKSAIGLGLLLSEGIGDTLRVSLAADPVEEIKVGFDILKSLRIRARGINFIACPTCSRQEFDVIGTVNALEQRLEDIITPMDVSIIGCVVNGPGEALVSTLGVTGGNKKSGLYEDGVRKDRLDNSDMIDQLEARIRAKATMMDEAQRISVQQVEK

SEQ ID NO: 9345 - protein, 440 aa, Enterobacter cloacae
LNPFFGFFFVYRKRINVAKNIQAIRGMNDYLPGETAIWQRIEGTLKQVLGSYGYSEIRLPIVEQTPLFKRAIGEVTDVVEKEMYTFEDRNGDSLTLRPEGTAGCVRAGIEHGLLYNQEQRLWYIGPMFRHERPQKGRYRQFNQLGVEVFGLQGPDIDAELIMLTARWWRALGISEHVSLELNSIGSLEARANYRDALVAFLEQHKEKLDEDCKRRMYSNPLRVLDSKNPDVQALLNDAPALGDYLDEDSREHFAGLCKLLEAAGIAYTVNQRLVRGLDYYNRTVFEWVTTSLGSQGTVCAGGRYDGLVEQLGGRAAPAVGFAMGLERLVLLVQAVNPEFKADPVVDIYLVASGADTQSAAMQLAERVRDALPDVKLMTNHGGGNFKKQFARADKWGASIALVLGESEVANGEVVVKDLRSGEQTTVTQDGVAAHLRTLLG

SEQ ID NO: 9346 - protein, 216 aa, Enterobacter cloacae
REEQMQIVKQSAVALFLAVFTFAAGAHPHSFISLKTELVTDGTQLSGLKMHWTMDEITSADLLYDAGNAKPGDEIWKKLAAEVMANVLGQHYFTEFWHNGQKVKFLNRPTEYGMTREGHQAVLTFVLPLAHPQPLPGQTYRFSTFDPTYYVDMRYDKDSDVRLPDALQKSCKIGVHTPKPSEETLNFAISLDKADAPPEDMELGKQFAQEVTLQCQ

SEQ ID NO: 9347 - protein, 268 aa, Enterobacter cloacae
QRDRIMSLVYDNMPEYSSDTESRHLKIMLQNIRIVLVETSHTGNMGSVARAMKTMGLTNLWLVNPLVKPDSQAIALAAGASDVIGNAQIVDTLDEALAGCSLVVGTSARSRTLPWPMLDPRECGLKSISEAEQAPVALVFGRERVGLTNEELQKCHYHVAIAANPEYSSLNLAMAVQVIAYEVRMAWLATQEKPVEPKEETAYPLVDDLERFYGHLEQTLLSTGFIREGHPGQVMNKLRRMFTRARPESQELNILRGILASIEQKNKA

SEQ ID NO: 9348 - protein, 164 aa, Enterobacter cloacae
DMRLTSKGRYAVTAMLDVALNSEAGPVPLADISERQGISLSYLEQLFSRLRKNGLVSSVRGPGGGYLLGKDAGSIAVGEVISAVDESVDATRCQGKGGCQGGDKCLTHALWRDLSDRLTGFLNNITLGELVNNQEVLDVSGRQHSQDSQRSTRTQDAIDVKLRA

SEQ ID NO: 9349 - protein, 439 aa, Enterobacter cloacae
VFRIRPGWSHPAYSVVHPAGCLIPCIEAMYGVYRAMKLPIYLDYSATTPVDPRVAEKMMQCLTLDGNFGNPASRSHRFGWHAEEAVDIARNQIADLVGADPREIVFTSGATESDNLAIKGAANFYQKKGKHIITSKTEHKAVLDTCRQLEREGFEVTYLAPQSNGIIDLKELEAAMRDDTILVSIMHVNNEIGVVQDIATIGEMCRARGIIYHVDATQSVGKLPIDLSQLKVDLMSFSGHKIYGPKGIGALYVRRKPRIRIEAQMHGGGHERGMRSGTLPVHQIVGMGEAYRIAKEEMETEMARLRTLRNRLWDGVKDMEEVYLNGDLEQGAPNILNVSFNYVEGESLIMALKDLAVSSGSACTSASLEPSYVLRALGMTDELAHSSIRFSLGRFTTEEEIDYTIKLVRNSIGRLRDLSPLWEMFKQGVDLNSIEWSHH

SEQ ID NO: 9350 - protein, 136 aa, Enterobacter cloacae
SVHKENSIMAYSEKVIDHYENPRNVGSFDNSDESVGSGMVGAPACGDVMKLQIKVNNEGIIEDARFKTYGCGSAIASSSLVTEWVKGKSLDEAQAIKNTDIAEELELPPVKIHCSILAEDAIKAAIADYKSKREAK

SEQ ID NO: 9351 - protein, 87 aa, Enterobacter cloacae
PMKIWSWSSHATPSTTHASTNMGLKWTDSREIGEALYDANPDLDPKTVRFTDMHQWICDLEDFDDDPNASNEKILEAILLVWLDEAE

SEQ ID NO: 9352 - protein, 435 aa, Enterobacter cloacae
LLIRINKMTEAMKITLSNQPADARWGEKATYSINNDGITLHLTGNDDLGLIQRAARKIDGLGIKHVSLEGEGWDTDRSWAFWAGYKGPKGTRKIEWANLDEAGQKELESRLNIIDWVRDTINAPAEELGPEQLAQRAVDLLCGVAGEKMSYRITKGEDLREQNYMGIHTVGRGSERPPVLLALDYNPTGDKEAPVFACLVGKGITFDTGGYSLKQSAFMDSMKSDMGGAATITGALAFAITRGLNKRVKLYLCCADNMVSGNAFKLGDIIRYRNGKNVEVMNTDAEGRLVLADGLIDASAQKPELIIDMATLTGAAKTALGNDYHALFSFDDKLAARLLASAAAENEPFWRLPLAEFHRSQLPSNFAELNNTASAAYPAGASTAAGFLSHFVENYHEGWLHIDCSATYRKAAVEQWSAGATGLGVRTVANLLTAE

SEQ ID NO: 9353 - protein, 267 aa, Enterobacter cloacae
GGNSTSGITMSETKNELETLLEQAATEPAHRPAFFRTLLESTVWVPGTAAEGEQVVEDSALDLLHWEKDDGTSVIPFFTSLEALQEAVEDEQAFVVMPVRTLFEMTLGQTLFLNAKLPTGKEFTPREISHLIGDEGNPLSTQEVLEGGETLLLSEVAEPPAQMIDSLTTLFKTIKPVKRAFLCSIKESADEKPVLLIGIEADGDVDEIIQAAGSVATDTLPGDEPIDICQVKKGEKGISHFITEHITPFYERRWGGFLRDLKTNRII

SEQ ID NO: 9354 - protein, 805 aa, Enterobacter cloacae
KKTRMRFYLKERAMKKNKHQGEGLIPAISRRHFIQAGSALAALPFVVKTGKVQAQDAAVSDATPEEKVVQTCSTFDCGGKCDIRAHVSDGVVTRISTRPDNALDPQMPVMRACVRGRAYRKFVYHPDRLKYPMKRVGKRGEGKFERITWDEATTLIANQLKTITQKYGAASRYVHVGTAVSGGTFSGDKMVRRLLNLTGGYLESYHSVSMGNTAAATPYTYGTAASGSSLDTLLDTKLVILWGHNPTETIFGHSNHFYQKMKQNGTRFIVVDPRYSDTVSSLADQWIPLLPATDNALMDAMMYVIVTENLHDRDFIQRYTLGFDEDAMPEGVPANESLMAYLSGAKDGVAKTPEWAEKITHVPAQTIRQLARDYATTKPAALIQGWGPQRHNCGERTARGSTILATLTGNVGVKGGWAAGYGGCANRKFAAGPEMPDNPVKAKISVMNWVQAADDASKVTAEDGLKDAEKLDSNIRILFSLAGNYLANQNPDLHQATRVLEDESKIEFIVASDLFMTPSARYADLLLPETSFMERWNIGETWGTASYLILSEKLIEPEFERRSDYDWLREVAAKLGVEPAFSEGRDEKAWIEHIWEQTRLSMPDENLPDFATLQKTRQHLFKSAPYVAFEDNIRDPQNHPFPTPSGKIEIFSKRLYDMHHPEIPALSHYVPAHEGPEDELAKTFPLQLITWKGKNRANSTQYANPWLIEAQQQKLWINPQDAQKRGIAQGDTVRIHNARGICEIPAEVTPRIIPGVVAMQAGAWWQPDEQGIDKGGCANVLSSARITALAKGNSHQTMLVEVAKA

SEQ ID NO: 9355 - protein, 272 aa, Enterobacter cloacae
SKRIRAQRKRGNVMHELPLLIFTLFLQGSVGVTLWLAFGSTQRSVLLPAAGAFVLASLGLLASALHMGYPLNALNALRHVSSSWLSREIIFASLYLAALGFATLLMIVKKPGWKPLLVVSGLVGLVDVFCMAQIYMHASVVTWQHVNTLVLFIGSVGIIGSACMVVGTRSQSTVRAAVVIITLLVLVRLVMQPVWLADITSMDHTVVTFPHAPLQMLEQLRTVHLLSWCVSVAGMLCFAAGGLKAARSPILLGGALLIVGELMLRFVFFSIG

SEQ ID NO: 9356 - protein, 171 aa, Enterobacter cloacae
AMALLLFIIRATPYSGMQKQQNILQRLSMAIERTFSIIKPNAVAKNVIGSIFARFESAGFKIVGTKMLHLTVEQARGFYAEHEGRPFFDGLVEFMTSGPIVVSVLEGENAVQRHRDLLGATNPDNALAGTLRADYADSFTENGTHGSDSVESAAREIAFFFAEGEVCPRTR

SEQ ID NO: 9357 - protein, 436 aa, Enterobacter cloacae
FRKCRVQTWHPCARLCTMQRPGRADCLPGRFFSTHQGPQRVTTRPEKIMSELVNTSEVAIPAVPNKNGKINLLDLNRQQMREFFKEMGEKPFRADQVMKWMYHYCSDNFDDMTDINKVLRNKLKEVAEIRAPEVVEEQRSSDGTIKWAIAVGDQRVETVYIPEDDRATLCVSSQVGCALECKFCSTAQQGFNRNLRVSEIIGQVWRAAKIVGAAKVTGTRPITNVVMMGMGEPLLNLTNVVPAMEIMLDDFGFGLSKRRVTLSTSGVVPALDKLGDMIDVALAISLHAPNDAIRDEIVPINKKYNIETFLAGVRRYLEKSNANQGRVTIEYVMLDHVNDGTEHAHELAELLKDTPCKINLIPWNPFPGAPYGRSSNSRIDRFSKVLMEYGFTTIVRKTRGDDIDAACGQLAGDVIDRTKRTLRKRMQGESIAVKTV

SEQ ID NO: 9358 - protein, 336 aa, Enterobacter cloacae
RMNTEATHDQNAALSTGVRLRNAREQLGLSQQAVAERLCLKVSTVRDIEEDKAPADLASTFLRGYIRSYAKLVHIPEDELLPMMEKQAPVRAAKVAPMQSFSLGKRRKKRDGWLMSFTWLVLFVVVGLTGAWWWQNHKAQQEEITTMADQSSAELNQSGNNGAQSVPLSTEGATSSEPQSAASNTPATEPAATPEATTNTAPATQTQDQNAVVSPSQANVDTAPAATAPAENTAASLPTDPAGTAAPAVDPNALVMNFTADCWLEVTDATGKKLFSGLQRKDGTLNLTGQAPYKLKIGAPAAVQIQYQGKPVDLSRFIRTNQVARLTVNAEQSAAQ

SEQ ID NO: 9359 - protein, 225 aa, Enterobacter cloacae
RRMALRRTCALYWAKEKDCVEIYENEHDQVDAVKRFFAENGKALVVGVILGVGALVGWRYWNNHQADSARGSSLNYENTVSAIRADQPQTLTAAEKFAADNKNTYGALAALEVAQQYVDKNELDKAAAQLSQGLAAASDDNLKAVINLRLARIQVQQKKADDALKTLDTIKGEGFAAIVADLRGEALLSKGDKAGARKAWQAGVDSKASPALSEMMQMKINNLSV

SEQ ID NO: 9360 - protein, 316 aa, Enterobacter cloacae
SGEKIGACSRVERGELVGVRKNTDNPFLRKRMEATMSTSYFVAADWLIEHGDDPEVQIIDARMAPPGQEHRDVPAEYRAGHLPGAVFFDIEALSDHTSSLPHMLPRPEAFSVAMRELGISKDKHLIVYDEGNLFSAPRAWWMLKNFGVEKVSILAGGLAGWKRDELPLQQGDVTLPEGEFDATFDANVVKRLTDVLVVSHENTAQIVDARPAPRFNAEADEPRPGLKRGHIPGALNVPWGDLVFEGELKTTDELRAIFERQGVDLHRPVIASCGSGVTACVVILALATLDANDVTLYDGAWSEWGARDDLPVEPAK

SEQ ID NO: 9361 - protein, 450 aa, Enterobacter cloacae
KACRCAFQRPSFSYSYQTFTLDTRQMMTTLEIPSVLSSSQRRCQVLLMLYLPDAAVTAQSIIAANGVDDVMARQDIAETRDEIQRYHRLDIVTHHDGCYRIEGSALNQRLCLLHWLRRALRLCPHFVAQQFTPALKTALKQHGIARPLYDDANLRALINFCARKLQRQFESRDVQFLQLYLQYCLIQHHLGNTPEFSPVQRSWTLSRGEYFTAQEIVRHWKRRVPQGTHSDEQLFLALLFMMLRTPDPVMDKHQQDQRLRRAIVRMIARFRAQTGMNFSDEQGLTDQLYIHLAQALDRSLFDIGIDNSLPEEIHRLYPRLLRTTKEALFELEAEFGLRFSGEEMALVAVIFGAWLMQETDLHEKQVVLLTGENKACEELIEQQLRELTLLPLNIRYLSLEAFKKEGAPREAALVITPYPTALPLFSPPLIHAVETLNTQQQEHIRVMLES

SEQ ID NO: 9362 - protein, 523 aa, Enterobacter cloacae
VRGSIREKAMKRAVNALQNFGKSLYGPVLILPIVGLFIAFGNVLGNGNLAEYMPFLGHPLIQSVGQLIAKSAVSVLVNLALVFAVGIPIGLATRDKGYAALIGLVTFIVFINAMNVTLQLQGELAPAEQMKAAGQSMVLGVQVLEMGVFAGILTGALSGYLYNKYSGVQFNGAMAIYSGHCFVAIVMLPVSMLLGVIMSELWPYAQHGISALALAIKGSGPFGVAIYGFLERILVPTGLHHLVYTPFLYTELGGTQEVCGTAYQGARNIYFAEMACPDVKQLSSTVVWDARGISKMFGLPAAALAMYMTAKPERKAIAKAILIPAALTSLLVGVTEPIEFSFLFVAPLLFVVHAVLTGIGMMLFSLFGVHAIGANGIIDFILYNLPLGTEKSNWPMYIVVGLIMFALYFVVFRFLILRFNMKTPGREDEDQETRLYSKQEYQAKGNNDGLGESIVVGLGGRENIEVVDNCYTRLRVTVKDVAIIDEPRLKATGAKGIIKQGNNVQVVYGLHVKKMREAVETFL

SEQ ID NO: 9363 - protein, 459 aa, Enterobacter cloacae
KELKMFTPPFILSIAGGGSTYTPGIVKSLMVRLHDFPLAEIRLYDIDEARQNTIAPVVEKVIRDHSQSIKFTVTSDPEVAFSGAHFVFAQMRVGQYKMREQDEKIPLRHGVVGQETCGPGGLAYGLRTILPMVELIDLVDRYAHEKAWIVNYSNPAAIVAEGVRRLRPNARVLNICDMPVAAMRNMGAILGVDRHKLEVDYFGLNHFGWFTRVLVDGEDKLPELRKHIAKFGLLTEDAAKTDPQHSDPSWVKTWRNIKPIMDNFPEYLPNPYLQYYLMPNQIVEHQNPDYTRANEVMNGREKKLFAAAEEYQRTGILPDAFHVGVHGEFIVDVACSLAFNLRSRHLVMVENRGAITNLPYDAVVEVPAYITSEGPEPVRVGQVPLFHQTLLQQQLASEQLLVEATIEGSYEKALQAFTLNRTVPTMEHAKAILDEMIEANRDYWPALQKAWQDGEAVKK

SEQ ID NO: 9364 - protein, 270 aa, Enterobacter cloacae
ERPMHPMLTIAVRAARKAGNVIAKHYETPDSVETSQKGSNDFVTNVDKAAEAIIIETIRKSYPQHTIITEESGEHEGTDQDVQWVIDPLDGTTNFVKRLPHFSVSIAVRIKGRTEVAVVYDPMRNELFTATRGQGAQLNGYRLRCSNARDLDGTILATGFPFKAKQHATTYMNILGKLFTECADFRRTGSAALDLAYVATGRVDGYFELSLKPWDFAAGELIAREAGAIVCDFTGGHNYMSTGNIVAGNPRVVKAMLANMRDELSDALKR

SEQ ID NO: 9365 - protein, 155 aa, Enterobacter cloacae
NCITFIRHRLKRSFAMNSLRYFDFGSSRSLLLLIARIAIVVLFIIFGYPKLTGFSGTVQYMTSLGAPMPMLAAIIAVVMEVPAAILIVLGFFTRPLAVIFVFYTLGTAVIGHHYWDMTGDAVLPNMINFYKNVSIAGAFILLAITGPGAISLDRR

SEQ ID NO: 9366 - protein, 260 aa, Enterobacter cloacae
TGEIMDNRLATLLTRGSSLTRAEYRVLAHLTEHPLLVGNITVRELAQATFVSTATIMRLCQKLGFSGFSEFIWHCKQLLSDTPHITVQPEQHAEMPALFTRFVANYQQTFQWVTQDKRQQFASLLRQKESFFLYGAGFSYLFAEYLTKKLQVLGKTAFISGAGDSRNIFLSNAARYQVFIAVSRSGETEQVLDKARIAKNVGMTIVAFTRASANTLAGMADVHFALYDEAVHFAAEAAGVTSFESNLVLLMDLLLLEATG

SEQ ID NO: 9367 - protein, 148 aa, Enterobacter cloacae
KMSVSTARCKHMSNQRNPDDLKKNLTEMQFYVTQNHGTEPPFSGRLLHNKREGVYHCLVCDAPLFNSQTKYDSGCGWPSFYEPVSDDAIRYLTDTSHGMVRTEIRCGNCDAHLGHVFPDGPQPTGERFCVNSASMSFTDDENGDQIKG

SEQ ID NO: 9368 - protein, 184 aa, Enterobacter cloacae
PMDALELLVNRRSASRLAEPAPVGEQLENILRAGMRAPDHGTLQPWHFFIIEGEGRGRFSQLLEQGAVAAGQDEKAIDKARNAPFRAPMIIAVVTKCQADHKVPVWEQEMSAGCAVMAMQMAAVAQGFNGIWRTGPLTESSVVRDGFACGEHDKIVGFLYLGTPQLKASSTISVPDTTPFVSRF

SEQ ID NO: 9369 - protein, 641 aa, Enterobacter cloacae
LRSVNSMRLFIAEKPSLARAIADVLPKPHRKGDGFIECGNGQVVTWCIGHLLEQAQPDVYDSRYARWNLNDLPIVPEKWRLQPRPSVTKQLNVIKRFLHEATEVVHAGDPDREGQLLVDEVLDYLELAPEKRQQVQRCLINDLNPQAVERAISRLRANSEFIPLCVSALARARADWLYGINMTRAYTILGRNAGYQGVLSVGRVQTPVLGLVVRRDEEIENFVAKDFFEVKAHIVTPKDERFTAVWQPSDACESYQDEEGRLLHRPLAEHVVNRITGQPAIVTSYNDKRESEPAPLPFSLSALQIEAAKKFGLSAQNVLDICQKLYETHKLITYPRSDSRYLPEEHFAGRHSVMNAIGVHAPDLLPQPAVNPDTHNRCWDDKKVDAHHAIIPTARTSNVNLTDNEAKVYNLIARQYLMQFCPDAVFRKCVIELDIAKGKFIAKARFLAEAGWRTLLGNKERDEENDGTPLPVVAKGDELLCEKGEVVERQTQPPRHFTDATLLSAMTGIARFVQDKDLKKILRATDGLGTEATRAGIIELLFKRGFLEKKGRYIHSTEPGRALIHSLPELAARPDMTAHWESVLTQISEKQCRYQDFMQPLVGTLYQLIDQARSTPVKRFRGMVAPGAGAKKPFKKKKSAA

SEQ ID NO: 9370 - protein, 211 aa, Enterobacter cloacae
LIAKNDILSCPSKESSHQENQVKEISAWVAPMETLPVSLSPIAAMQKKHFGAVLNPTRWWGRMPRLFWLVALFVGYLERRKARLTPVLRSLLMTRVSQICHCAFCIDANSLRLAERSGALDKVQAVSDWQNSTLFSEEERAALAYAEAVTATPPEVDENIKSLLKRHFTEETITEMTALIAFQNLSARFNAALDIPTQGLCATFKGKPHAG

SEQ ID NO: 9371 - protein, 416 aa, Enterobacter cloacae
TTFYLPDEVAMSLSVTRENFDEWMMPVYAPAAFIPVRGEGSRLWDQQGKEYIDFAGGIAVNALGHANPALRQALNDQAAKFWHTGNGYTNEPALRLAKKLIDATFAEKVFFCNSGAEANEAALKLARKYAHDKFGAHKSGIVAFKNAFHGRTLFTVSAGGQPSYSQDFAPLPPDIRHAAYNDLHSASELIDDTTCAVIVEPMQGEGGVMPAQKAFLQGLRELCDRHNAVLIFDEVQTGVGRTGELYAYMHYGVTPDVLSTAKALGGGFPVGAMLTTEKFASVMTVGTHGTTYGGNPLATAVAGQVLDIINTPEVLNGVKQRHQWFVERLTAINSKTGLFKEIRGLGLLIGCELAPEFAGKAKLISQEAAKQGVMVLIAGANVVRFAPALIVSEEEVRTGLDRFALACEQVKSGVSS

SEQ ID NO: 9372 - protein, 171 aa, Enterobacter cloacae
LKVRKDIMRKLTALFVASTLALGATSMAFAADTATTTAAPTEGKMMMHHKGKPGMHHEMMMFKDLNLTDAQKQQIRDIMKSQRDQMKRPPLEERRAMHDIIASDSFDKAKAEAQIDKMAEQHKARMLAHMETQNKIYNILTPEQKKQFNANFEKRLTERAAPEGKMPAPTE

SEQ ID NO: 9373 - protein, 112 aa, Enterobacter cloacae
PNKREVIMEKKHIYLFCSAGMSTSLLVSKMRAQAEKYEVPVVIEAFPETLAGEKGQTADVILLGPQIAYMLPEIQRLLPNKPVEVIDSVLYGKIDGLGVLKAAVAAIKKAAN

SEQ ID NO: 9374 - protein, 457 aa, Enterobacter cloacae
YAKGDIMQQKLKVVTIGGGSSYTPELLEGFLKRYHELPVSELWLVDVEEGQEKLNIIFELCKRMVEKAGVPLTMHKTLDRRLALKDADFVTTQLRVGQLKARELDERIPLSHGYLGQETNGAGGLFKGLRTIPVIFDIIKDVEEICPNAWVINFTNPAGMVTEAVYRHTGFKRFIGVCNIPIGMKMFIRDVLELTEHDDLSIDLFGLNHMVFIKDVIVNGQSRFAELLDGVASGRLTAASVKNIFDLPFSEGLIRSLNLLPCSYLLYYFKQKEMLAIEMGEYYKGGARAQVVQKVEKQLFDLYKDPNLNVKPKELEQRGGAYYSDAACEVINAIYNDKQAEHYVNVPHHGHIDNIPADWAVEMTCILGREGAKPHPRITHFDDKVMGLIHTIKGFEVAASNAALSGELNDVLLALNLSPLVHSDRDAEKLASEMILAHEKWLPNFAATVEKLKLTHR

SEQ ID NO: 9375 - protein, 189 aa, Enterobacter cloacae
AQITRLYEEELMTYQQAGRIAVLKRVAGWVIFIPALISTLISVLKFMYDHSEKQPGINAVMLDFAHVMIEMMRFNTPFLNVFWFNSPTPDFHHQLNVGFWIIYALIFIAMALQASGARMSRQTRFLREGFEDQLILEKAKGPDGMSREQIESRIVVPRHTIFVQFFPLYILPVIIIVAGYFFFTLLGFL

SEQ ID NO: 9376 - protein, 311 aa, Enterobacter cloacae
NKTRFGIVLIQKMKEENIAMLFAAFYNLLPFYGRLVIDPQESFRDRDGLFLCCTDSLNKMKLLKTVPAALMLAGGVFASLNATADDTVFTVMDDPSTAKKPFEGNVNAGYLAQSGNTKSSSLTADSTLTWYGNTTAWSLWGNASNTSANDQRSSEKYAVGGRSRYNMTDYDYLFGQASWLTDRYNGYRQRDVVTAGYGRQFLNGPVHSLRFEFGPGVRYDEYTNGEDETQPLGYASGTYAWQMTDNAKFTQGVSVFGAEDTTLNSESALNVAINEHFGLKVAYNVTWNSSPPDSAPEHTDRRTTISLGYKM

SEQ ID NO: 9377 - protein, 645 aa, Enterobacter cloacae
GYKMPVITLPDGSQRHFDHAVSPMDVALDIGPGLAKATIAGRVNGELVDASDLIESDATLAIITAKDEEGLEIIRHSCAHLLGHAIKQLWPNTKMAIGPVIDNGFYYDVDLDHTLTQEDIDALEKRMHELAETNYDVIKKKVSWHEARETFVKRGESYKVSILDENIAHDDKPGLYHHQEYVDMCRGPHVPNMRFCHHFKLMKIAGAYWRGDSNNKMLQRIYGTAWADKKALNAYLQRLEEAAKRDHRKIGKQLDLYHMQEEAPGMVFWHNDGWTIFRELETFVRSKLKEYQYQEVKGPFMMDRVLWEKTGHWDNYKDAMFTTSSENREYCIKPMNCPGHVQIFNQGLKSYRDLPLRMAEFGSCHRNEPSGALHGLMRVRGFTQDDAHIFCTEDQVREEVNACIRMVYDMYSTFGFEKIVVKLSTRPEKRIGSDETWDRAEADLAVALEENGIPFEYQLGEGAFYGPKIEFTLYDCLDRAWQCGTVQLDFSLPQRLSASYVGEDNERQVPVMIHRAILGSLERFIGILTEEFAGFFPTWLAPVQVVVMNITDSQADYVKELTQKLQNAGIRVKADLRNEKIGFKIREHTLRRVPYMLVCGDKEVEAGKVAVRTRRGKDLGSLDVSEVIEKLQQEIRSRSLQQLEE

SEQ ID NO: 9378 - protein, 106 aa, Enterobacter cloacae
GIKGGKRVQTARPNRINGEIRAQEVRLTGLEGEQLGIVSLREAIEKAEEAGVDLVEISPNAEPPVCRIMDYGKFLYEKSKSSKEQKKKQKVIQVKEIKFRHVFTSR

SEQ ID NO: 9379 - protein, 234 aa, Enterobacter cloacae
LPFRIFPPALTPRWISRLRGCAPRLKVNHMLDKHLHPRLKPGLNQLAAALDKPFITPDGLTLAGFAIGVLALPFLALGWYPAALIAIVLNRLLDGLDGALARRRGLTDAGGFLDIALDFLFYALVPFGFALAAPADNAIAAAWLLFAFMGTGSSFLAFAALAGKHDIDNPGYAHKSLYYIGGLTEGTETIALFVLCSLFPAHFALFAWVFGALCWLTTTTRIWSGYITLKSLPR

SEQ ID NO: 9380 - protein, 499 aa, Enterobacter cloacae
GENSMTLWINGDWVTGEGDARTKTNPVGQEVLWSGNDASAGQVEQACQAARRAFPAWAKRPFSERQALVEKFAALLEANKAELTRIIACETSKPRWEATTEVTAMINKIAISVKAYHTRTGEQHTEMPDGAATLRHRPHGVLAVFGPYNFPGHLPNGHIVPALLAGNTVIFKPSELTPLTGEAVVKLWEQAGLPPGVLNLVQGGRETGQALSALSDIDGLLFTGSAGTGYQLHRQLAGQPEKILALEMGGNNPLIVEDPEDIDAAVHLTIQSAFITAGQRCTCARRLLVKRGAQGDAFLKRLVEVSARLVPAKWDAEPQPFIGGLISGQAALNVLKAWQEHVARGAKTLLEPKLVQPGTSLLTPGIIDMSATSNVPDEEVFGPLLCVWRYDDFESAIEMANNTRYGLSSGLISPHREKFDQLLLEARAGIVNWNKPLTGAASTAPFGGVGASGNHRASAWYAADYCAWPMASLETPALTLPETLNPGLDFTEGDAHESA

SEQ ID NO: 9381 - protein, 119 aa, Enterobacter cloacae
TRGRNMNKNVAGILSAAAVLTMLAGCTAYDRTKDQFTQPVVKDVKKGMTRSQVAAIAGKPSSEVTMIHARGTCQTYILGQRDGKAETYFVALDDTGHVINSGYQTCAEYDTDPQAPKAQ

SEQ ID NO: 9382 - protein, 96 aa, Enterobacter cloacae
KGEIMNIDDMIAGMTPEVYQRLVTAVELGKWPDGVALTPEQKENSLQLVMLWQARHNTDAQHMTIDTNGQMVMKSKRELKEDFGITPKPIATMKMQ

SEQ ID NO: 9383 - protein, 351 aa, Enterobacter cloacae
QETSMSEQTIRLTQYSHGAGCGCKISPKVLETILHSEQAKFVDPNLLVGNETRDDAAVYDLGNGTSIISTTDFFMPIVDNPFDFGRIAATNAISDIFAMGGKPIMAIAILGWPINNLPPEIARDVIEGGRFACQQAGIALAGGHSIDAPEPIFGLAVTGVVPTERVKRNSTAQPGCKLFLTKPLGIGVLTTAEKKSLLKPEHIGLATEVMCQMNLAGAAFANIDGVKAMTDVTGFGLLGHLSEVCQGAGVQAQVRYQDVPKLPGVEEYIAQGALPGGTQRNFASYGHLMGEMPEAWRNLLCDPQTSGGLLLAVTPEAEADVQATAAEFGITLTAIGELVTARGGRPMIEIR

SEQ ID NO: 9384 - protein, 113 aa, Enterobacter cloacae
RDTLKIPSGSTVIDINDAKETKSMNRYAMAALCLMVSAGAQADRIRPDVEVNVPPEVFSAGGQRAQPCNQCCIYQDQNYSEGAVVRADGVLLQCQRDERTLSTNPLVWRRVKE

SEQ ID NO: 9385 - protein, 379 aa, Enterobacter cloacae
RGALCPCADRQRGRGQNWLRSFCAGLRTGEVRGVIMMVIRPVAHGDLAGLMQLAGKTGGGLTSLPADEKTLSARIERALQTWQGTLPKSEQGYVFVLEDTDTGTVAGICAIEVAVGLNDPWYNYRVGTMVHASKELNVYNALPTLFLCNDHTGASELCTLFLDPDWRKEGNGYLLSKSRFMFMAAFRDRFNEKVVAEMRGVIDETGYSPFWESLGERFFSMEFSRADYLCGTGQKAFIAELMPKHPIYTHFLTPEAQAVIGEVHPQTAPARAVLEKEGFRYRNYVDIFDGGPTLECDIDRVRAIRKSRLVEVSECQPAPGEWPACLVSNENYTNFRAMLVRTNPSCERLVLTAAQLDALKCNAGDTVRLVRLCPEEKTA

SEQ ID NO: 9386 - protein, 452 aa, Enterobacter cloacae
IRGWILLRVTPMKAREVNFDGLVGLTHHYAGLSFGNEASTKHRFQVSNPKLAAKQGLLKMKALSDAGFPQAVIPPQERPNVAVLRQLGFSGTDEQVVEKAGTQTPHLLSAASSASSMWVANAATVAPSADTLDGKVHLTVANLNNKFHRASEAETTGRVLRAIFNHDAHFEVHSALPQVAMFGDEGAANHNRLGGDYGEPGLQLFIYGREEGGHAAPVRYPARQTLAASQAVARLNQVNPSQVIFAQQNPQVIDQGVFHNDVIAVSNRQVLFCHEQAFAHQEKLLATLRERVPGFMPIQVPTQAVSVQDAVETYLFNSQLLSRDDGSMMLVLPQESRNHQGVWRYLSELVQADNPIDELRVFDLRESMANGGGPACLRLRVVLTPEELQAVNPAVMMNDTLFNTLNDWVDRYYRDRLVQADLVDPQLLREGREALDALSTILQLGSVYPFQR

SEQ ID NO: 9387 - protein, 324 aa, Enterobacter cloacae
GDDMENLLALTLAEETPERQEGAGPSFHWRWLGPGVLELTPTGKYNLSLLLSTGIHGNETAPVEIVELLLRALYRAEFTLHCRLLVVLGNPPALAQNKRYLVSDINRMFGGRWAQFPQSDETTRAQWLEKVVTAFFAGAGETRWHLDLHTAIRASYHVRFGVLPQRHQPWDEAFLTWLGDAGLEALVFHQTPGGTFTHFTCENVGALSCTLELGKALPFGQNDLTRFTPTHQALRALLAGVAPEPTREPVVRYRVVQQITRQSEAFQLHMAPHTLNFTPFRQGVLLAEDGETRYAVQKSTEYVLFPNPSVAFGLRAGLMLEKMP

SEQ ID NO: 9388 - protein, 235 aa, Enterobacter cloacae
DRRAPVYKSENAVDRTGGFSFIPCLRSGLTAADNTSVKMPWRTVRPSGVVMEFFDIRKMPVSLWRNGAGETREICCFPPATRDFFWRASIASIASNGEFSAFPGVDRVITLLEGGEVTLDAGRAFCHTLKHHQPYRFAGDLAVKAVLTEGQMSMDFNIMTRRDCCQAKVRVATRTFTTFASRGGVVFVLSGAWQLGDKLLTADQGASWEAGSHTLRLLETKGSLLFSEITWLPGH

SEQ ID NO: 9389 - protein, 456 aa, Enterobacter cloacae
GYFPMSKVIASLEKVLLPFAVKIGKQPHVNAIKNGFIKLMPLTLAGAMFVLINNVFLSFGEGSFFYSLGIRLDASTIETLNGLKAIGGNVYNGTLGIMSLMAPFFIGMALAEERKVDPLAAGLLSIAAFMTVTPYSVGDAYAVGANWLGGANIISGIIIGLVVAEMFTFIIRRNWVIRLPDSVPASVSRSFSALIPGFIILSIMGIIAWALSHWGTNFHQIIMDSISTPLASMGNVVGWAYVIFTSLLWFFGVHGSLALAALDSGIMTPWALENVALYQQYGSVDAALAAGKTFHVWAKPMLDSYIFLGGTGATLGLIIAVFIVSRRADHRQVAKLALPSGIFQINEPILFGLPIIMNPVMFIPFILVQPLLAAITLTAYYLGIIPPVTNIAPWTMPAGLGAFFNTNGSVAAFLLAIFNLGIATLLYMPFVAIANKAATVIDEEESEEDIALALKF

SEQ ID NO: 9390 - protein, 116 aa, Enterobacter cloacae
KMLDLESIVAEETAENDLEEVVMGLIINSGQARSLAYAALKQAKQGDFVAAKTMMEQSRTALNEAHLVQTKLIESDQGEGKMKVSLVLVHAQDHLMTSMLARELVAELIELHEKMQ

SEQ ID NO: 9391 - protein, 277 aa, Enterobacter cloacae
QEVSTMEIKTAHEQQLFNGKNFHVVIYNKTESASGLHQHDYYEFTIVLTGRYYQEINGKRVLLERGDFVFLPMGSYHQSFYEFGATRILNVGVSRRFFEKHYLPLVPFCFVASQVYRVKNEFMTWIETVIASLNFRDNEFDEFIETVTFYVMNRLRHHREEQQVVDDIPQWLRSTVELMHDKGQFSDNALENMVALSGKSQEYLTRATQRYYRKTPVQIINEIRINFAKKQLEITNYSVTDIAYESGYSSPSLFIKTFKKLTSFTPNSYRKNLTVIN

SEQ ID NO: 9392 - protein, 261 aa, Enterobacter cloacae
ETETHTPLRGGAMENLLIVNADDFGLSKGQNYGIIEACRRGVVTSTTALINGEAVEHAAQLSRELPELGVGMHFVLTLGLPLSPMPGLTREGKLGKWIWEMAEQDALPLDEIARELECQFNRFVDVFGREPTHIDSHHHVHMIPAIFPLVAEFAQRKGVAMRVDREVRGLPDVAVTSTEGFSSAFYGDEIDEALFLKVLDDSAAKGERSLEVMAHPAFVDEIVRKSAYCWPRLAELDVLTSASLKYAIAERGYRLGTFRDL

SEQ ID NO: 9393 - protein, 88 aa, Enterobacter cloacae
EFALVNPSLMKPLRQQNRQVISYVPRVEPAPPDHALKVDGFRDVWMLRGKYVAFVLIGEHFRRSPAFTVPESAQRWAMQTRQDEEVEE

SEQ ID NO: 9394 - protein, 97 aa, Enterobacter cloacae
IMSSGDITRYVVTVNIHEASLTELNELNNAFTRANFLLTLTDDEGNIHDLGSLAFGLISPLSQEEVKALASSLVESVTDKATEIDVDSWENWHKKEQ

SEQ ID NO: 9395 - protein, 295 aa, Enterobacter cloacae
SGRQHGRDIMWQAISHLLSEQLGEGEIELRNELPGGEIHAAWHLRYAGRDLFVKCDERELLPIFTAEADQLELLSRSKTVTVPQVLAVGSDRDYSFLVMNYLPARPLDAHNAFILGQQTARLHQWSDQPQFGLDFDNDLSTTPQPNAWQRRWSTFFAEQRIGWQLELAAEKGLAFGNIDAIVEHIQQRLASHQPQASLLHGDLWSNNCALGPDGPYIYDPACYWGDRECDLAMLPLHPEQPPQIYDGYQSVSPLPAGFLDRQPVYQLYTLLNRAILFGGSHLVNAQRALDRILAA

SEQ ID NO: 9396 - protein, 204 aa, Enterobacter cloacae
IDSLPGFIMTAEGHLLFSLACAVFAKNAELTPVLAQGDWWHIVPSAVLTCLLPDIDHPKSFLGQRLKWISKPIARAFGHRGFTHSLLAVFGLLTLFYLKVPESWIVPADAIQGMVLGYLSHILADMLTPAGVPLLWPCRWRFRLPILVPQKGNQLERVLCMALFAYAVWMPQTLPENGAVRWSSQMINSLQFQFNRFINHQIEH

SEQ ID NO: 9397 - protein, 760 aa, Enterobacter cloacae
GFQERTKENRAMSNNDKPHQSPIHGTEESQPGMDSLAPADGSHKPSPGLSAPGEQPTAPGSMKSPDADNEKLKSLDPHRKGGEGYALTTNQGVRIADDQNSLRAGTRGPTLLEDFILREKITHFDHERIPERIVHARGSAAHGYFQPYKSLKEITKADFLSDPNKITPVFVRFSTVQGGAGSADTVRDIRGLATKFYTEEGIFDLVGNNTPVFFIQDAHKFPDFVHAVKPEPHWAIPQGQSAHDTFWDYVSLQPETLHNVMWAMSDRGIPRSYRTMEGFGIHTFRLINAEGKATFVRFHWKPVAGKASLVWDEAQKLTGRDPDFHRRELWESIEAGDFPEYELGLQLIPEEDEFKFDFDLLDPTKLIPEELVPVQLVGKMVLNRNPDNFFAENEQAAFHPGHIVPGLDFTNDPLLQGRLFSYTDTQISRLGGPNFHEIPINRPTCPYHNFQRDGMHRQDIDTNPANYEPNSINDNWPRETPPGPKRGGFESYQERVDGTKIRERSPSFGEYYAQPRLFWNSQTPIEQQHIIGGFSFELSKVVRTYIRERVVDHLAHIDIQLAQGVANNLGITLTDEQCHAAPPKDVNGLKKDPSLSLYAVPGGSIKGRVVAILLNDKPRASDVLGIMRALKTQGVHAKLLYSRMGEVTADDGSVLPIAATFAGAPSLTVDAVIMPCGDVESLLGNGDAAYYLLEAYKHLKPIALAGDARKFKTLLKVPDQGEEGIVEGDNVDDAFMTRLFDLLAAHRVWSRSSKIDQIPA

SEQ ID NO: 9398 - protein, 316 aa, Enterobacter cloacae
PPPGSFLTTEHLLHCMPEQYMEQYVSRRQSAPRLEFEAAAIYEYPEHLRPWLEALPKQPGVYFFHGDSDTMPLYIGKSVNIRSRVMSHLRTPDEASMLRQSRRITWIETAGELGALLLEARLIKEQQPLFNKRLRRNRQLCSLQVNAGKPQVVYAREVDFSHEPNLYGLFANKRAALQTLQSLADELQLCYGLLGLEATTRGRACFRSALKRCAGACCGKESVEEHHARFMAGLASISVNCWPWEGAVALKETRDAMTHYHIIRNWLWLGAVESLDDATALLRTPAGFDQDGYKILCKPLLTGKYEIIVLSDPAAR

SEQ ID NO: 9399 - protein, 160 aa, Enterobacter cloacae
PVSRPPCTRFSTPGGSPACSQSFTTASPVKGVNSLGLKMTVFPASSAGTMCPFGRCPGKLYGPNTASTPCGRWRSVAAPSGISVCCSPVRVWYAFTDIAILLIIAVTSVVASQRGLLVSQAMMRVSSALLASSSAANFSTSAWRSENGRFAHAGNARRAA

SEQ ID NO: 9400 - protein, 514 aa, Enterobacter cloacae
RPGAGMASPLRNPLSGLVWAAMAVIYLPLLPASGMLLAPAFSPGNWATLFADPQLPQALAATLVSALIATLGSLFIALTLLALLWPGEGWQRLSTRLPWLLAVPHVAFATSALLLFAEGGQFYRICTVCSPQLDRYGIGLGLTLAVKESAFVLWTIYAALPEKRLVQQKIVLHTFGYGRMQALNWLILPAIAPALGAVMLAVLAWSLSVVDVAIVLGPGNPPTLAVLAWQWLTQGDAQQQTKGTLLCLVLLLLLAALAAVGYGFWTAWRRAQPAPSGVRRASHSALPARTLGGLLPLCGVLCALVLLMLARRDDIGPVSDSLSLGLLSSLTALAILMIWLEWGPQRGAVWIWLPLALPALPLVSGQYAVALWLGIDGQYAAVLWSHMLWVLPWMLLVLQPAWRRLDPRLILTARTLGWRRAKIFWLVKCPLMVRPALLAFATGFSVSMAQYMPTLWLGAGRFTTLTTEAVALSSGGSIPILASRALGLLLLTSSVFALAALLSRLVGRHRQGLR

SEQ ID NO: 9401 - protein, 467 aa, Enterobacter cloacae
LRFLAGNNVLTQCFWLQERRQCPPLLMTSGFSMKRVSQLTALALICGLASLSSTAADMPHSLTLAQLQTQNGAVIDTRISAFYNGWPQTLSGTSGHEPAALNLSASWLGAMSDEQLSGWAKQHRLTPDMPVALYGNDNDNQTVKTRLEKAGFTHVSTLSDALQQSDRLQRLAHFEQLVYPQWIRQLQQGKPVTAAPAGEWKVIEAGWGTPKLYLLSHIPDAGYIDTNEVESEPLWNKVSDEKLKAMLAKHGIRHDTTVILYGRDVYAAARVAQIMLYAGVRDVRILDGGWKAWSDASLPVERGTPANVKPAPDFGAPIPGQPQLMVDMEQARGMLHRQDASLVSIRSWPEFIGETSGYSYIKPKGEIAGARWGHAGSDATHMEDFHNPDGTMRSADDIAAMWKTWNILPEQHVAFYCGTGWRASEAFMYARAMGWQNVAVYDGGWYEWSSHPQNPVSTGERGPESAR

SEQ ID NO: 9402 - protein, 142 aa, Enterobacter cloacae
LLTNMLKTLDVVAAILENEGKILLAQRPEHADQPGMWEFAGGKVEAGETQPEALIRELREELGIEAVPARYVASHQREVSQRLIHLHAWHVPEFSGELKAHYHSALVWCTPEDAFTYDLAPADIPLLEAFILLRDARPAGLY

SEQ ID NO: 9403 - protein, 307 aa, Enterobacter cloacae
RIDCPPSAWGVTLFQAASAACPAKSKQRFTLFAFLIPDSYSYVQNDNNLTSEARMILDAFTLAGKVAMVTGCDTGLGQGMAIALAEAGCDIVGVNRKVPDETAARVTALGRRFIAIRADLGKQESIQSVVDTAVAEMGRIDILVNNAGTIRRADALEFSEKDWDEVIDLNLKSVFFLSQAVAKQFIAQGQGGKIINIASMLSFQGGIRVPSYTASKSGVLGLTRLLANEWATLGINVNAIAPGYMVTNNTRQLRDDEQRSQAILDRIPAGRWGLPEDLQGPVVFLASRASDYVNGHTLAVDGGWLAR

SEQ ID NO: 9404 - protein, 468 aa, Enterobacter cloacae
IRRTGMNFPLIANIVVFVVLLLLLAQARHKQWSLAKKVLVGLVMGVVFGLALHAIYGSDSPVLKDSIQWFNIVGNGYVQLLQMIVMPLVFASILSAVARLHNASQLGKISFLTIGTLLFTTLIAALVGVLVTNLFGLTAEGLVQGSAETARLTAIETNYVGKVADLTVPQMVLSFIPKNPFADLTGASPTSIISVVIFAAFLGVAALKLLKDDAPKGERVLTAIDTLQSWVMKLVRLVMQLTPYGVLALMTKVVAGSNLQDIIKLGSFVIASYLGLGIMFVVHGILLGVNGVGPLKYFRKVWPVLTFAFTSRSSAASIPLNVEAQTRRLGVPESIASFSASFGATIGQNGCAGLYPAMLAVMVAPTVGINPLDPVWIATLVGIVTISSAGVAGVGGGATFAALIVLPALGLPVTLVALLISVEPLIDMGRTALNVSGSMTAGTLTSQWLKQTDKTILDSEDDAELAHR

SEQ ID NO: 9405 - protein, 293 aa, Enterobacter cloacae
LGEADNRRRKFCYHPCTIHLALAATMKFVSFNINGLRARPHQLEAIVEQHQPDVIGLQETKVHDDMFPLEEVAKLGYNVFYHGQKGHYGVALLTKDTPVSVRRGFPGDGEEAQRRIIMAEIPSALGNVTVINGYFPQGESRDHETKFPAKAKFYQDLQNYLTTELKKENPVLIMGDMNISPTDLDIGIGEENRKRWLRTGKCSFLPEEREWMERLLGWGLVDTFRTANPETQDRFSWFDYRSKGFDDNRGLRIDLLLASAPLAERCIETGIDYDIRSMEKPSDHAPVWATFKL

SEQ ID NO: 9406 - protein, 229 aa, Enterobacter cloacae
TSVNIKKISLLCALLGAFVLIVVLLPPGMLSLDTLKIHQQTLLARVEQAPLQSALFYFAVYVLLSALSIPGAALLTLLGGALFSLWEATLLVSFASTLGATLAMLVSRYLLRDWVQRRFAAQMNTIDAGMDRDGARYLFALRLMPLFPFFLVNLLMGLTRLRVRHYWWVSQLAMLPATVIYLNAGRELGKLTSLRDILSPGLLFAFTLLGLLPLVTRWLFSRYIPSIKK

SEQ ID NO: 9407 - protein, 391 aa, Enterobacter cloacae
GIMRRVRFCAFLTSLLLATSAFAAESWQSIQQQATGQTVWFNAWGGDEAVNRYLDWVSGEMKTHYAINLKIVHLADAADAVKRIQTEHAAGRSSNGSVDLLWVNGENFRNLKAANLLLTGWAQTLPNWRYVDTRKPVTEDFAIPTDGAESPWGGAQLTFIARKASTPTPPADPHALLVYARQHPGKVSYPRPPDFTGTAFLEQLLLALTAHPEALKNAPDSTFAQVTAPLWDYLDTLHPLLWREGNDFPPSPARMDTLLASGSLNLSLTFNPAHAMQKVASGELPADSYSFGFLKGMIGNVHFVAIPANASASAGAKVVANFLLSPQAQIRKANPAVWGDPSVLDGEKLPAKAAKQLRAFTPSGTPDVLPEPHAAWVNALEQEWLRRYGTR

SEQ ID NO: 9408 - protein, 452 aa, Enterobacter cloacae
EVLISMDQTRSLESFLAHVQQRDPHQSEFAQAVREVMTTLWPFLEENPRYRQMALLERLVEPERVIQFRVAWVDDRNQVQVNRAWRVQFNSAIGPFKGGMRFHPSVNLSILKFLGFEQTFKNALTTLPMGGGKGGSDFDPKGKSEGEVMRFCQALVTELYRHLGPDTDVPAGDIGVGGREVGFMAGMMKKLSNNSACVFTGKGLSFGGSLIRPEATGYGLVYFTEAMLKRHGLSFEGMRVAVSGSGNVAQYAIEKAMAFGARVVTASDSSGTVVDEAGFTAEKLARLCEIKASRDGRVADYAREFGLTYLEGKQPWGVPVDIALPCATQNELDVDAARTLISNGVKAVAEGANMPTTIDATDLFLDAGVLFAPGKAANAGGVATSGLEMAQNAARMSWKAEKVDARLHHIMLDIHHACVEYGGEASQTNYVRGANIAGFVKVADAMIGQGVI

SEQ ID NO: 9409 - protein, 375 aa, Enterobacter cloacae
STEPLRVLPDLRERALKTVPSSREEGIFSFEEQELITMQKKSIYVAYTGGTIGMQRSENGYIPVSGHLQRQLALMPEFHRPEMPDFTIHEYEPLMDSSDMTPEDWQHIADDIKAHYDQYDGFVILHGTDTMAFTASALSFMLENLSKPVIVTGSQIPLAELRSDGQINLLNSLYVAANYPINEVTLFFNNRLYRGNRTTKAHADGFDAFASPNLQPLLEAGIHIRRLGTPPAPNTAGELIVHPITPQPIGVVTIYPGISADVVRNFLRQPVKALILRSYGVGNAPQNGEFLKELQEASDRGIVVVNLTQCMSGKVNMGGYATGNALAHAGVISGFDMTVEATLTKLHYLLSQDLDIDSIRRAMMQNLRGELTPDE

SEQ ID NO: 9410 - protein, 216 aa, Enterobacter cloacae
GDPMKQRALLLVDLQNDFCAGGALAVAEGDSTVDVANSLIAWCKARGEAVVASQDWHPANHGSFASQHNVEPFSQGELDGLAQTFWPDHCVQQTEGAELHPLLNQKAIDAVFHKGENPTIDSYSAFFDNGHRQKTALDAWLRHHEITELIVLGLATDYCVKFTVLDALQLGYTVNVITDGCRGVNIQPQDSAQAFMDMAAEGATLYTLADWMETQA

SEQ ID NO: 9411 - protein, 454 aa, Enterobacter cloacae
TPSHHKRNGDAILSRLFFRHAFSVAWLFLFSQRGNYMKRLPLLAALPLLCASLASAAPLMSVGYFNGGGDVTAGPGGDIHKLDVRQITHLNYSFGLVYNNEKDETNAALKDPAKLHQIWLSPKVASDLALLPQLRKQNPNLKVLLSVGGWGARGFSGAAATKESRAVFIRSAQEIVSQYGLDGIDLDWEFPVNGAWGLVESTPADRDNFTALLKEMRDAFGKKKLVTIAVGANAESPKSWVDVKAIAPLLDYINLMTYDMAYGTQYFNANLYDSSDWPTVAAADKYSVDFVVNNYLAAGLKPQQMNLGIGFYGRVPKRAVEPGIDWSKPDAQNNPVTQPYFGPQELSLFKSLGYDLTKDTYVKYNDIVRKLLNDPQKRFTEHWDEQAKVPWLSVKSADGKALFAISYENPRSVAIKADYIKEKGLAGAMFWEYGADDENQLAKQLAESLGILHQ

SEQ ID NO: 9412 - protein, 314 aa, Enterobacter cloacae
KEVMMASIYTLTLSPSLDSATMTPQIYPEGKLRCSAPVFEPGGGGINVARAITHLGGKATAIFPAGGATGEHLVALLADEQVAVDTVDAKDWTRQNLHVHVESSGEQYRFVMPGAKLTDDEFRQLEEKVLTIESGSLLVISGSLPPGVKTEKLTALVQAALQRGIRCIVDSSGEALKAALEPGQLELVKPNQKELSALVNRELSQPDDVRTAAEELVRTGKAHRVVVSLGPQGALAVDKTGFVQVVPPPMKSQSTVGAGDSMVGAMVLKLAQGASLLEMARYGVAAGSAATINQGTRLCSLADTQKIVDYLERS

SEQ ID NO: 9413 - protein, 227 aa, Enterobacter cloacae
GDVVMSTPRKILAAIFDMDGLLIDSEPLWDRAELDVMASLGVDISRRNELPDTLGLRIDMVVDLWYAHQPWVGPDRDEVTARIINRAISLVEEYKPLLPGVRDAIALCKAQGLKVGLASASPLHMLEKVLTMFGLRDSFDALASAEKLPYSKPHPQVYMDCAAKLGLDPLTCVALEDSVNGMVASKAARMRSIVVPAEEGRHDPRFALADVRLTSLEELTARHLRGE

SEQ ID NO: 9414 - protein, 311 aa, Enterobacter cloacae
IAVKQYTQNCDPCRFPDKGLVLTDHTFCLVLHREGVMALQQEIIQALGAKPAIDANEEIRRSVDFLKAYLSAHPFLKTLVLGISGGQDSTLAGKLSQMAISELRDETGDTALQFIAVRLPYGVQADEQDCQDAIAFIQPDRVLTVNIKGSVLASEQALREAGIELSDFVRGNEKARERMKAQYSIAGMTKGVVVGTDHAAEAITGFFTKYGDGGTDINPLFRLNKRQGKQLLAALGCPEHLYKKAPTADLEDDRPSLPDEAALGVTYDNIDDYLEGKTLDEGTANIIEGWYLKTEHKRRPPITVFDDFWKK

SEQ ID NO: 9415 - protein, 380 aa, Enterobacter cloacae
VGTPARRGVDLAAACPPGAAPRVRAVCRGAVAGHRRPVRCGALEPYALGPPVDAPGAATGLAPARSPAYPHCQNAGLAAGENFLASEMPIDGSSGPAGLCHRLFREHGPVHAYPLAGGGTFHHPDDGGGRPQQRRQHSDPRQPGAGSVVVDQQRICPCRAALPARGPSQTRITLMLTVKNLTIAPLLHEVNFRVPAGEIVTLMGPSGSGKSTLFAWMVGALSADFKAHGELWLNDRRCDMLPVETRGIGILFQDALLFDAFSVGQNLMLALPAHIVGRARRNAVEQALETAGLANHYTSDPATLSGGERARVSLLRALLAQPQALLLDEPFSRLDKTLRASFRAWVFEVTRQRRIPVVLVTHDEDDIPPGGEVIEISRWQ

SEQ ID NO: 9416 - protein, 86 aa, Enterobacter cloacae
RPALYPAPRSARPDAGCWHQYKMRSGRSARPASLVAIAEPGSNAPCAAPDSRQTAPPARKDAAYAPTSEWGSAPRRSVFSAWRRWG

SEQ ID NO: 9417 - protein, 621 aa, Enterobacter cloacae
GEYMRTLWRIIAGFFKWTWRLLNFVRNLVMNIFFILLVLVCAGIWMHISNANQSQHSTRGALLLDITGVIVDKPSTSNRLGVIGRQLFGATSDRLQENSLFDIVDTIRQAKDDRNITGIVLDLKDFAGADQPSMQYIGKALREFRDSGKPVIAIGDSYTQGQYYLASFANKIWLSPQGTVDLHGFATNGLYYKSLLDKLKVTTHVFRVGTYKSAVEPFIRDDMSPAAREADSRWIGELWQNYLGTIAANRQITAEQVFPGARGVLDGLRKVDGDTAKYALDNKLVDQLGSSAEIEKALTKQFGWSKEDKNYSAISMYDYAAKKSDDSGDSIAVVFANGAIMDGEETPGNVGGDTTASQIRDARLDPKVKAIVLRVNSPGGSVSASEVIRAELAAARAAGKPVVVSMGGMAASGGYWISTPANYIVANPSTLTGSIGIFGVINTVENSLDYLGVHTDGVSTSPLADVSVTKSLPPEVSEMMQLSIESGYKRFITLVADSRKKTPDQIDQIAQGHVWTGQDAKSNGLVDSLGDFDDAVKKAAELAKLKQWHVDYYQDEPTFFDMVMDSMSGSVRAMLPDALQAYLPAPVATAAKAMKAESDKLAAFNDPQSRYAFCLTCANVR

SEQ ID NO: 9418 - protein, 524 aa, Enterobacter cloacae
PMSQQVVIFDTTLRDGEQALQASLSVKEKLQIALALERMGVDVMEVGFPVSSPGDFESVQTIARTIKNSRVCGLARCVEKDIDVAAESLKVAEAFRIHTFIATSPMHIATKLRSTLDEVIERAVYMVKRARNYTDDVEFSCEDAGRTPIDDLARVVEAAINAGARTINIPDTVGYTMPFEFSNIITGLYDRVPNIDKAIISVHTHDDLGLAVGNAIAAVHAGARQVEGAMNGIGERAGNCSLEEVIMAIKVRKDIMNVHTRINHNEIWRTSQTVSQICNMPIPANKAIVGAGAFAHSSGIHQDGVLKNRENYEIMTPESIGLNQVQLNLTSRSGRAAVKHRMEEMGYKDSDYNMDQLYDAFLKLADKKGQVFDYDLEALAFINKQQEEPEHFRLDYFTVQSGSSDIATASVKLACGDEIKAEAANGNGPVDAIYQAINRVTEYDVELVKYDLTAKGHGKDALGQVDIVVNYNGRRFHGVGLATDIVESSAKAMVHVLNNIWRAAEVEKELQRKAQNKENNKETV

SEQ ID NO: 9419 - protein, 506 aa, Enterobacter cloacae
HIKDTIMTIFNNYEVWFVIGSQHLYGPEALQQVTKHAEHVVNALNAEAKLPCKLVLKPLGTTPDEITNICRDANYDDKCAGLVVWLHTFSPAKMWINGLAILNKPLLQFHTQFNASLPWDSIDMDFMNLNQTAHGGREFGFIGARMRQQHAVVTGHWQDGQAQKRIGSWMRQAVSKQDTRHLKVVRFGDNMREVAVTDGDKVAAQIKFGFSVNTWAVGDLVQVVNDISDGDVNALVDEYESSYRLTPAAQINGDKRQNVLDAARIELGMKRFLEQGGFHAFTTTFEDLHGLKQLPGLAVQRLMQQGYGFAGEGDWKTAALLRIMKVMSTGLQGGTSFMEDYTYHFENGNDLVLGSHMLEVCPSIAVEEKPILDVQYLGIGGKADPARLIFNTRTGPAINASLIDLGDRFRLLVNCVDAVETPHSLPKLPVANALWKAQPDLPTASEAWILAGGAHHTVFSHALDLNDMRQFAELHDIELTVIDNDTRLPAFKDALRWNEVYYGSKR

SEQ ID NO: 9420 - protein, 972 aa, Enterobacter cloacae
SRTTMPFTLGQRWISDTESELGLGTVVAVDARMVTFLFPATGENRLYARNDSPVTRVMFNPGDTVTSHEGWQLKVEDVKEENGLLAYIGTRLDTDETNVILREVLLDSKLVFSKPQDRLFAGQIDRMDRFSLRYRARKFQSEQYRMPWSGLRGQRTSLIPHQLNIAHDVGRRHAPRVLLADEVGLGKTIEAGMILHQQLLSGAAERVLIVVPETLQHQWLVEMLRRFNLRFSLFDDERYAEAQHDADNPFETEQLVICSLDFVRRSKQRLEHLCDAEWDLMVVDEAHHLVWSEDAPSREYMAIEQLAERVPGVLLLTATPEQLGLESHFARLRLLDPNRFHDFEQFVEEQKNYRPVADAVALLLAGNRLSNDELNTLSDLIGEQDIEPLLQAANSDSDNAGSARKELIDMLMDRHGTSRVLFRNTRNGVKGFPKRELHTIKLPLPTQYQTAIKVSGIMGTRKSAEDRARDMLYPEQIYQEFEGDTGTWWNFDPRVEWLMGYLTAHRSRKVLVICAKAATALQLEQVLREREGIRAAVFHEGMSIIERDRAAAWFSEEDSGAQVLLCSEIGSEGRNFQFASNLVMFDLPFNPDLLEQRIGRLDRIGQAHDIQIHVPYLEKTAQSVLVRWYHEGLDAFEHTCPTGRTIYDQVHADLIGYLAAPENTEGFDELIKSCREKHDALKAQLEQGRDRLLEIHSNGGEKAQQLAESIEEQDDDTSLISFSMNLFDIVGINQDDRGENMIVLTPSDHMLVPDFPGLPEDGCTITFERDVALSREDAQFITWEHPLIRNGLDLILSGDTGSSTISLLKNKALPVGTLLVELIYVVEAQAPKQLQLNRFLPPTPVRLLLDKNGTNLAGQVEFESFNRQLSAVNRHTGSKLVNAVQQDVHAILQLGEAQAEKAARELIDAARSEADEKLSAELSRLEALKAVNPNIRDDELAAIESNRQQVLESLNQAGWRLDALRLIVVTHQ

SEQ ID NO: 9421 - protein, 167 aa, Enterobacter cloacae
  UNSURE (157)
  UNSURE (167)
AERKMVMEPYNPPMDPWLVILYQDEHIMVVNKPSGLLSVPGRLEEHKDSVMTRIQRDYPQAESVHRLDMATSGVIVVALNKAAERELKRQFREREPKKQYVARVWGHPAQAEGLVDLPLICDWPNRPKQKVCYETGKAAQTEYEVLEYARHNVFITXRQIRHNLTQX

SEQ ID NO: 9422 - protein, 470 aa, Enterobacter cloacae
RGVIMAKTLYEKLFDAHVVYEAPNETPLLYIDRHLVHEVTSPQAFDGLRAHKRPVRQPGKTFATMDHNVSTQTKDINASGEMARIQMQELIKNCNEFGVELYDLNHPYQGIVHVMGPEQGITLPGMTIVCGDSHTATHGAFGALAFGIGTSEVEHVLATQTLKQGRAKTMKIEVKGKAAPGITAKDIVLAIIGKTGSAGGTGHVVEFCGDAIQALSMEGRMTLCNMAIEMGAKAGLVAPDETTFNYVKGRLHAPKGQNFDDAVAYWKTLKTDEGAIFDTVVTLQAEEIAPQVTWGTNPGQVISVNDSIPDPASFADPVERASAEKALAYMGLKPGVPLTDVSIDKVFIGSCTNSRIEDLRAAAEIAKGRKVAPGVQALVVPGSGPVKAQAEAEGLDKIFIEAGFEWRLPGCSMCLAMNNDRLNPGERCASTSNRNFEGRQGRGGRTHLVSPAMAAAAAVTGHFADIRSLK

SEQ ID NO: 9423 - protein, 536 aa, Enterobacter cloacae
MATRRQPLIPGWLVPGLLAAVLMVVVSLGAFLALWFNAPESDLLALWHDSYLWHVIRFSFWQAFLSALLSAIPAIFLARALYRRRFPGRLALLRLCAMTLILPVLVAVFGILSVYGRQGWLASLFNLLGLEWTFSPYGLKGILLAHIFFNMPMATRLFLQALENIPGEQRQIAAQLGMRGWSFFRFVEWPWLRRQIAPVAALIFMLCFASFATVLSLGGGPQATTIELAIYQALSYDYDPGRAALLAIVQMVCCLALVLLSQRLSKAIPTGSNNLTGWRDPQDSLHSRVADFMLIALALLLLLPPLLAVIVDGLNRNVLSVLQQPVLWQATWTSLRIALAAGLLCVILTMMLLWSSRELHARHARKAGHALELTGMLILAMPGIVLATGFFLLFNSTIGLPESADGIVIFTNALMAIPYALKVLENPMRDVNSRYSLLCQSLGMQGWQRLKVVELRALKRPLAQALAFACVLSIGDFGVVALFGNEDFRTLPFWLYQQIGSYRSQDGAVTALLLLLLCFALFTVIEKLPGRDVKTD

SEQ ID NO: 9424 - protein, 371 aa, Enterobacter cloacae
REQQGNRVMSKNYHIAVLPGDGIGPEVMAQALKVLEAVRSRFAMKITTSHYDVGGIAIDNHGTPLPKGTVEGCENADAVLFGSVGGPKWEHLPPAEQPERGALLPLRKHFKLFSNLRPAKLYPGLEEFCPLRADIAANGFDILCVRELTGGIYFGQPKGREGSGQHEKAFDTEVYHRFEIERIAHIAFESARKRRRKVTSIDKANVLQSSILWREIVSEVAKQYPDVALSHMYIDNATMQLIKDPSQFDVLLCSNLFGDILSDECAMITGSMGMLPSASLNEEGFGLYEPAGGSAPDIAGKNIANPIAQILSLALLLRYSLDAGDAATAIENAINRALEEGVRTGDLARGTAAVSTDEMGDIIARYVAEGV

SEQ ID NO: 9425 - protein, 206 aa, Enterobacter cloacae
NKETIMAEKFTQHTGRVVPLDAANVDTDAIIPKQFLQKVTRTGFGAHLFNDWRFLDDKGEVPNPEFVLNFPEYKGASILLARENFGCGSSREHAPWALTDYGFKVVIAPSFADIFYGNSFNNQLLPVTLSDEQVDELFALVQANPGISFEVDLEAEVVKAGDKTYSFSIDAFRRHCMLNGLDSIGLTLQHEEAIAAYEKKQPAFMG

SEQ ID NO: 9426 - protein, 559 aa, Enterobacter cloacae
FFVRSSPFMPSGRLQQQFIRLWQCCEGQSQETTLNELAELLNCSRRHMRTLLNTMQQQGWLNWEAEAGRGKRSRLTFLYTGLALQQQRAEDLLEQDRIDQLVQLVGDKAAVRQMLVSHLGRSFRQGRHILRVLYYRPMKNLLPGTALRRSETHMARQIFSGLTRINEENGELEADIAHHWQQLSPRHWRFFLRPGIHFHHGRELEMRDVIDSLERARTLPLYSHIARIHSPTAWTLDIELSQPDKWLPWLLGYVPSMILPAEWRSLNNFSSQPIGTGPYSVTRNNSNQLKIRAFDDYFGYRALIDEVNVWVLPDLNEELSAGLTLEGPTAGEKAFESRLEEGCYYLLFDSRSHRGANHDVRRWISHILAPANLIYHAEEQYQTWWFPAYGLLPRWHHAQPVRSEKPAGLETITLSYYRDHIEHRFIARIMSTLLAAEGVTLAIQEVDYDEWHRGDVISDIWLNSANFTLPLDFSLFSHLYEVPLIQHCINRDWQQDAARWRAGEMDLAAWCQELLAGQTIVPLIHHWLLIQGQRSMRGLRMNTLGWFDFKSAWFAPPEP

SEQ ID NO: 9427 - protein, 348 aa, Enterobacter cloacae
RRRRDLRLSLKILCHSTLRCKVLKNVLPLLALFALPVFAKPVLTVYTYDSFSADWGPGPVVKKAFEADCNCELKFVALEDGVSLLNRLRMEGKNSKADVVLGLDNNLLEAATQTRLFAKSGVAADAVNVPGGWKNDTFVPFDYGYFAFVYDKNKLKNPPKSLKELVESDQKWRVIYEDPRTSTPGLGLLLWMQKVYGDKTPEAWQKLAAKTVTVTKGWSEAYGLFLKGESDLVLSYTTSPAYHIIAEKKDNYAAANFAEGHYLQVEVAARTAASKQPELAEKFLKFMISPAFQNAIPTGNWMYPVTDVALPAGFEQLNKPQTSLEFTPQQVAAQRAAWISEWQRAVSR

SEQ ID NO: 9428 - protein, 306 aa, Enterobacter cloacae
SVRWPRRWRLPACCRLAILALWPSSATRISARCRSGFISKLAPIVARTAPSRRYSCCCCALRYLPLSKNFRGVMLKLTDVTWLYEHLPMRFTLSVRQGERIAVLGPSGAGKSTLLNLIAGFLQPASGSIVIDNGEYTYAPPAKRPVSMLFQENNLFNHLTVWQNIALGMDPGLKLNVAQRQTLEAIAEQMGLAAFINRLPGELSGGQRQRVALARCLVRKQPLLLLDEPFSALDPALRQEMLSLVEEVCEREQLTMLMVSHSIEDAARIAPRSVVIAEGRILWDGETEELLSGKAGASSLLGIREV

SEQ ID NO: 9429 - protein, 589 aa, Enterobacter cloacae
RFLSLVSNVLPYLFFGWSNTMAIAIGLDFGSDSVRALAVDCTTGQEIATSVEWYPRWQEGRYCDAPNNQFRHHPRDYIESMEAAIKTVLAELTDAQRADVVGIGVDSTGSTPAPVDAEGRVLALRPEFADNPNAMFVLWKDHTAVEEAEAITRLCLQPGKTDYSRYIGGIYSSEWFWAKILHVTRADASVAQAAASWIELCDWVPALLSGTTRPQDIRRGRCSAGHKSLWHESWGGLPPAAFFDELDPIINKNLTYPLFTDTFTADIPVGTLCEEWAKRLGLPQNVTISGGAFDCHMGAVGAGAQPNTLVKVIGTSTCDILTADKASVGDRAVKGICGQVDGSVVPDFIGLEAGQSAFGDIYAWFGRVLGWPLDQLAAAHPELKTQITASKKQLLPQLTDAWAKNPSLDHLPVVLDWFNGRRTPFANQRLKGVITDLNLATDAPALFGGLIAATAFGARAIMECFIDQGIDVNNVMALGGIARKNPVIMQACCDVLNRPLQIVASDQCCALGAAIFAAVAAGVHADIPTAQQHMASAVENTLHPQTQQAQRFEQLYQRYQQWAKSAELHYLPVAAPAKSTADTTATLTH

SEQ ID NO: 9430 - protein, 275 aa, Enterobacter cloacae
RRAALERSLLRFKTLSPECPVALRLPGLRFCRPDKRSAIWQETTMLEDLKRQVLEANLALPKHNLVTLTWGNVSAVDREKGVFVIKPSGVDYTVMTAEDMVVVSIETGEVVEGKKKPSSDTPTHRLLYQAFPTIGGIVHTHSRHATIWAQAGQPIPATGTTHADYFYGTIPCTRLMTDAEINGEYEWETGNVIVETFEKQGIDAAQMPGVLVHSHGPFAWGKNAEDAVHNAIVLEEVAYMGIFCRQLAPQLPDMQQTLLDKHYLRKHGAKAYYGQ

SEQ ID NO: 9431 - protein, 837 aa, Enterobacter cloacae
TFARCRCAYRDCGTCRPDKRSAIRLNRHCIKPQQTPLNQAIIRPGFVLWDNAVTQAQEGFLLTRHWRDTPQGTEVEFWLATDNGPLNVTLPPQESVAFIPEAHVEKVKQLLRGENGWRITPLELKDFHRQPVYGLYCRAHRQLMRYEKLLREAGVTLYEADIRPPERFLMERFITAPVWVDGTAQNGRIVNARLKPSPNYRPPLKWVSLDIETTRHGELYCIGLEGCGQRVVYMLGPPNGDASALDFNLEYVNSRPQLLEKLNQWFAEHDPDVLIGWNVVQFDLRVLQKHAERYRIPLMLGRGNSELEWREHGFKNGVFFAQANGRLIIDGIEALKSAFWNFSSFSLEAVAQELLGEGKSIDNPWDRMDEIDRRFNEDKPALATYNLKDCELVTQIFHKTEIMPFLLERATVNGLAVDRHGGSVAAFSHLYFPRMHRAGYVAPNLGDVPPQASPGGYVMDSRPGLYDSVLVLDYKSLYPSIIRTFLIDPVGLVEGMAQPDDAHSTEGFLGARFSREKHCLPEIVGNIWHGRDEAKRHGNKPLSQALKIIMNAFYGVLGTSACRFFDPRLASSITMRGHEIMRQTKALIESRGYDVIYGDTDSTFVWLKAAHSEDDAAQIGKDLVAFVNDWWRESLQKERLTSALELEFETHFARFLMPTIRGTDQGSKKRYAGLIQEGDTQRMVFKGLETVRTDWTPLAQQFQQTLYLRVFRNEPYQDYVRDTIASLMAGELDDQLVYRKRLRRPLAEYQRNVPPHVRAARLADEENVRRGRAPQYQNRGTIKYVWTTNGPEPVDYQQSPLDYDHYLTRQLQPVAEGILPFINDDFATLVTGQLGLF

SEQ ID NO: 9432 - protein, 267 aa, Enterobacter cloacae
AESLIRFLTGIVMQALLEHFITQSVMYSLIAVALVAFLESLALVGLILPGTVMMAGLGALIGSGEVNFWQAWMAGIIGCLLGDWISFWLGWRFKKPLHRWSFMKKNKALLDKTEHALHQHSMFTILVGRFVGPTRPLVPMVAGMLDLPVAKFVVPNIIGCVFWPPFYFLPGILAGAAIDIPDGMQSGEFKWLLLGTAVLLWLAVWLCWRLWRSAKASVDRLTRYLPRTRLLWLAPLTLGVAVVALIALIRHPLMPVYGEILLKVVSR

SEQ ID NO: 9433 - protein, 420 aa, Enterobacter cloacae
SPASKMFFAGFFRLLFHPISIRFHKDLRMLWLMTMGRRLNGVYAAFMLVAFMMGVAGALQAPTLSLFLSREVGAQPFWVGLFYTVNAIAGILVSLWLAKRSDSQGDRRKLILFCCAMAVGNALLFAFNRHYLTLITCGVLLASLANTAMPQLFALAREYADNSAREVVMFSSVMRAQLSLAWVIGPPLAFMLALNYGFTTMFSIAAGIFVISLALIAFALPSVARVEQVTDKPITQVSGWQDKNVRMLFIASTLTWTCNTMYIIDMPLWISSDLGLPDKLAGILMGTAAGLEIPAMILAGYYVKRFGKRKMMVVAVAAGVLFYLGLILFHSREALLALQLFNAVFIGIVAGIGMLWFQDLMPGRAGSATTLFTNSISTGVILAGVIQGALAQSYGHGSVYWMIAAISVVTLGLTCRVKDV

SEQ ID NO: 9434 - protein, 170 aa, Enterobacter cloacae
AKRREPDMRRILSVLLENESGALSRVIGLFAQRGYNIESLTVAPTDDPTLSRMTIQTVGDAKVLEQIEKQLHKLVDVLRVSELGQGAYVEREVMLVKIQASGYGREEVKRNTDIFRGQIIDVTPSIYTVQLAGTSDKLDAFLASVRDVAKIVEVARSGVVGLSRGDKIMR

SEQ ID NO: 9435 - protein, 132 aa, Enterobacter cloacae
FSAAYCREDERMISRVTETLSKVKGSLGSNERHALPGVIGDDLLRFGKLPLCLFICIIVTAVMVVTTAHHTRLLTAQREQMVLERDALDIEWRNLILEENALGDHSRVERIATEKLQLQHVDPSQENIVVQK

SEQ ID NO: 9436 - protein, 593 aa, Enterobacter cloacae
GKTRRMKAAAKTLKPKRQEEQANFVSWRFALLCGCILLALGFLLGRVAWLQIIAPDMLVRQGDMRSLRVQEVSTSRGMITDRSGRPLAVSVPVKAIWADPKELHDAGGITLDNRWKALSDALKMPLDQLASRVNANPKGRFIYLARQVNPDMADYIKKLKLPGIHLREESRRYYPSGEVTAHLIGFTNVDSQGIEGVEKSFDKWLTGQPGERIVRKDRYGRVIEDISSTDSQAAHNLALSIDERLQALVYRELNNAVAFNKAESGSAVLVDVATGEVLAMASSPSYNPNNFAGTAKDAMRNRSITDVFEPGSTVKPMVVMTALQRGIVNENTVLNTIPYRINGHEIKDVARYSELTLTGVLQKSSNVGVSKLALAMPSSALVDTYSRFGLGKATNLGLVGERSGLYPQKQRWSDIERATFSFGYGLMVTPLQLARVYATIGSYGIYRPLSITKVDPPVPGERVFPESIVRTVVHMMESVALPGGGGVKAAIKGYRIAIKTGTAKKVGPDGRYINKYIAYTAGVAPASNPRFALVVVINDPQAGKYYGGAVSAPVFGAIMGGVLRTMNIEPDALATGEKSEFVINQGEGTGGRS

SEQ ID NO: 9437 - protein, 478 aa, Enterobacter cloacae
RLSDCRQSSSGLLRPRDGSASAGSGGMISITLSQAAAVLQGMLHGQDLTIEAVTTDTRKVTAGCLFVALKGERFDAHDFAQQAKDNGAGALLVSRKLDIDLPQIVVKDTRLAFGELAAWVRQQVPTRVVALTGSSGKTSVKEMTAAILSQCGNTLYTAGNLNNDIGVPMTLLRLTHEHEYAVIELGANHQGEIAWTVSLTRPEAALVNNLAAAHLEGFGSLAGVAKAKGEIYTGLPDDGIAIMNADNNDWLNWQSIIGSRKTWRFSPNAANSDFSATNIHVTSHGTEFTLTTPTGDIDVLLPLPGRHNIANALAAAALSMAVGASHAAIKAGLANLKAVPGRLFPIQLAENKLLLDDSYNANVGSMTAAVQVLSEMPGYRVMVVGDMAELGDESEACHVQVGEAAKAAGLDRVLSAGPLSKAISDASEVGEHFADKSALIERLKALITEKQIVTVLVKGSRSAAMEEVVHALQENGTC

SEQ ID NO: 9438 - protein, 425 aa, Enterobacter cloacae
CLYPPGEGVRLMRLSLPRLKMPRLPGFGILVWLFTALKGWVMASRDKDSDSLIMYDRTLFWLTLGLAAIGFIMVTSASMPVGQRLANDPFLFAKRDGLYIILAFCLALITLRLPMSFWQRHSTAMLIASIIMLLIVLVVGSSVNGASRWIAFGPLRIQPAEFTKLSLFCYLANYLVRKVDEVRNNLRGFLKPMGVILVLAILLLAQPDLGTVVVLFVTTLAMLFLAGAKLWQFIAIIGMGISAVVLLILAEPYRIRRVTSFWNPWEDPFGSGYQLTQSLMAFGRGEVWGQGLGNSVQKLEYLPEAHTDFIFSIIGEELGYIGVVLALLMVFFVAFRAMSIGRKALEIDHRFSGFLACSIGIWFSFQALVNVGAAAGMLPTKGLTLPLISYGGSSLLIMSTAIMFLLRIDYETRLEKAQAFTRGSR

SEQ ID NO: 9439 - protein, 187 aa, Enterobacter cloacae
LYVFWTRRADMSQAALNTRNRDDEEEYSSSRRSNGTRLAGIIFLLGVLCTVFISGWMVLGWMEDAQRLPLSKLVVTGERHYTRNDDIRQSILALGSPGTFMTQDVNIIQSQIERLPWIKQASVRKQWPDELKIHLVEYVPIARWNDQHMVDVDGNSFSVPSDRVNKQNLPMLYGPAVIENRRIPGFS

SEQ ID NO: 9440 - protein, 336 aa, Enterobacter cloacae
IIFFEVITVPWQREFSVTVESEMPENNINQPQTYDGVKPQLRTVDLNLLTVFDAVMQEQNITRAAQSLGMSQPAVSNAVARLKVMFNDELFVRYGRGIQPTARAFQLFGSIRQALQLVQNELPGSGFEPLSSERVFHLCVCSPLDNYLTSVIYNKVEQIAPNIHLVFKSSLNQNTEHQLRYQETEFVLGYEEFRRPEFACVPLFKDEMVLVASKKHPRMNSPLRESDVYSEQHAVVALDRYASFSLPWYDTADKQASVAYQGMAMVSVLNVVSQTQLVAIAPRWLAEEFSDSLSLQILPLPLKLNSRTCYLSWHEAAGRDKGHQWMEELLVNICRR

SEQ ID NO: 9441 - protein, 328 aa, Enterobacter cloacae
FRNIIGTAAGLVSINMMENYKHTTVLLDEAVNGLNIRPDGIYIDGTFGRGGHSRLILSQLGAEGRLLAIDRDPQAIAVAQTIDDPRFSIVHGPFSALADYVAERGLTGKIDGILLDLGVSSPQLDDAERGFSFMRDGPLDMRMDPTRGQSAAEWLQTADEADIAWVIKTFGEERFGKRIARAIVERNRVEPMTRTKELAEVIAAATPVKDKHKHPATRTFQAVRIWVNSELEEIELALKSSLDVLAPGGRLSIISFHSLEDRIVKRFMREQSRGPQVPAGLPMTEEQLRKLGGRQLRALGKLMPGEEEVAENPRARSSVLRIAERTNA

SEQ ID NO: 9442 - protein, 502 aa, Enterobacter cloacae
LIKAREQVADRNLRDLLAPWVPMLPARALREMVLDSRVAASGDLFVAVVGHQADGRRYIPQAIAQGVAAIIAEAKDEATDGEIREMHGVPVIYLSQLNERLSALAGRFYNEPSDQLQLVGVTGTNGKTTTTQLMAQWAQLLGETGAVMGTVGNGLLGKVSPTENTTGSAVDVQRVLAGLAEQGATFAAMEVSSHGLVQHRVAALKFAASVFTNLSRDHLDYHGDMEHYEAAKWLLYSTHHHGQAIINADDEVGRRWLEKLPDAVAVSMEDRINPNCRGRWLKAVEVNYHDSGATIRFASIWGEGEIESRLMGAFNVSNLLLALATLLALGYPMADLLKTAERLQPVCGRMEVFSAPGKPTVVVDYAHTPDALEKALEAARLHCAGKLWCVFGCGGDRDKGKRPLMGAIAEQFADIPVVTDDNPRTEEPRAIINDILAGMLDAGRARVVEGRAEAVTNAIMQAQENDVVLLAGKGHEDYQIVGNRRLDYSDRVTAARLLGVVA

SEQ ID NO: 9443 - protein, 471 aa, Enterobacter cloacae
TERLAGAARHCALLDYFADAGADWPGNAEGTLIMADYQGKKVVIIGLGLTGLSCVDFFLARGVTPRVMDTRVSPPGLDKLPEQVERHLGGLNDEWLLTADLIVASPGMALAHPSLSAAADAGVEIVGDIELFCREAQAPIVAITGSNGKSTVTTLVGEMAKAAGKNVGVGGNIGLPALMLLDKGCELFVLELSSFQLETTSSLHAAAATILNVTEDHMDRYPFGLQQYRAAKLRVYENAKVCVVNADDALTMPVRGADDRCISFGINMGDYHLNRQQGETWLRVKGEKVLNVKEMMLSGQHNYTNALAALALADAVGLPRSSSLKALTTFTGLAHRFQLALEHNGVRWINDSKATNVGSTEAALNGLHVDGTLHLLLGGDGKSADFSSLKQYLNGDNVRLYCFGRDGSELAALRPEVAEQTETMEQAMRLIAPRVKPGDMVLLSPACASLDQFKNFEQRGDVFTRLAKELG

SEQ ID NO: 9444 - protein, 492 aa, Enterobacter cloacae
RMNTQQLAKLRSIVPEMRRVRHIHFVGIGGAGMGGIAEVLANEGYQISGSDLAPNPVTQQLASLGATIYFNHRPENVSDASVVVVSSAISADNPEIVAAHEARIPVIRRAEMLAELMRFRHGIAVAGTHGKTTTTAMVSSIYAEAGLDPTFVNGGLVKAAGVHARLGHSRYLIAEADESDASFLHLQPMVAIVTNIEADHMDTYQGDFENLKQTFINFLHNLPFYGRAVMCVDDPVIRELLPRVGRQITTYGFSEDADVRVEDYKQIGAQGHFTLARQDKDLLHVTLNAPGRHNALNAAAAVAVATEEGIDDEAILRALESFQGTGRRFDFLGEFPLEPVNGKPGSAMLVDDYGHHPTEVDATIKAARAGWPEKNLVMIFQPHRYTRTRDLYDDFANVLSQVDTLLMLDVYAAGETPIPGADSRSLCRTIRGRGKVDPILVPDPAQVAEMLAPVLTGNDLILIQGAGNIGKIARTLAEIKLKPQTQEDERHG

SEQ ID NO: 9445 - protein, 340 aa, Enterobacter cloacae
TLLLLLIRPCWRRNQGERLKHGGRKRGVMLFGSFRGPFLYCFYRYGQLVSFRTLGRTESMAEPQNDPLLPGYSFNAHLVAGLTPIEAEGYLDFYVDRPLGMKGYILNLTVRGEGVVKNGDQQFICRPGDMLLFPPGEIHHYGRHPDAKEWYHQWVYFRPRAYWQEWLSWPAIFAHTGLYRPDEAHLAQFRELFAQIIEAGQAGGRYAELLAINLLEQVLLRRMEAINESLNPPLDNRVRDACQYISDHLADSQFDIASVAQHVCLSPSRLSHLFRQQLGVSVLSWREDQRISQAKLLLSTTRMPIATVGRNVGFEDQLYFSRVFKKCTGASPSEFRAGCE

SEQ ID NO: 9446 - protein, 584 aa, Enterobacter cloacae
PSITKAWRQSMEMLSGAEMVVRSLIDQGVKQVFGYPGGAVLDIYDALHTVGGIDHVLVRHEQAAVHMADGLARATGEVGVVLVTSGPGATNAITGIATAYMDSIPLVILSGQVATSLIGYDAFQECDMVGISRPVVKHSFLVKQTEDIPGVLKKAFWLAASGRPGPVVVDLPKDILNPANKLPYLWPESVSMRSYNPTTQGHKGQIKRALQTLLAAKKPVVYVGGGAVNAACETQLRELIEKLNLPVASSLMGLGAFPATHRQALGMLGMHGTYEANMTMHHSDVIFAVGVRFDDRTTNNLAKYCPHATVLHIDIDPTSISKTVPADVPIVGDARQVLDQMLDLLAQETASQPLDEIRDWWQQIEQWRGRQCLKYDTQSENIKPQAVIETIWRLTNGDAYVTSDVGQHQMFAALYYPFDKPRRWINSGGLGTMGFGLPAALGVKLALPNETVICVTGDGSIQMNIQELSTALQYELPVLVLNLNNGYLGMVKQWQDMIYSGRHSQSYMKSLPDFVRLAEAYGHIGMRVTDPSELEAKLGEALEHVKNNRLVFMDVIVDGTEHVYPMHIRGGGMDEMWLSKTERT

SEQ ID NO: 9447 - protein, 337 aa, Enterobacter cloacae
GAIVKLDEIARLAGVSRTTASYVINGKAKQYRVSDKTVEKVMAVVREHNYHPNAVAAGLRAGRTRSIGLVIPDLENTSYTRIANYLERQARQRGYQLLIACSEDQPDNEMRCIEHLLQRQVDAIIVSTSLPPEHPFYQRWANDPFPIVALDRALDREHFTSVVGADQDDAEMLAAELRTFPAETVLYLGALPELSVSFLREQGFRTAWKDDPRDVHYLYANSYEREAAAQLFEKWLETHPMPQALFTTSFALLQGVMDVTLRRDGKLPSDLAIATFGDNELLDFLQCPVLAVAQRHRDVAERVLEIVLASLDEPRKPKPGLTRIKRNLYRRGILSRH

SEQ ID NO: 9448 - protein, 170 aa, Enterobacter cloacae
TPSGGNLWVKVVRRGETGMFRGATLVNLDSKGRLSVPTRYRDQLIENASGQLVCTIDINSPCLLLYPLPEWEIIEQKLSRLSSMNPQERRVQRLLLGHASECQMDSAGRLLIAPVLRQHAGLTKEVMLVGQFNKFELWDETTWYQQVKEDIDAEQSDSETLSERLRDLSL

SEQ ID NO: 9449 - protein, 375 aa, Enterobacter cloacae
CRHGRGCARITGERDMLVWLAEHLVKYYSGFNVFSYLTFRAIVSLLTALFISLWMGPRMIARLQKLSFGQVVRNDGPESHFSKRGTPTMGGIMILTAIVVSVLLWAYPSNPYVWCVLTVLVGYGIIGFVDDYRKVVRKDTKGLIARWKYFWMSVIALGVAFALYLAGKDTPATELVVPFFKDVMPQLGLFYILLAYFVIVGTGNAVNLTDGLDGLAIMPTVFVAGGFALVAWATGNMNFANYLHIPYLRHAGELVIVCTAIVGAGLGFLWFNTYPAQVFMGDVGSLALGGALGIIAVLLRQEFLLVIMGGVFVVETLSVILQVGSFKLRGQRIFRMAPIHHHYELKGWPEPRVIVRFWIISLMLVLIGLATLKVR

SEQ ID NO: 9450 - protein, 368 aa, Enterobacter cloacae
NASGESSGVYTRFTMNQPKRLMVMAGGTGGHVFPGLAVAHHLMEQGWQVRWLGTADRMEADLVPKHGIEIDFIRISGLRGKGIKALLLAPVRIFNAWRQARAIMKRFKPDVVLGMGGYVSGPGGLAAWSLGIPVVLHEQNGIAGLTNKWLAKIATKVMQAFPGAFPKADVVGNPVRVDVLALALPDTRLAGREGPVRVLVVGGSQGARILNQTMPQVAAKLGDAVTIWHQSGKGAQQTVEQAYAQEGQPQHKVTEFIDDMAAAYAWADVVVCRSGALTVSEIAAAGLPALFVPFQHKDRQQYWNALPLEKAGAAKIFEQPQFTADAVATTLAGWNRDVLLEMAQRARATAIPDATERVAKEVSLAAQA

SEQ ID NO: 9451 - protein, 315 aa, Enterobacter cloacae
SRKLRRTSVMADKIAVLFGGTSAEREVSLNSGAAVLAGLREGGVDAHPVDPKEVDVTQLKAMGFDKAFIALHGRGGEDGTLQGLLELIGIPYTGSGVMASAISMDKLRSKLLWQGAGLPVAPWVALTRREYELGLSDSVNTRIAALGLPVIVKPSREGSSVGMSKVDKAVDLADALALAFQHDEEVLIEKWLSGPEFTVAMLGEEILPSIRIQPAGVFYDYEAKYLSDETQYFCPAGLEAEREAELQSLVLKAWNVLGCRGWGRIDVMLDGDGQFYLLEANTSPGMTSHSLVPMAARQAGMSFSQLVVRILDQAG

SEQ ID NO: 9452 - protein, 154 aa, Enterobacter cloacae
FIDTPPAGAILAAKLLPETGGDTLWASGIAAFEALSAPLQTLLSGQRAEQDFKKSFQENKNRKTEEEHQRRQEAVEKHPTTSQQHPEERTHPETGKQAQKEKEGKTTRIEDEAEKESEAQLGNQKAQITKPENQERRRRQENDQAIRDNRVTQH

SEQ ID NO: 9453 - protein, 243 aa, Enterobacter cloacae
PSDRLVKTIVQATGVGLHTGKKVTLTLRPAPANTGVIYRRTDLNPPVDFPADAKSVRDTMLCTCLVNEHDVRISTVEHLNAALAGLGIDNIMVEVDAPEIPIMDGSAAPFVYLLLDAGIEELNCAKKFVRIKETVRVEDGDKWAEFKPYNGFSLDFTIDFNHPAIDSSTQRYAMNFSADAFMRQISRARTFGFMRDIEYLQSRGLCLGGSFDCAIVVDDYRVLNEDGLRFENEFVRHKMLDAI

SEQ ID NO: 9454 - protein, 281 aa, Enterobacter cloacae
HEVALIYPGDPMAIKLIAIDMDGTLLLPDHTISPAVKNAIAAAREKGVNVVLTTGRPYAGVHSYLKELHMNQPGDYCITYNGALVQKAADGSTVAQTALSYDDYRFLEKLSRDVGSHFHALDRNTLYTANRDISYYTVHESYVATIPLVFCEAEKMDPATQFLKVMMIDEPAVLDKAISRIPAEVKEKYTVLKSAPYFLEILDKRVNKGTGVKSLADALGIKPEEIMALGDQENDIAMIEYAGMGVAMDNAIPSVKEVANFVTKSNLEDGVAWAIEKFVLS

SEQ ID NO: 9455 - protein, 325 aa, Enterobacter cloacae
SAVRCDTASGRRCGRAGGADHDRQLDTKVEGNHMTSRYIAIDWGSTNLRAWLYQGEQCLESRQSEAGVTRLNGKSPAAVLAEVTQNWRDGTTPVVMAGMVGSNVGWKVAPYLSVPVHFTAVGEQLTSVGDNVWIIPGLCVSRDDNHNVMRGEETQLLGARTLSPSSVYVMPGTHCKWVQADAEQIHDFRTVMTGELHHLLLKHSLVGTGLPEQTPSPEAFAAGLERGIASPAVLPQLFEVRASHVLGNLPREQVSEFLSGLLIGAEVATLSDAFAGQQAITLVAGSSLTSRYRQAFHAIGRDVAAVEGDTAFQAGIRSIAHAVAN

SEQ ID NO: 9456 - protein, 111 aa, Enterobacter cloacae
TGEDGLQAYRHTEYEPRGDPPGGGVRHDRLPGLRHGYRSLCRPRCRRTVSQNFPVVGLWSGLHQSAESGLTRQRAGLCRGRRHAGKPGAVDKSGLCGRRAGQRSLSCRTAR

SEQ ID NO: 9457 - protein, 400 aa, Enterobacter cloacae
AYRTAGGSICESVSRGSAMKITKLTTYRLPPRWMFLKIETDEGVVGWGEPVIEGRARTVEAAVHELGEYLIGQDPARINDLWQVMYRAGFYRGGPILMSAIAGIDQALWDIKGKVLNAPVWQLMGGLVRDKIKAYSWVGGDRPAEVIDGIRQLRNIGFDTFKLNGCEEMGVIDNSRAVDRAVNTVAQIREAFGNEIEFGLDFHGRVSAPMAKVLIKELEPYRPLFIEEPVLAEQAEYYPKLAEQTHIPIAAGERMFSRFEFKRVLEAGGIAILQPDLSHAGGITECYKIAGMAEAYDVALAPHCPLGPIALAACLHVDFVSRNAVFQEQSMGIHYNKGAELLDFVKNKEDFSMEGGFFKPLTKPGLGVEIDEAKVIELSKSAPDWRNPLWRHEDGSVAEW

SEQ ID NO: 9458 - protein, 465 aa, Enterobacter cloacae
RIPFTFLIKKTKYTLCKLQGMVSGFAMPKIWRQIAMDIPVTAAKTGRRRYLTLIMIFITVVICYVDRANLAVASAHIQEEFGITKAEMGYVFSAFAWLYTLCQIPGGWFLDRVGSRLTYFIAIFGWSVATLFQGFATGLMSLIGLRAITGVFEAPAFPTNNRMVTSWFPEHERASAVGFYTSGQFVGLAFLTPLLIWIQELLSWHWVFIVTGGIGIIWSLIWFKVYQPPRLTKSITKAELDYIRDGGGLVDGDAPVKKEARQPLTRADWKLVFHRKLVGVYLGQFAVTSTLWFFLTWFPNYLTQEKGITALKAGFMTTVPFLAAFFGVLLSGWLADKLVKKGFSLGVARKTPIICGLLISTCIMGANYTNDPVWIMTLMAVAFFGNGFASITWSLVSSLAPMRLIGLTGGVFNFVGGLGGITVPLVIGYLAQDYGFGPALVYISAVALIGALSYILLVGDVKRVG

SEQ ID NO: 9459 - protein, 426 aa, Enterobacter cloacae
SLRMFYPDAITAHQGIFMKQITFASRNHQLTNINTWTPDSQWLVYDVRPSGASFTGETIERVNVSTGEVEAIYRATDGAHVGVVTVHPAQDKYVFIHGPKNPDADWQYDFHHRQGVIAHNGQVSNLDAMDITAPYTAGALRGGTHVHVFSPNGQFVSFTYNDHVLHARDPQLDLRNVGVAAPFGPVNPQGNHPREYAGTFWSVLVSRTTPNPKPGSDEVNRAYEEGWVGNDRLAFIGDTVSAKGEKVPELFIVDLPKDEQGWKRAGDAPLQGTPDTMPAPPAGVMQRRLTFTHQKAYPGLVNVPRHWVRSNPQGTQVAFLMRDDNGVVQLWLISPEGGEPRQLTHSESDIQSAFNWHPSGRTLGFVLESRIACCDAQTGEVTFLTSDHGNPPSADAVVFSPDGRFIAWMEAKDGFRQLWLTETAQN

SEQ ID NO: 9460 - protein, 154 aa, Enterobacter cloacae
TVPNSLLRRRFSMRNYDFSPLLRQWIGFDKLANALQSATEQQTFPPYNIEKSDDNHYRITLALAGFRQEDLDIQLEGARLTVKGSPEKPDTETKWLHQGLVTQPFSLSFTLADHMEVSGATFTNGLLNIDLTRNVPEAIAPQRIAISERPALNS

SEQ ID NO: 9461 - protein, 616 aa, Enterobacter cloacae
SCAGWCPHPDPLPVGEGANTKNGHLRVTVLRLPSAFLCAIAHTTAASSERILIITKVIHRMWNMSDIALTVSVLALVAVVGLWLGNIKIRGVGFGIGGVLFGGIFVGHFADQLGWVLSADMLHFIQEFGLILFVYTIGIQVGPGFFASLRISGLRLNLFAFGIVVMGGLVTAILHKLFAIPLPVVLGIFSGAVTNTPALGAGQQILRDLGIPADVVDQMGMSYAMAYPFGICGILLSMWLVRVLFRVNVGQEAKEHESTLTNGHALIKTINIRVENPNLNNMAIQDVPILNSATIICSRLKRDDTLMVPSPDTLIQHGDLLHLVGQPADLNNARLVIGQEVDTSLSTRGTDMRVERVVVTNEKVLGKKIRDLQVKERYDVVISRLNRAGVELVASQDASLQFGDILNLVGRPSSIDAVADMVGNAQQKLQQVQMLPVFIGVGLGVMLGSIPLYVPGFPVALKLGLAGGPLIMALILGRIGSIGKLYWFMPPSANLALRELGIVLFLAVVGLKSGGDFVDTLVNGEGMSWVGYGIFITAIPLITVGLLARMFAKMNYLTLCGMLAGSMTDPPALAFANNLHATSGAAALSYATVYPLVMFLRIITPQLLAVLFWGMG

SEQ ID NO: 9462 - protein, 557 aa, Enterobacter cloacae
KTIKASIPYRLFHEDLKMLSQIQRFGGAMFTPVLLFPFAGIVVGIAIMLRNPLFVGEALTAPDNLFAQIVHIIEEGGWAVFRNMPLIFAVGLPIGLAKQAQGRACLAVLISFLTWNYFINAMGMTWGHFFGVDFSAEPTAGSGLAMIAGIKTLDTSIIGAIIISGLVTAIHNRFFDKPLPVFLGIFQGTSFVVILAFFVMIPCAWLTLLGWPKVQMGIESLQAFLRTAGALGVWVYTFLERILIPTGLHHFVYGPFIFGPAAVEGGIQVYWAQHLQEFSQSTVPLKTLFPEGGFALHGNSKVFGSVGIALAIWYTASPENRVKVAGLLIPATLTAVLVGITEPLEFTFLFISPLLFAIHAVLAATMATVMYIFGVVGNMGGGLLDQFLPQNWIPMFHNHASTVFTQIGIGLCFTGIYFVVFRTLIERLNLKTPGREESEIKLYSKADYKAARGQTTAPAAASQQVGQAAGFLQALGGAANIESINNCATRLRIALVDMTKTQSDDVFKALGAHGVVRRGNGIQVIVGLHVPQVRDQLESLMKTPLTNEQTTLTEAIS

SEQ ID NO: 9463 - protein, 236 aa, Enterobacter cloacae
YVSSRSDNERKQECAAKCKHRGDKRRRRIVFEGLIQGRAAVLLNQPEERIGHDRAANSAGPDGNGDDLRAYVRVERQHRRHYRRGTHHRYRCRTHGGVQHQCHQPGEKDRVHMQVRENMRQRLRQTTGFKDGVERPARTDNQQNVGDRAKAVLRMGQHCAHAHVLADPQQVIGDKHGDKHRGDGVADKLQQGIQRAFFRHVQLGNGFHQHQGNRQQHGEQRGAQRRQSVLFPHLQV

SEQ ID NO: 9464 - protein, 317 aa, Enterobacter cloacae
TQKLRVGIVMTDANEGRNRLLNGWQLSKMYTFEVAARHESFALAAAELSLSPSAVSHRINLLEEELGIQLFVRSHRKVELTQEGKRVYWTLKSSLDTLNQEILDIKNQALSGTLTVYSRPSIAQCWLVPMLGDFTRRYPSISLTILTGNDYVNMQRTGIDLALYFDDTPPNHLSHHFLMDEEILPVCSPAYAREHELLKNPHNLSHCTLLHDRQAWSNDSGTDEWLSWAQHFAVNMPLSSGIGFDRSDLAIIAAMSNVGVAMGRKRLVQKRLERGELIAPFDGETLKCHQHYYVSTLPGRQWPKIDAFIGWLRELAG

SEQ ID NO: 9465 - protein, 371 aa, Enterobacter cloacae
TVLKPFIATAILLSSGWATAAEPPLTAARYAQMLGVGMDVDWARTERGIREFDPLVVRDFQAKGIHHVRIRVAGEPTEARLIHLRKLVEACEQYGVIPIIAYQADEYKNDPKADTEKEVINWWIAVAHYFGQRSPLLGFDLIYEPADKLNHNVASLNRVYEKAIKDIHAIDASRMIFIAPRLRAAPEDLSTLKLPAHSQNYLLAEWHIFPWGPLKTNGKYPWTSGTAAEKAAIRNRINAALHWQQKTGHVSWVGGWGVGESKSLTPTASQMAFATFMACELQHANIPYAINADVQFYDGEEGAWRPAPERLLQAMIAPVCEKPGEKPGHHAVKPAVRDARHATPAAASTAKSAAPSGSSASLNSPARSAAS

SEQ ID NO: 9466 - protein, 153 aa, Enterobacter cloacae
GERMVWIMLATLAVVFVVGFRVLTSDSRRAIKRLSERLGITPMPVESMIDQFGKTPGNEFIRYLERPDEAHLQNAAQVLLIWQVCIVDGSEENLHTWHRMLRKARLAAPITDAQIRLALGFMREIEPDPQELDAFQLRYNQLFLPEEGVFYLH

SEQ ID NO: 9467 - protein, 410 aa, Enterobacter cloacae
TARLFRTFLSSGDAMTEHIQPTTRPQTKEVSRPNWSAVFSVAFCVACLITVEFLPVSLLTPMAQDLGISEGVAGQSVTVTAFVAMFASLFITQAIGTIDRRKVVILFSVLLTLSCLLVSFAESFTLLLLGRACLGLGLGGFWAMSASLTMRLVPARTVPKALSVIFGAVSIALVIAAPLGSFLGGIIGWRNVFNAAAVMGVLCIIWVWKALPSLPGEAAHHKQNMFALLKRPGVLAGMTAIFMAFAGQFAFFTYIRPVYMTMAGFDVDGLTLVLLSFGIASFVGTSLSSQFLKRSLKVALAGAPLVLAISAAVLVLWGSDKWVASAIAIIWGFAFALVPVGWSTWITRSLADQAEKAGSIQVAVIQLANTCGAAVGGVALDHLGLTSPLVISGTLMLLTALLVAGKVKAK

SEQ ID NO: 9468 - protein, 374 aa, Enterobacter cloacae
RCRITVGCLCCYANETVMSLTRLLIRDFRNIESADLALSPGFNFLVGANGSGKTSVLEAIYTLGHGRAFRSLQIGRVIRHEQDSFVLHGRLQGEERETAIGLTKDKQGDSKVRIDGTDGHKVAELALLMPMQLITPEGFTLLNGGPKYRRAFLDWGCFHNEAGFFNAWSNLKRLLKQRNAALRQVTRYAQLRPWDMELIPLAEQISRWRAEYSAGIAEDMADTCKQFLPEFSLTFSFQRGWEKETDYAEVLERSFERDRMLTYTAHGPHKADFRIRADGAPVEDTLSRGQLKLLMCALRLAQGEFLTRESGRRCLYLIDDFASELDDARRGLLASRLKATQSQVFVSAISAEHVMDMSDENSKMFTVEKGKITD

SEQ ID NO: 9469 - protein, 345 aa, Enterobacter cloacae
QEKKMTATMQRWSMDALGRESLRLVQEPVPQPGSGEVRVRVNAVALNYRDKMVIEGTMPIPLSFPFTPASDMAGVVDSIGEGVTRFKPGARVISTFFPEWIDGKPQADARDLPYKTSGGYFQGMLAEYVIVSENALVASPESLDDAEASTLPCAGLTAWFALVERGHLRAGQSVLVQGTGGVALFALQIAKAHGAEVFVSSGSDEKLARAKKLGASQGINRLKGDWAENTLALTQDRGIDHIIETVGGENLRHSLRAVAVHGRISVIGVLAGTEISLPASELLLKSPVIQGIGVGHRRALEDFVRAVDVTELKPVIEHRYRFDELEQALEHLDRGAFGKIVLTRE

SEQ ID NO: 9470 - protein, 238 aa, Enterobacter cloacae
WTYRAQGLSMTLNKTDRIVITLGTQIVGGKYVPGSPLPAEAELCEEFETSRNIIREVFRSLMAKRLIEMKRYRGAFVAPRNQWNYLDTDVLQWVLENDYDPRLIGAMSEVRNLVEPAIARWAAERATSGDLAQIESALNDMIANNQNREAFNEADIRYHEAVLQSVHNPVLQQLSVAISSLQRAVFERTWMGDEANMPKTLQEHKALFDAIRHQDGDAAEQAALTMIASSTRRLKEIT

SEQ ID NO: 9471 - protein, 209 aa, Enterobacter cloacae
GASLMQWQTELPLIAILRGITPGEALAHVGAVIDAGFDAVEIPLNSPEWEKSIPAIVKAFGDKALIGAGTVLQPEQVDELAKMGCKLIVTPNMNPEVIRRAVEYGMTVCPGCATATEAFAALDAGAQSLKIFPSSAFGPDYIKALKAVLPASVPVFAVGGVTPENLVQWIKAGCVGAGLGSDLYRAGQPVERTAQQAAAFVKAYREAVQ

SEQ ID NO: 9472 - protein, 125 aa, Enterobacter cloacae
SLHAARQGTFMNISRLGEAPDYRFSLANERTFLAWIRTALGFLAAGVGLDQLAPDFATPLIREVLALLLCLIAGVLAIYGYLRWLRNEKAMRLKQDLPYTRGLLIISTILLMVAGVVMLLVLYAG

SEQ ID NO: 9473 - protein, 152 aa, Enterobacter cloacae
TITVPTSAPNLLVTNSAAGCGGTTQCTAISAVQSGMASLSSDVLVFLAMENASGISSTTPTSTNSVMPQIRPTRTIITSADSQRQRCNVIPMRSAAPETSIILPRIVPRPITAARKPSVPPIPLSMALTISSGLIPIIAPTKKLASSSARNG

SEQ ID NO: 9474 - protein, 142 aa, Enterobacter cloacae
GEEMMIVADAMKATHALVAAVPLLGEQPSEKDYKDALELVEYLLMNEPNSPLLDIVCARISRYEANRPEIVALRKEMESVPVGIAVLRTLMDQYNLTISDFKDEIGSKSMVSRVLNGQRQLTLNHIKKLAARFGVSPALFIE

SEQ ID NO: 9475 - protein, 576 aa, Enterobacter cloacae
TTTRKAGSEEKDWSMASSGTTSTKTRFTGAQLIVHLLERQGITTVAGIPGGTVLPLYDALSQSTQIRHVLARHEQGAGFIAQGMARTQGKPAVCMACSGPGATNLVTAIADARLDSIPLICITGQVPSSMIGTDAFQEVDTYGISIPITKHNYLVRDISELPQVISDAFRIAQSGRPGPVWIDIPKDVQTAEIEIDILPEPGERAPAPEFSAESVRDAAAMINAAKRPVLYLGGGAINAADEIRQFAEKANLPTTMTLMALGMLPKAHPLSLGMLGMHGARSTNYILQEADLLIVMGARFDDRAIGKTEQFCPNAKIIHVDIDRAELGKIKQPHVAIQGDVAEVLAQLIPQTVATDRADWRQLVADLQREFPGAIPTEGDPLSHYGLINAVAACVDDSAIITTDVGQHQMWTAQAYPLNRPRQWLTSGGLGTMGFGLPAAVGAALANPDRKVICFSGDGSLMMNIQEMATAAENQLDVKIILMNNEALGLVHQQQSLFYKQGVFAATYPGMINFMQIAAGFGLHTCDLNAEEDAHAALQDAISRPGPALIHVRIDPEQKVYPMVPPGAANTEMVGE

SEQ ID NO: 9476 - protein, 96 aa, Enterobacter cloacae
AMQKQHDNVILELTVRNHPGVMTHVCGLFARRAFNVEGILCLPIQGSEHSRIWLLVNDDQRLEQMIAQIDKLEDVTKVARNQSDPTMFNKIAVFFE

SEQ ID NO: 9477 - protein, 504 aa, Enterobacter cloacae
QLAMNSLFSRLIAVVASFFIFSAAWFCLWSISLHLVERPELAVLLFPFGLRLGLMLQCPRGYWPVLLGAEWLMLIWLAQEVALAHLPLLMTGSLLTLIPVALISRYRHQRDWRTLLRQGAALIAAALLQSLPWVGEKEVLNALLLTLTGGLTLAPTCLVIWHYLTSTVWQPLGPALVSQPVNWRARHLIWYLLLFVVSLWLQLGLPAELSRFTPFCLALPIIALAWHYGWQGALIATLMNAIALIASQTWHDHPVDLLLSLLAQSLTGLLLGAGIQRLRELNQSLQNELARNRRLAERLLETEESVRQEVARELHDDIGQTITAIRTQAGIVQRLAAENAGVKQGGAHIEQLSLGVYDSVRRLLGRLRPRQLDDLSLEQAVRSLMREMELESRGIVSHLDWRISEPALSEGQRVTLFRVCQEGLNNIVKHASASAVTIQGWQQDERLMLVIEDDGCGLPPGSGQQGFGLAGMRERVKALGGTLSLSCTHGTRVSVSLPLRTHHV

SEQ ID NO: 9478 - protein, 338 aa, Enterobacter cloacae
RRACMLTRRLSCLALLMALASPAMAANAPTYGEKLEGFDYGWPVKHFTFTSQNQPLDMAYLDVKPEKPNGRTVVLMHGKNFCAGTWDGTIRALSASGYRVIAPDQIGFCKSTKPEHYQYTFQQLADNTHALLKTLGVDRVTVIGHSTGGMLATRYALMWPQQVEQLVMVNPIGLEDWKARGVPHITVDQWYQRELKVSADGIRQYEKNTYYAGEWKPEYERWVTMLAGLNNGPGKERVAWNSALLYDMIYTQPVIYEFSELSMPVLLMIGTKDNTAIGKDLAPPEIRKTLGNYAVLGKETAKRIPHATLVEFNDMGHAPQMQDPERFHEALLKGLQAR

SEQ ID NO: 9479 - protein, 176 aa, Enterobacter cloacae
TMKQSAIIWPNDYLPGTTDNFASNEIIVAGLSAKEIWAQLNDTTLWPNYYSNAEDIRFHDGSGPELSANARFRFTTFGFPVEAQVTEYVPPVDGEAARIAWHGWVEGDASSRLDVIHAWLFEDLPGNRVRILTQESQKGVPAQELARTVPNPMINGHQEWIVGLANAAMQEKLSKR

SEQ ID NO: 9480 - protein, 369 aa, Enterobacter cloacae
PPRTYEWLAGAVGNKPLQQVSGPLGGRPTLPILGNLLLQVADGTLSLTGTDLEMEMIARVTLTQPHDAGATTVPARKFFDICRGLPEGAEIAVQLEGDRMLVRSGRSRFSLSTLPAADFPNLDDWQSEVEFTLPQATMKRLIEATQFSMAHQDVRYYLNGMLFETEGEELRTVATDGHRLAVCSMPIGDSLPNHSVIVPRKGVIELMRMLDGGDTPLRVQIGSNNIRAHVGDFVFTSKLVDGRFPDYRRVLPKNPDKTLEAGCDILKQAFARAAILSNEKFRGVRLYVSENQIKITANNPEQEEAEEILDVTYAGAEMEIGFNVSYVLDVLNALKCENVRILLTDSVSSVQIEDAASQSAAYVVMPMRL

SEQ ID NO: 9481 - protein, 809 aa, Enterobacter cloacae
NERETLMSNSYDSSSIKVLKGLDAVRKRPGMYIGDTDDGTGLHHMVFEVVDNAIDEALAGHCKDIVVTIHADNSVSVTDDGRGIPTGIHPEEGVSAAEVIMTVLHAGGKFDDNSYKVSGGLHGVGVSVVNALSQKLELVIQREGKIHRQIYQHGVPEAPLAVTGDTEKTGTMVRFWPSLETFTNVTEFEYDILAKRLRELSFLNSGVSIRLRDKRDNKEDHFHYEGGIKAFVEYLNKNKTPIHPNIFYFSTEKDGIGVEVALQWNDGFQENIYCFTNNIPQRDGGTHLAGFRAAMTRTLNAYMDKEGYSKKAKVSATGDDAREGLIAVVSVKVPDPKFSSQTKDKLVSSEVKSAVEQQMNELLSEYLLENPSDAKIVVGKIIDAARAREAARKAREMTRRKGALDLAGLPGKLADCQERDPALSELYLVEGDSAGGSAKQGRNRKNQAILPLKGKILNVEKARFDKMLSSQEVATLITALGCGIGRDEYNPDKLRYHSIIIMTDADVDGSHIRTLLLTFFYRQMPEIVERGHVYIAQPPLYKVKKGKQEQYIKDDDAMDQYQIAIALDGATLHANSSAPALAGEPLERLVSEFNATQKMIGRMERRYPKALLKELIYQPTLTEADLSNEQTVTRWVNTLVSELNEKEQHGSQWKFDVQQNAEQQFEPIVRVRTHGVDTDYPLEHEFVTGPEYRRICTLGEKLRGLIEDDAFIERGERRQPVASFEQALEWLVKESRRGLSIQRYKGLGEMNPDQLWETTMDPESRRMLRVTVKDAIAADQLFTTLMGDAVEPRRAFIEENALKAANIDI

SEQ ID NO: 9482 - protein, 142 aa, Enterobacter cloacae
FQEHLSMRNFDLSPLYRSAIGFDRLFNHLENNQSQSNGYPPYNVELVDENHYRIAIAVAGFAESELEITAQDNLLVVKGSHAGEQKERTYLYQGIAERNFERKFQLAENIHVKGANLVNGLLFIELERVIPEEKKPRRIEIN

SEQ ID NO: 9483 - protein, 492 aa, Enterobacter cloacae
RIQSPGRTRCGAARQRHTGDCRSARSSGARPAGIADENPFNKRTNHSDRGYIMKKFSVVIAGGGSTFTPGIVLMLLANRDRFPLRALKFYDNDGARQEIIAEACKIILKEQAPEIEFSYTTDPEAAFTDVDFVMAHIRVGKYPMREKDEKIPLRHGVLGQETCGPGGISYGMRSIGGVLELVDYMEQYSPNAWMLNYSNPAAIVAEATRRLRPNAKILNICDMPIGIEGRMAQIVGLKDRKEMRVRYYGLNHFGWWTSIEDQNGNDLMPKLREYVAKNGYVPPSEDVHTEASWNDTFAKAKDVQALDPDTMPNTYLKYYLFPDYVVAHSNPERTRANEVMDHREKHVFSSCRAIIEAGHSSAGELEIDEHASYIVDLATAIAFNTQERMLLIVPNNGAIHNFDADAMVEIPCLVGHNGPEPLTVGDIPHFQKGLMSQQVAVEKLVVDAWEQRSYQKLWQAITLSKTVPSASVAKAILDDLIEANKDYWPELH

SEQ ID NO: 9484 - protein, 120 aa, Enterobacter cloacae
CYWCCMPDSRKARREADPGLQPERTSLAWLRTLLGYGALIALAIKHNWHRTGAPFWISIVVLALVAIILWRYTRSRNLMDVSQNDFAQPKAVRDKFLIALAVLSLSLLFAVTHIQQILHL

SEQ ID NO: 9485 - protein, 113 aa, Enterobacter cloacae
WQWTRQASRMHLISMKAILDAVSQFPQHREELLFLGRVIEKSHCPTPAALRKLFPTLDNFKYLDKHYVIDIANNNLRVVALIFFESQKFYVRHVFTHKEYDRFTEKHRTKGKK

SEQ ID NO: 9486 - protein, 255 aa, Enterobacter cloacae
RRSTSWKTSPKWRATSPIPPCLTKLRCSSNRSLKVSVFRSCRPDKRSAIRLFQTAGTHMTTIALIDDHLIVRSGFAQLLNLEPDFQVVAEFGSGREALAGLPGRGVQVCICDISMPDLSGLELLSQLPKGMATIMLSVHDSPALVEQALNAGARGFLSKRCSPDELIAAVRTVSTGGCYLTPDIAIKLAAGRQDPLTRRERQVAEKLAQGMSVKEIAVELGLSPKTVHVHRANLMEKLNVSNDVELARRMFDSWQ

SEQ ID NO: 9487 - protein, 439 aa, Enterobacter cloacae
GRIMFKTPASAAPLSNKAEIDSRYRYWRRHILITIWLGYALFYFTRKSFNAAAPEILASGVMTRTDIGLLATLFYITYGLSKFFSGIVSDRSNARYFMGVGLIATGVVNILFGFSTSLWAFALLWALNAFFQGWGAPVCARLLTAWYSRNERGGWWAIWNTAHNVGGALIPMVVGAAALHYGWRAGMMIAGGLAIVAGLFLCWRLRDRPQTVGLPPVGDWRHDEMEIAQQQEGAGLSRQEILTKYVLKNPYIWLLSLCYVLVYVVRAAINDWGNLYMSETLGVDLVTANSAVTMFELGGFIGALVAGWGSDKLFNGNRGPMNLIFAAGILLSVGSLWLMPFASYVMQAACFFTIGFFVFGPQMLIGMAAAECSHKEAAGAATGFVGLFAYLGASLSGWPLARVIDIWHWSGFFAVIAIAAGISALLLLPFLHAQAPREA

SEQ ID NO: 9488 - protein, 507 aa, Enterobacter cloacae
RASPFAAETRKTKKFSRFHLDAVSGISPGWFLQCCKNQLRSKPTMLAFLNQVRKPTLDLPLDVRRKMWFKPFMQSYLVVFIGYLTMYLIRKNFNIAQNDMISTYGLSMTQLGMIGLGFSITYGVGKTVVSYYADGKNTKQFLPFMLILSAICMLGFSASMGAGSVSLFLMIAFYALSGFFQSTGGSCSYSTITKWTPRRKRGSYLGMWNISHNLGGAGAAGVALFGANYLFDGHVIGMFIFPSIIALIVGFIGLRYGSDSPESYGLGKAEELFGEEISEEDKDTEENEMTKWQIFVEYVLKNKVIWLLCFSNIFLYVVRIGIDQWSTVYAFQELKLSKEVAIQGFTLFEVGALVGTLLWGWLSDLANGRRALVACIALALIIATLGVYQHASNQYVYLASLFALGFLVFGPQLLIGVAAVGFVPKKAIGAADGIKGTFAYLIGDSFAKLGLGMIADGTPIFGLTGWAGTFAALDAAAIGCIVLMAMVAVLEERKIRRENRAQKLKVA

SEQ ID NO: 9489 - protein, 104 aa, Enterobacter cloacae
RVMMMIALEEAVMEIIVNAGQSRSLCFEALHAARQGNLDEAKSLLREADGYARQAHKMQTKLIEQDAGEARQPMTLIMVHAQDHLMNSLLARELSEEIIHLYQR

SEQ ID NO: 9490 - protein, 468 aa, Enterobacter cloacae
IKLNYIEITMNTIKKLPLTMAVIAALCPISVLAQEFTQEQIDAIVAKAVDKALAERQAKMDAAVAKKADVVTEPQSAAQSPDMAIPFGVKFTGYARYGAHFQAADQKYVAVDGSYNGASAIGRLGNEGNGGEFQLSKAFKGENGAIWDINVMIDHWGDEVNLKKAYAGVTNIMASNPNAYFWAGRDFHQRPQQGINDYFWMNHDGQGAGVKNFDIGGVQFDVAAVAAVESCSPEVMEDEANPSRITCTGGSGTGDKGNYAATSKIHGMKLGPLDLELYANYGFDSKAVESDERLNAWQGGVVLSHTNDSGVNKVIARYSDNSDNSVFNKTEDLTTVYASFEGLYKFTQATQVEYILAFHDYDNSRDKTDNRKNYNAIVRPMHWWNDVHSTWLEAGWQHVDYDNGGDNKGWKLTLSQNMSIAMGPEFRPMLRFYVTGGKVDNERTARVNNTKDETLDDFNVGAMWEAWF

SEQ ID NO: 9491 - protein, 349 aa, Enterobacter cloacae
SKSKTATKVAVFNVRSLSPWERAGVRASGRTQPCYAVDRINDNITGENMGSTRKGMLNVLIAAVLWGSSGVCAQYIMEKSHISSPYLTMVRLLFTGVILLTLSFVHGDKIFSVIKNRKDALSLLFFSLVGALTVQLTFLLTIEKSNAATATVLQFLSPTIIVAWFALARKTRPGIFVLSAIFTSLVGTFLLVTHGDPTSLSISPAALFFGIASAFAAAFYTTYPSTLIARYGTLPIVGWSMLIAGLMLTPFYAGRGTTFVIDGGLLLAFFYLVVIGTALTFSLYLKGAQMIGGPKASILSCAEPLSSALLSVVLLGVAFTLPDWLGTLLIVSSVVLISMDSRRRVKASA

SEQ ID NO: 9492 - protein, 303 aa, Enterobacter cloacae
QNIMKADLRTLDLNLLKTLDALLDERSVTRAAARLALTQPAVSGMLNRLRDYFDDPLFIRAPHGMVPTTRAEALAAPVKRILADIDVLLQPVAFDPNTARLTFTLAATDYALRAVVVPFIAALKTQAPGIRVRVVPVTPGSLVSQLEQGAIDVALITPHTTPDELHSRALYDERYVCMMRADHPNAGEPMTLDRFCALEHVLVSYEGDGFRGVTDSALEKIGRTRHVGLSVSHFLVLPDVLALSDMIAVVPSRIAENQTGMFICETPVPVPGFTKSMAWHGRTHRNPAQAWLRGLLLQTSQRA

SEQ ID NO: 9493 - protein, 446 aa, Enterobacter cloacae
DMGSQVWVVATLLVSIVLIVLTIVKLKFHPFLALLLASFFVGAMMGMSPLDMVNAIESGIGGTLGFLAAVIGLGTILGKMMEVSGAAERIGITLQRCRWLSADVIMVLVGLICGITLFVEVGVVLLIPLAFSIAKKTNTSLLKLAIPLCTALMAVHCVVPPHPAALFVTNKLGADVGTVIVYGLMVGLMASLVGGPLFLKLLGNHLPYKPVPAEFSDLKVREEHTLPSLGATLFTVLLPIALMLVKTIAELNMAKEGSLYTLLEFIGNPITAMFIAVFVAYYLLGIRQHMGMGAMLTHTEHGFGSIANILLIIGAGGAFNAILKTSGLAETLAHILSNLHMHPILLAWLVALVLHAAVGSATVAMMGATAIVAPMLPLYPNVSPEIITIAIGSGAIGCTIVTDSLFWLVKQYCGATLNETFKYYTTATFIASVLALGGTFLLSFII

SEQ ID NO: 9494 - protein, 251 aa, Enterobacter cloacae
CAQRGLLVIYKSIADRLRLRLNSSDYNIGSPLPGEKALAKEFGVARMTVRKALDLLVSWGLVERRHGSGTFVARKDVHHETTNLTGLVEVLRQQGKEVQSKVLQFEVMPAPPAIASQLRIQVDERIYFSRRVRYVDGKPLMLEDSFMPVKLFRNLSLAHLEGSKFDYIEKECGITISGNYESLTPVLADKQLAGYMNVPEQTPLLRITSLSYSDSGEFLNYSVMFRNTSDYQVDYHLRRIHPEDLLAHPPE

SEQ ID NO: 9495 - protein, 113 aa, Enterobacter cloacae
ITEADDYRQLLGEDKFLDRPGNAVFQVRFGHEVRHFFYRRDGVIHRHAHACIFDHRNIVFLVAQRHDLLRLDAQRIGKRFDARAFIDAFIEDFEEVRRTFQYGVFLFYLSRNA

SEQ ID NO: 9496 - protein, 455 aa, Enterobacter cloacae
HFPDNFWWGSASSALQTEGTREGETTWDYWFAREPNRFHNGVGPQHTSTFYQHWKTDIQLLKQLNHNSFRTSISWARLIPDGIGEVNPDAVDFYNQVIDELNEQGITPFITLFHFDMPMAMQEIGGWENRDVVDAYARYAQICFELFGDRVLHWFTFNEPIVPVEGGYLYDFHYPNVVDFRRAATVAYHTVLAHAKAVQAYRAGHYAGEIGIVLNLTPSYPRSQNPADVKAAHVADLMFNRSFLDPVLRGEYPADLVALLKSYDQLPACKPEDGFLIAEGKIDLLGINYYQPRRVKCRDSAVNPQAPFMPEWFFDNYEMPGRKMNPYRGWEIYEPGIYDILVNLRDHYGNPRCFISENGMGVENEQRFIENGQINDQYRIDFISEHLSWLHKGISEGCNCLGYHMWTFIDNWSWCNAYKNRYGFIQLDVETQQRTIKKSGEWFAATALNNSFDKE

SEQ ID NO: 9497 - protein, 284 aa, Enterobacter cloacae
HFTNRYAMTITVFCILLFAALLHASWNAIVKAGTDKLYSAIGVSGSAALIALILLPFSPQPTAASWPYLFVSCALQVVYTVLVAKTYQVSDMSQTYPLMRGTAPLLVALISVMVLGDHLSRFAWSGIGVICLSILAMAMNGRMQSRKGLWLALLNACFIAGYTLVDGTGVRLSDTALGYTLWTFFMNGFCLLSWAMVARRREASSYLRLHWKKGLLGGVGTMGSYGLALWAMTQAPLAVVAALRETSILFGALIAFVLLKEKVAGLRIAAALGIAAGAILLRLA

SEQ ID NO: 9498 - protein, 111 aa, Enterobacter cloacae
VMMRNVLIKLATFSGVVLLCGCSSVMSHTGGKEGTYPGTRASAAMISDDETNWGTKSLAILDMPFTAVADTLLLPWDMFRTDSSVRSRVEKSEQETLATNSVIPPAAMPPR

SEQ ID NO: 9499 - protein, 315 aa, Enterobacter cloacae
YNSSMTDTLKDIPVFVASVEAGSFAQAAVRLHLSRSAVGKSIARLEERLGVRLFHRTTRSQRLTDNGALFYERCLRALEEIRGAESQLETGKHQVSGRLRVAMPVLFGRQCIAPLLIELAQEHPGLELEMSFSDRIVDLVEEGFDMAVRNGTLADSAVLVARRLGVHRMVLCAAPDYLIKNGQPQSVDDLRQYTAINYTRAGRVLPWQLMDYDGTSRTFIPRSSLNMDDLQAICDAALAGHGIAWLPCWMVIKEIHQGNLVPLFKQAPDVRFDVHAVWQQTPHLPLRVRIAIDMLVKRLPAVMSLEFPASIKKPR

SEQ ID NO: 9500 - protein, 481 aa, Enterobacter cloacae
SAASYVVVKRRLNIDIRRLQGVLFDEGATWFNRIAHQGREQLIRCDCVFNGDAQHATAFRIHSGFPQLIRVHFAQAFITLNREAATGLFHQPLQRLFEAGYRLTTLATFDERVVFDQTTQLLAEGADTAVFRTGNKLVLQRVVGIDAVGTHANNRLELLLSVLLNVELPLAAVLLFLVQLAHQGVHPAGDGLLVAQIGFGQGRLINQLFQQRFRIATLHTANHFLRGVELGNQTLQRLTGQRWRAGVCVQGRTIKGDRDLVLIHRVVIFNVLFLLAFFHLVQRWLRNVDVAALNDFRHLTIEEGQQQRTDVRAVDVRIGHDDDAVITQFVRVVLVATNAAAERGDERRHFLRREHLVEARFLNVEDFTLQRQNRLVLAVTALLCRTARGVPFHKVQFRQRRVAFLTVSQFARQACQVQRAFTTGHFTRFTRRFTGTRRIDNFTHHDFRVGRVFQQVFAQQFVHLLFNRRFHLRRDQLVFGL

SEQ ID NO: 9501 - protein, 352 aa, Enterobacter cloacae
GELRIRHLHGDHGNQAFTGIVTGGADFRFFTVAFFVHVSVQGTGHRRAEARKVRTAVALWNVVGEAVNVFLETVVPLQGHFHADTVFFSREVEDIRVNWRFVLVQILNERLDTTFVMEVVFFVVAFVAQTNRHAGVQERQFTQAFRQNVVLEFGDVGEGFKARPETHHGTGFLGITRDGQRRFRHAVLVDLTVNFAFALDNQLQLLRQGVYYGYAYAVQTAGNFIGVIIELTACVQNGHDHFRSRYALFRVNTGWDATAVIGNGHGVVRMDRDHDVFTVTRERFVDSVIYHLEYHVVQTGAVIRVADIHTRALTHRIQPFQDFDTGGVIRIRHQRFSLISTWVNPLFYPFPR

SEQ ID NO: 9502 - protein, 96 aa, Enterobacter cloacae
ASFTRRSSGCRCVGCVPSPQSRTYVRSWGFAHLPPSCNPNYLAYPGGVLNEKPRPVCAGGVLDSCVDPVPTAHCRRPPPHARRPLRQVAQFLVGSK

SEQ ID NO: 9503 - protein, 409 aa, Enterobacter cloacae
SLILHLSLLAKVFSDMKKQRNVNLLLMLVLLVAVGQMAQTIYIPAIADMAKDLSVREGAVQSVMAAYLLTYGVSQLVYGPLSDRVGRRPVILVGMSIFMVATMIAITTHSLTVLIAASALQGVGTGVGGVMARTLPRDMYQGTQLRHANSLLNMGILVSPLLAPLIGGLLDTVWSWRACYAFLLVLCIIVTFSMGRWMPETRPKDAPRTKLIASYKTLFGNGSFTCYLLMLIGGLAGIAVFEACSGVLLGAGLGLSSMVVSILFILPIPAAFFGAWFAGRPNKRFSTLMWQSVISCLLAGLMMWIPGLFDVMSVWTLLIPAALFFFGAGMLFPLATSGAMEPFPFLAGTAGALVGGLQNIGSGALAWLSAMMPQTGQASLGLLMTLMGLLILLCWLPLASRVSHHEQPV

SEQ ID NO: 9504 - protein, 462 aa, Enterobacter cloacae
DLQILYDGDVYRLGACTWRHIPAFFHYLSAKRRIMENATITTLTAQFPLVEDLIALKETTWLNPRTTTLAEGLPYVGLTKADVDDAHARLKRFAPYLAKAFPETAATGGIIESDLVAIPAMQARLEKEFAKPVTGPLLLKKDSHLPISGSIKARGGIYEVLTHAEKLALEAGLLSVEDDYSVLLEPRFKDFFSQYSIAVGSTGNLGMSIGIMSARIGFKVTVHMSADAREWKKAKLRSHGVIVVEYEQDYGVAVEQGRKAAESDPNCFFIDDENSRTLFLGYAVAGERLKAQFAEQGRVVDADHPLYVYLPCGVGGGPGGVAFGLKLAFGDNVHCFFAEPTHSPCMLLGVYTGLHDEIAVQDLGIDNVTAADGLAVGRASGFVGRAMERLLDGFYTLSDQSMYDMLGWLAQEERIRLEPSALAGMAGPLRVDADENVTHLVWATGGGMVPEDEMAKYLAKGK

SEQ ID NO: 9505 - protein, 660 aa, Enterobacter cloacae
HLTRRKKAMSQIHKHDIPANIADRCLISPEQYQEKYQQSVSSPDAFWGEQGHILDWIKPYQKVKNTSFAPGNVSIKWYEDGTLNLAANCLDRHLAERGNETAIIWEGDDASQSKHISYKELHRDVCRFANVLLAQGIKKGDVVAIYMPMVPEAAVAMLACARIGAIHSVIFGGFSPEAVAGRIVDSNSKLVITADEGVRAGRGIPLKKNVDEALKNPNVKSISNVIVFKRTGGKIDWHEGRDLWWSDLIEKASDQHQPEEMNAEDPLFILYTSGSTGKPKGVLHTTGGYLVYAATTFKYVFDYHPGDIYWCTADVGWVTGHSYLLYGPLACGATTLMFEGVPNWPTPARMCQVVDKHQVNILYTAPTAIRALMAEGDKAIEGTDRSSLRILGSVGEPINPEAWEWYWKKIGNEKCPVMDTWWQTETGGFMITPMPGATQLKAGSATRPFFGVQPALVDNEGNPQEGATEGNLVIVDSWPGQARTLFGDHERFEQTYFSTFKNMYFSGDGARRDEDGYYWITGRVDDVLNVSGHRLGTAEIESALVSHPKIAEAAVVGIPHNIKGQAIYAYVTLNHGEEPSPELYTEVRNWVRKEIGPLATPDVLHWTDSLPKTRSGKIMRRILRKIAAGDTSNLGDTSTLADPGVVDKLLEEKQAIAMPS

SEQ ID NO: 9506 - protein, 559 aa, Enterobacter cloacae
QRSSARGKSIMKRILTALAATLPFAAHAADAITGEVQRQPTNWQAIIMFLIFVVLTLYITYWASKQVRSRNDYYTAGGNITGFQNGLAIAGDFMSAASFLGISALVYTSGYDGLIYSLGFLVGWPIILFLIAERLRNLGRYTFADVASYRLKQGPIRTLSACGSLVVVALYLIAQMVGAGKLIELLFGLNYHIAVVLVGVLMVMYVLFGGMLATTWVQIIKAVLLLFGASFMAFMVMKHVGFSFNNLFTEAMSVHPKGEAIMSPGGLVKDPISALSLGLGLMFGTAGLPHILMRFFTVSDAREARKSVFYATGFMGYFYILTFIIGFGAIMLVGANPAFKDAAGALIGGNNMAAVHLADAVGGNLFLGFISAVAFATILAVVAGLTLAGASAVSHDLYANVFRKGASERDELKVSKITVLVLGVVAILLGILFEKQNIAFMVGLAFSIAASCNFPIILLSMYWSKLTTRGAMIGGWLGLLTAVILMILGPTIWVQILGHESAIFPYEYPALFSIAVAFIGIWVFSATDNSPEGNLEREKFRAQFIRSQTGLGVEQGRAH

SEQ ID NO: 9507 - protein, 400 aa, Enterobacter cloacae
RMADMKIKTGARVFALSALAAMMISAPALAKIEEGKLVIWINGDKGYNGLAEVGKKFEKDTGIKVTVEHPDKLEEKFPQVAATGDGPDIIFWAHDRFGGYAQSGLLAEVTPDKAFQDKLFPFTWDAVRYNGKLIAYPIAVEALSLIYNKDLVPNPPKTWEEIPALDKELKAKGKSALMFNLQEPYFTWPLIAADGGYAFKFENGKYDVKDVGVDSAGAKKGLTFLVDLIKNKHMNADTDYSIAEAAFNKGETAMTINGPWAWTNIDKSKINYGVTLLPTFNGKPSKPFVGVLSAGINAASPNKELAKEFLENYLLTDQGLDEVNKDKPLGAVALKSFQDQLAKDPRIAATMDNAQKGEIMPNIPQMAAFWYATRTAVINAASGRQTVDAALKDAQGRITK

SEQ ID NO: 9508 - protein, 302 aa, Enterobacter cloacae
  UNSURE (248)
LRRALNMAMVQPKSQKLRLLATHLGLLIFIAAIMFPLLMVIAISLRSGNFATGSLIPDEISWEHWKLALGFSVEHADGRVTPPPFPVLLWLWNSVKVATITAIGIVTLSTTCAYAFARMRFPGKATLLKVMLIFQMFPAVLSLVALYAVFDRLGQYVPFIGLNTHGGVIFAYLGGIALHVWTIKGYFETIDGSLEEAAALDGATPWQAFRLVLLPLSVPILAVVFILSFIAAITEVPVASLLLRDVNXYTLAVGMQQYLNPQNYLWGDFAAAAVLSAIPITVVFLLAQRWLVNGLTAGGVKG

SEQ ID NO: 9509 - protein, 93 aa, Enterobacter cloacae
ADLQPGCSPQAGCRRRATFSRCGNAASRWWPDPASPISAARFHRKRAPQTVADHRLAACTGWHTACSEVRHRSDARPACRTCCPTVSGPALWW

SEQ ID NO: 9510 - protein, 115 aa, Enterobacter cloacae
NKPTLLLEISVMNNDICQQIENSAHYRELVEKRQRFAFLLSIIMLIIYVGFILLIAFAPHWLGTPLHEGTSVTRGIPIGIGVIIISFVLTGVYVWRANGEFDRLNREVLREVKAS

SEQ ID NO: 9511 - protein, 298 aa, Enterobacter cloacae
FRGIIMDIRTLRYFVEVVRQQSFTRAAEKLFVTQPTISKMLKNLEDELNCTLLIRDGRKLLLTDTGRVVFERGLAILAEFRQLEAELGDINHLTKGLLRLGIPPMVGMMMAGPISLFRQRYPGVELKISEFGGLTVQQAVMNGELDVAMTALPVEEESGLATLPLFSHPLCVLVPRSGDWLKIDAVKPELLGEHPLLIYNEDFALSRQLMALFNQHNVKPRIAVRSGQWDFLAAMVQAGVGIAILPQPICERLDKNTLRWIPLESDLHWQLGMIWREGVYLSHSAQAWLQCCEGFWVP

SEQ ID NO: 9512 - protein, 79 aa, Enterobacter cloacae
KVGLFERYLQRMFRTVMHQTLGDYIRQRRLLLAAQALRSTQRPIFDIAMDLGYVSQQTFSRVFRREFDRTPSDYRHQLN

SEQ ID NO: 9513 - protein, 110 aa, Enterobacter cloacae
RETLFHSSSSVLSRMSFMATITTSMVLLRWPLLSAVLMFLASTLNIQFRKSDYAGLAVISTLLGLGAACWFATGLLGITLVDIAAVWENIKVVMVEAMSHTPPDWPMVIT

SEQ ID NO: 9514 - protein, 940 aa, Enterobacter cloacae
MDKIEVRGARTHNLKNINLIIPRDKLIVVTGLSGSGKSSLAFDTLYAEGQRRYVESLSAYARQFLSLMEKPDVDHIEGLSPAISIEQKSTSHNPRSTVGTITEIHDYLRLLYARVGEPRCPDHDVPLAAQTVSQMVDNVLSQPEGKRLMLLAPIIKERKGEHTKTLENLASQGYIRARIDGEVCDLSDPPKLELQKKHTIEVVIDRFKVREDLATRLAESFETALELSGGTAVVSDMDDAKAEELLFSANFACPICGYSMRELEPRLFSFNNPAGACPTCDGLGVQQYFDPDRVIQNPELSLAGGAIRGWDKRNFYYFQMLKSLAEHYKFDVEAPWASLSANVHKVILFGSGKENIEFKYMNDRGDTSVRRHPFEGVLHNMERRYKETESSAVREELAKFISNRSCATCEGTRLRREARHVFVENTALPTISDMSIGHAMDFFNNLKLSGQRAKIAEKVLKEIGDRLKFLVNVGLNYLTLSRSAETLSGGEAQRIRLASQIGAGLVGVMYVLDEPSIGLHQRDNERLLGTLVHLRNLGNTVIVVEHDEDAIRAADHVIDIGPGAGVHGGQVVAEGTLKDIMAVPESLTGQYMSGKRKIEVPKQRVAANPEKVLKLTGARGNNLKDVTLTLPVGLFTCITGVSGSGKSTLINDTLFPIAQTALNGATLAEPAPYRDIQGLEHFDKVIDIDQSPIGRTPRSNPATYTGVFTPVRELFAGVPEARSRGYTPGRFSFNVRGGRCEACQGDGVIKVEMHFLPDIYVPCDQCKGKRYNRETLEIKYKGKTIHEVLDMTIEEAREFFDAVPALARKLQTLMDVGLTYIRLGQSATTLSGGEAQRVKLARELSKRGTGQTLYILDEPTTGLHFADIQQLLDVLHQLRDQGNTIVVIEHNLDVIKTADWIVDLGPEGGSGGGEILVSGTPETVAECEASHTARFLKPLL

SEQ ID NO: 9515 - protein, 100 aa, Enterobacter cloacae
RFRDGFGFGLATSGHEVNAVAALYVHGDQRAGNLFRDTELIPAVVHLFPEFRVFQIGFAVRGVRFFAAPETGAGEENGIVNIEAHGHRRATRQAVFNLCH

SEQ ID NO: 9516 - protein, 369 aa, Enterobacter cloacae
PGDLIITLTRFSLFVEGFVSCHSEWSYRDKEWVERLPHSGGSMATRIEFHKHGGPDVLKAVEFTPAAPGENEIQVENKAIGINYIDTYIRGGLYPPPSMPSGLGTEAAGIVSKVGSAVKHIKEGDRVVYAQSALGAYSSIHNVPAEKAALLPNAIGFEQAAASFLKGLTVYYLLRKTYEIKPDEQFLFHAAAGGVGLIACQWAKALGAKLIGTTGSAQKAQRALDAGAWQVINYREESIVERLKEITGGKKVRVVYDSVGKDTWESSLDCLQRRGLMVSFGNASGAVTGVNLGILNQKGSLYVTRPSLQGYITNREELEEASNELFSLIASGVIKVDVAEAQKYPLTDAQRAHEVLESRATQGSSLLIP

SEQ ID NO: 9517 - protein, 833 aa, Enterobacter cloacae
RVTTEILRAFCYPCAAIALLTRGFTSFMSGWPRIYYKLLNLPLSVLVKSKSIPAEPALELGLDTSRPIMYVLPYNSKADLLTLRAQCLAHDLPDPLEPLEVDGTLLPRYVFIHGGPRVFTYYTPKEESIKLFHDYLDLHRSNPDLDVQMVPVSVMFGRRPGREKGEENPPLRMLNGIQKFFAVSWLGRDSFVRFSPSVSLRRMADEHGTDKIIAQKLARVARMHFARQRLAAVGPRLPARQDLFNKLLASKAIARAVEDEARSKKISHEKAQQNAIALMEEIAANFSYEMIRLSDRILGFTWNRLYQGINVHNAERVRQLAHDGHEIVYVPCHRSHMDYLLLSYVLYHQGLVPPHIAAGINLNFWPAGPIFRRLGAFFIRRTFKGNKLYSTVFREYLGELFSRGYSVEYFVEGGRSRTGRLLDPKTGTLSMTIQAMLRGGTRPITLVPIYIGYEHVMEVGTYAKELRGATKEKESLPQMLRGLSKLRNLGQGYVNFGEPLPLMTYLNHHVPEWRESIDPIEAVRPAWLTPTVNGIASELMVRINNAGAANAMNLCCTALLASRQRSLTREQLTEQIDCYLDIMRNVPYSVDSTVPSATASELIDHALQMNKFEVEKDTIGDIIILPREQAVLMTYYRNNITHMLMLPSLMAAIITQHRRISRQELLRHIQAIYPMLKAELFLRWSKDELAAELDKMTAEMHRQGLITISDDELHINPSRSRTLQLLASGARETLQRYAITFWLLSANPSINRGTLEKESRTLAQRLSVLHGINAPEFFDKAVFSSLVLTLRDEGYISDTGDAEPEETMKVYQMLAELITADVRLTIESSTQGE

SEQ ID NO: 9518 - protein, 518 aa, Enterobacter cloacae
RKNPMDVIKKKHWWQSDALKWSVIGLLCLLVGYLVVLMYVQGEYLFAIMTLILSSVGLYIFANRKAYAWRYVYPGVAGMGLFVLFPLICTIAIAFTNYSSTNQLAQERATQVLLDRSYQAGKTFNFGLYPAGDEWKLALTDGESGKTYLSDAFKFGGEQKLTLKEAAALPEGERANLRIITQNRQALTQLTAVLPDESKVIMSSLRQFSGTQPLYTLADDGTLTNNQSGVKYRPNNDIGFYQSVNADGSWGDDKLSPGYTVTIGWDNFTRVFTDEGIQKPFFAIFVWTVVFSVLTVILTVAVGMVLACLVQWESLKGKAIYRVLLILPYAVPSFISILIFKGLFNQSFGEINMMLSALFGIKPAWFSDPTTARSMIIIVNTWLGYPYMMILCMGLLKAIPDDLYEASAMDGAGPFQNFFKITLPLLIKPLTPLMIASFAFNFNNFVLIQLLTNGGPDRLGTTTPAGYTDLLVSYTYRIAFEGGGGQDFGLAAAIATLIFLLVGALAIVNLKATRMKFD

SEQ ID NO: 9519 - protein, 183 aa, Enterobacter cloacae
GAAATGQDFLRPDALTPALSHREREIISSEYLHHSCKRLRHALDVAGIQTRHAHTAAGDQVDTELFTQAIDLRCAQSGVAEHPALLEKIIKVMPRHGLFQDVNQLLTHRQDALTHRFHFRKPGGFQSFVTENCRHHLRTKVRRAGVDTADRRFQLAEYASRGFGVFTHHGQTANALAVQGEDF

SEQ ID NO: 9520 - protein, 173 aa, Enterobacter cloacae
EGVADQSGKPRAGNRANGVGVFFHARAKALIGDVEERDQVTRLQYLDHRIPLGIGEVRTRRVMAARMQQYDAALRQGVQFFQQRINAHAVRFAVEPRISFNLKARALEDRNVVFPRRVADPHAGIREVLFQEICAYLQRTRATQRLDSRYALLREHRVVRTKQQRRDSVAVGV

SEQ ID NO: 9521 - protein, 183 aa, Enterobacter cloacae
SESFHPLPHPRCPMDKSTKELLAQAEKLCAQRNVRLTPQRLEVLRLMSLQQGAISAYDLLDLLRESEPQAKPPTVYRALDFLLEQGFVHKVESTNSYVLCHLFDQPTHTSAMFICDRCGVVKEECAEGVEDIMHTLAARMGFALRHNVIEAHGLCSACVEVESCRHQDDCQHDHSILVKKKPR

SEQ ID NO: 9522 - protein, 71 aa, Enterobacter cloacae
SGSGTTTSSALKPKRFCRTTSTCTALRPTSSRATWNPTASTLTVTATRWITRLAQSSGASRAPTVSTRSTS

SEQ ID NO: 9523 - protein, 712 aa, Enterobacter cloacae
CRYPSLPDTADTGIMKKTYLYSMLALCVSAACHAETYPAPIGPSQSDFGGVGLLQTPTARMAREGEISLNYRDNDQYRYYSASVQLFPWLETTLRYTDVRTKQYSSVDAFSGDQTYKDKAFDVKLRLWEESYWMPQVSVGAKDIGGTGLFDAEYIVASKAWGPFDFSLGLGWGYLGTSGNVKNPFCSYSDKYCYRDNSYQKAGSINGDQMFHGPASLFGGVEYQTPWQPLRLKLEYEGNNYSEDFAGKIEQKSKFNVGAIYRVTDWADVNLSYERGNTLMFGFTLRTNFNDMRPHYNDNPRPKYQPEPQDAIIQHSVVANQLTLLKYNAGLADPKIQTKGDTLYVTGEQVKYRDSREGIERANRIVMNDLPEGIRTIRVTENRLNLPQVTTETDVASLKRHLEGEPLGHETELVQKRVEPVVPETTEQGWYIDKSRFDFHIDPVLNQSVGGPENFYMYQLGAMATADLWVTDHLLTTGSLFGNITNNYDKFKYTNPPNDSKLPRVRTRVREYVQNDIYVNNLQANYFQYFGNGFYGQVYGGYLETMFGGAGAEVLYRPVDSNWAFGVDANYVKQRDWRSAQDMMKFTDYSVKTGHLTAYWTPSFAQDVLVKASVGQYLAGDKGGTLDISKHFDSGVVVGGYATITNVSPDEYGEGDFTKGVYVSIPLDLFSSGPTRSRAAVGWTPLTRDGGQQLGRKFQLYDMTSDKNINFR

SEQ ID NO: 9524 - protein, 155 aa, Enterobacter cloacae
IPVTFLRYTGTSPWRMRCCMTSLTRPRVEFISTILQTVLNLGLLSLGLILVVFLGKETVHLADVLFAPEQTSKYALVEGLVVYFLYFEFIALIVKYFQSGFHFPLRYFVYIGITAIVRLIIVDHKSPLDVLIYSAAILLLVITLWLCNSKRLKRE

SEQ ID NO: 9525 - protein, 189 aa, Enterobacter cloacae
ILFVRPHFVNLRYNAFTLCIGESGMSHPALTQLRALRYFDHIPALDPEQLDWLLLEDSMTKRFEQQGKTVTVTMIQEGFVSPAEIASELPLLPQEERYWLREILLCADGEPWLAGRTVVPESTLSGPELALQRLGKTPLGRYLFTSSELTRDFIEIGCDADLWGRRSRLRLSGKPLILTELFLPASPLY

SEQ ID NO: 9526 - protein, 293 aa, Enterobacter cloacae
EGEKMEWSLTQNKLLAYHRLMRTDKPIGALLLLWPTLWALWVATPGVPPLWILAVFVAGVWLMRAAGCVVNDYADRKFDGHVKRTANRPLPSGQVTGKEARILFVVLVLLSFMLVLTLNTMTILLSVAALALAWVYPFMKRYTHLPQVVLGAAFGWSIPMAFAAVSESVPLSCWLMFLANILWAVAYDTQYAMVDRDDDLKIGIKSTAILFGRHDKLIIGILQVAVLALMVAIGRLNGLNWEFYWSVLVAGLLFAYQQKLIAKREREACFKAFLNNNYVGLVLFLGLAMSYWS

SEQ ID NO: 9527 - protein, 126 aa, Enterobacter cloacae
KVLLMANNTTGLTRIIKAAGYSWKGFRAAWVNEAAFRQEAVAAIVAVVIACFLDVDAITRVLLIGSVFLVMIVEILNSAIEAVVDRIGSEFHELSGRAKDMGSAAVLLAIITAAITWVTLLWSHFR

SEQ ID NO: 9528 - protein, 210 aa, Enterobacter cloacae
LYIHPGGGMKALTTRQQEVFDLIRDHIGQTGMPPTRAEIAQRLGFRSPNAAEEHLKALARKGVIEIVSGASRGIRLLVEEESGIPLVGRVAAGEPLLAQQHIEGHYQVDPGMFKPSADFLLRVSGMSMKDIGILDGDLLAVHKTQDVRNGQVVVARIDDEVTVKRLKKQGNTVQLLPENNEFSPIVVDLREQSFSIEGLAVGVIRNGEWL

SEQ ID NO: 9529 - protein, 459 aa, Enterobacter cloacae
FLYSLACFLIPVISMALLTSADKALWRLALPMIFSNITVPLLGLVDTAVIGHLDSPIYLGGVAIGATATSFLIMLLLFLRMSTTGLTAQAYGAKDPLRLARALVQPLILAFGAGALIVLLRTPLIDFALHIVGGSDAVLEQARRFLEIRWLSAPASLANLVLLGWLLGVQYARAPVILLVVGNLLNIMLDLWLVMGLHMNVRGAALATAIAEYGTLLIGLGMVWRVLAMRGITLDLLKSAWRGNIRKLLALNRDIMLRSLLLQLCFGALTVFGARLGPEIVAVNAVLMTLLTFTAYALDGFAYAVEAHSGQAYGARESGQLREVWRAACRQAGLVALAFALVYACFGGHIVALLTSLPALRELADRYILWQVVLPVVGVWCYLLDGMFIGATRGAEMRNSMAVAAAGFGLTLLTLPYLGNHGLWLALAVFLSLRGLSLAVIWHRHWRNNTWFPAPHDIS

SEQ ID NO: 9530 - protein, 334 aa, Enterobacter cloacae
NFAMSSEFQTVFPAHRFSIAPMLDWTDRHCRYFLRQLSRHTLLYTEMVTTGAIIHGKGDYLAYSEEEHPVALQLGGSDPAALAQCAKLAEERGYDEINLNVGCPSDRVQNGMFGACLMGNAHLVADCIKAMRDVVSIPVTVKTRIGIDDQDSYEFLCDFINTVSGKGECEMFIIHARKAWLSGLSPKENREIPPLDYPRVYQLKRDFPHLTMSINGGIKSLDEAKAHLEHMDGVMVGREAYQNPGILATVDREIFGVEGADTDPVAVVRAMYPYIERELSHGTYLGHITRHMLGLFQGIPGARQWRRYLSENAHKAGADIEVLEHALRLVADKR

SEQ ID NO: 9531 - protein, 362 aa, Enterobacter cloacae
GIQMQAATVVINRRALRHNLQRLRELAPASKLVAVVKANAYGHGLLETARTLPDADAFGVARLEEALRLRAGGITQPILLLEGFFEASDLPTIADQHLHTAVHNEEQLAALETAELSEPVTVWMKLDTGMHRLGVRPESAEAFYQRLCQCKNVRQPVNIVSHFARADEPECGATEQQLDIFNTFCEGKPGMRSIAASGGILLWPQSHFDWARPGIILYGVSPLENKPWGPDFGFKPVMSLVSKLIAVREHKAGEPVGYGGTWISERDTRLGVVAMGYGDGYPRAAPTGTPVLVNGREVKIVGRVAMDMICVDLGPDAQDKAGDDAVMWGEGLPVERIAEITKVSAYELITRLTSRVAMKYVD

SEQ ID NO: 9532 - protein, 148 aa, Enterobacter cloacae
KDSPFIMEQHMWYQQTLTLSAKPRGFHLVTDEVIGQIRDLSRVKTGLLHLLLQHTSASLTLNENCDPTVRSDMERHFLKTVPDNAPYEHDYEGADDMPSHIKSSLLGVSLMLPVHNGRLQLGTWQGIWLGEHRIHGGSRKIIATLQGE

SEQ ID NO: 9533 - protein, 74 aa, Enterobacter cloacae
RRCPSAYKVSKASEDLPDPESPVTTMSLSRGIMRLIFLRLWVRAPRTSILSIHLSRLEHGLPDLFEGQTAVRNG

SEQ ID NO: 9534 - protein, 155 aa, Enterobacter cloacae
RGFMEKRLPRIKALLTPGEVAKRSGVAVSALHFYESKGLIKSIRNAGNQRRYTRDVLRYVAIIKIAQRIGIPLATIGDAFGVLPEGHSLSAKEWKQLSSQWREELDRRIHTLVALRDELDGCIGCGCLSRSDCPLRNPGDRLGEQGTGARLLEED

SEQ ID NO: 9535 - protein, 597 aa, Enterobacter cloacae
LFMRKRVAKAARFYFQDSSCCLLRYSGEDRIRGTTPQVWLIRNTANRERMEIFFTILIMTLVVSLSGVVTRVLPFQVPLPLMQIAIGALLAWPTFGLHVEFDPELFLVLFIPPLLFADGWKTPTREFLEHGREIFGLALALVVVTVVGIGFLIYWAVPGIPLIPAFALAAVLSPTDAVALSGIVGEGRIPKKIMGILQGEALMNDASGLVALKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGIMESSLIAAEADPNVEVWMLFTDIVLIYLALMLVRFGWLWTMKKFSVRFLTKKPMEFGSWTTRELLIASFAGVRGAITLAGVLSIPLLLPTGDVFPARYELVFLAAGVILFSLFVGVIMLPILLQHIDAGDSSQQHKEERIARAATAEVAIVAIEKMEERLAADAEENIDNQLLKEVSSRVIGNLRRRADGRNDVESSLQEENLERRFRLAALRSERAELYHLRATRQISNETLQKLLHDLDLLEALLIENQ

SEQ ID NO: 9536 - protein, 251 aa, Enterobacter cloacae
WCWAPPPGWWIRCIALKSAGRSMTNFQISLLCLIATVVIYFANKRLYRRFRALPLMPLVFTPILLVLMLVFGHISWQNYIGESHWLLWLLGPATIAFAVPVYDNLAIIRRHWMSLSAGVVTATVVAVCSSVWLARLFTLSDEIQRSLAVRSVTTPFALAAAKPLGGQPDLVALFVVVTGVFGMAVGDMLFLRLSIREGMAKGAGFGAASHGAGTARSYELGQQEGVVASLVMMLSGVTMVLIAPLVAWMMF

SEQ ID NO: 9537 - protein, 420 aa, Enterobacter cloacae
ITDNDTFCSEMPCSLRLAQHAVQMILIRRVKKSHKPTQHNSYPFSMSPYSCSFDGAEISLRKSVSMKNLKVSLAWQILLALVLGILLGSYLHYHSDSREWLIANLLSPAGDIFIHLIKMIVVPIVISTLVVGIAGVGDAKQLGRIGVKTILYFEVITTVAIVLGITLANVFQPGAGIDMSQLATVDISKYQSTTADVQSHSHGLMGTILSLVPTNIIASMAKGEMLPIIFFSVLFGLGLSSLPATHREPLVTVFRSISETMFKVTHMVMRYAPVGVFALIAVTVANFGFASLWPLAKLVILVHFAILFFALVVLGIVARLCGLSIWILIRILKDELILAYSTASSESVLPRIIEKMEAYGAPASITSFVVPTGYSFNLDGSTLYQSIAAIFIAQLYGIDLSLWQEIVLVLTLMVTSKGIA

SEQ ID NO: 9538 - protein, 279 aa, Enterobacter cloacae
PLLGGRRGANPPVLTVSRCRFLPGEDHPDQGGEIMKMFIHIALLASLASPLAWSAGTVQVYTPDSEKPKTLTNARHLLDLVGQPRLAKSWWTGAVISERQATIVAEQKHQALLARLSGLAQQEDADDAAAITSLRQQLQAVKVTGRQKVNLDPDEVRVAENGNPSLEGDYTLWLPAQPSTVTVMGLLSSPGKKPFTPGRDVASYLDEQSLLSGADKSYAWVVYPDGHTQKAPVAYWNKRHIEPMPGSIIFVGFADHFWTKAYDGLNADILRSLIQRIPE

SEQ ID NO: 9539 - protein, 122 aa, Enterobacter cloacae
KMVKYATPCNTLRGVLLSEQQLIFGMILVTIAASFGNSWESTMLELLFVIGFFIMLMVTGVSLLGILAALVVATVVMFVGGLFALTIKLLPWLLLAIAVVWAIRAIKSPKLPSYQRNNRFRY

SEQ ID NO: 9540 - protein, 402 aa, Enterobacter cloacae
SGEHRVFQKVDAYAGDPILSLMERFKEDPRSDKVNLSIGLYYNEDGIIPQLKAVAEAEARLNATPHGASLYLPMEGLNTYRNTIAPLLFGADHAVLAQKRVATIQTLGGSGALKVGADFLKKYFPDSGVWVSDPTWENHVAIFEGAGFKVETYPWFDSETNGVRVDALLEKLNTLPERSIVLLHPCCHNPTGADLTNAQWDAVIEILKARNLIPFLDIAYQGFGAGMEEDAYAIRAIASAGLPALVSNSFSKIFSLYGERVGGLSVVCEDAEAAGRVLGQLKATVRRIYSSPPNFGAQVVATVLGDERLKATWLAEVEAMRKRILSMRQELVNVLKEAVPGHNFDYLLKQRGMFSYTGLSAAQVDRLREEFGVYLIASGRMCVAGLNASNVQRVAQAFAAVM

SEQ ID NO: 9541 - protein, 182 aa, Enterobacter cloacae
ETYSGDTNMASRGVNKVILVGNLGQDPEVRYMPSGGAVANITLATSESWRDKATGEMKEQTEWHRVVLFGKLAEVAGEYLRKGSQVYIEGQLRTRKWTDQSGQEKYTTEVVVNVGGTMQMLGGRQGGGAPAGGGQQQGGWGQPQQPQGGNQFSGGAQSRPQQQSAPAPSNEPPMDFDDDIPF

SEQ ID NO: 9542 - protein, 491 aa, Enterobacter cloacae
FRGLILLFRYELLRLLSRLMTCEKIMKEQRREIINDSMQALHALAKLMPQLNAQCSPVEMLETINSALGANLSWVSVESADGPRVVCAGDVTCHAFNVADFLASTLLQRHHRAWRVIYWKAHIGRAVFSPQHPGYARLQSGVLCKLSAHGRQCSGYFFLAFNGKLTSLPILKNIVVVLVEKLKDYFDDIIVREKTAQEMQRVVTQYKTLFERAPVLMNAFDRHNRCVLWNAECEKVFGWSMTEIDEHPDPLALFYPDPEERQRVQESVRFAPLKDMYEWHPVRKDGTQLTILWSNILLPDNSILNIGLDITERKKAEQQLTVKATTDDLTGCLNRSTILQQLKMALAASSPQDVSSHFCLLMFDLDYFKQINDRWGHQVGDAALIHFCDRIREVSPAGSALGRVGGEEFVLLLARTDGMAATLLSSRLRAALISKPLRVGDKTLVLSFSAGVVEVCQGQRDTSAILMRADKALYDAKRTGRGKTVLASDYL

SEQ ID NO: 9543 - protein, 245 aa, Enterobacter cloacae
PNFFREVAQFSIVKKYESSENIMLTVHHLNQSRSHRVLWALEELGLTYDIVRYQREKTMLAPDSLKKVHPLGKSPVLEDNGLVLAESGAIMEYLQETYDSASRFKPLDPAHKVQYRFWLHYAEGSLMPLLLMKLVFNSLGKPPVPFGLRTLGKALGQGVQKAYLNRQLETHARFINDHLAENSWFAGDTLTMADIQMSFPLFALLARGGIDNLDHIAAWKQRVEARPGWQTTLAKGGPLTIPGEG

SEQ ID NO: 9544 - protein, 472 aa, Enterobacter cloacae
RLAGSGVSTSLTDFLKNSQGMFSMSTPSARTGGSLDAMFKISARGSTVRQEVVAGLTTFLAMVYSVIVVPGMLGKAGFPPAAVFVATCLVAGVGSIVMGLWANLPLAIGCAISLTAFTAFSLVLGQQISVPVALGAVFLMGVLFTVISATGIRSWILRNLPQGVAHGTGIGIGLFLLLIAANGVGLVIKNPLDGLPVALGNFASFPVIMSLVGLAVIIGLEKLKVPGGILLTIIGVSIVGLIFDPTVHFSGIFAMPSLSDDKGNSLIGSLDIMGALNPVILPSVLALVMTAVFDATGTIRAVAGQANLLDKDGQIIDGGKALTTDSLSSVFSGLVGAAPAAVYIESAAGTAAGGKTGLTAITVGVLFLLILFLSPLSYLVPAYATAPALMYVGLLMLSNVAKIDFADFVDAMSGLITAVFIVLTCNIVTGIMIGFASLVIGRLVSGEWRKLNIGTVVIAVALVAFYAGGWAI

SEQ ID NO: 9545 - protein, 630 aa, Enterobacter cloacae
HRGTFQAPGVKTTGPYFMLLVYPLFDQHFATPEGRDSSYTFRVFSPAFDADQGNGIKTITIFICRRYNRPQSQFSNQKSIAMKNINPTQTAAWQALQKHFDEMKDVTIADLFAKDADRFSKFSATFDDLMLVDFSKNRITEETLAKLQDLAKETELADAIKSMFSGEKINRTEDRAVLHVALRNRSNTPIIVDGKDVMPEVNAVLEKMKTFSEAIISGSWKGYTGKAITDVVNIGIGGSDLGPFMVTEALRPYKNHLNMHFVSNVDGTHIAEVLKKVNPETTLFLVASKTFTTQETMTNAHSARDWFLKTAGDEKHVAKHFAALSTNGKAVGEFGIDTANMFEFWDWVGGRYSLWSAIGLSIILSVGFDNFVELLSGAHAMDKHFSTTAPEKNLPVLLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELGDDKAIDSHDSSTNGLINRYKAWRA

SEQ ID NO: 9546 - protein, 226 aa, Enterobacter cloacae
PHFGVVISPLRRRVVKRPAIILICLLLQACSATTKGLGHSLWDSMFGTPGVHLTDDELQNMPYASQYMQLNDGPQLFVVLAFDENGQQKWVTQDQATIVTQHSRIVKTLLGGDNLLEVNNLAEDPLIKPNQIVDGASWTRTMGWTEHKQVRYATARSTFRWDGTDSVKVGSDETQVRVLDEEVTTDQATWHNRFWVDEEGQIRQSLQYLGAGFFPVKTTLIKAAKS

SEQ ID NO: 9547 - protein, 374 aa, Enterobacter cloacae
RREKGMASVQLRNVTKAWGDVVVSKDINLDIHEGEFVVFVGPSGCGKSTLLRMIAGLETITRGDLFIGDTRMNDIPPAERGVGMVFQSYALYPHLSVAENMSFGLKLAGAKKETINQRVTQVAEVLQLAHLLERKPKALSGGQRQRVAIGRTLVAEPRVFLLDEPLSNLDAALRVQMRIEISRLHKRLGRTMIYVTHDQVEAMTLADKIVVLDAGRVAQVGKPLELYHYPADRFVAGFIGSPKMNFLPVKVTATAIEQVQVELPNRQQVWLPVDSANVQVGANMSLGIRPEHLLPSHIADVTLEGEVQVVEQLGHETQIHIQIPAIRQNLVYRQNDVVLVEEGATFAIGLPPERCHLFREDGTACRRLHKEPGV

SEQ ID NO: 9548 - protein, 450 aa, Enterobacter cloacae
AFQLQRKAMISGDRIMITLRKVPLAVAIAAGILSAQAGAVDFKGYARSGIGWTGSGGEQQCFQATGAQSKYRLGNECETYAELKLGQEVWKEGDKSFYFDTNVAYSVSQQNDWESTSPAFREANVQGKNLIEWLPGSTIWAGKRFYQRHDVHMIDFYYWDISGPGAGIENIDLGFGKLSLAATRSSESGGSATFADRDANGDRIYDNVVPNDVFDVRLAGLETNPGGTLELGVDYGHTNIPDDYYLQPGASKDGWLFTAEHTQSMMKGFNKFVLQYGTDSMTSNGKGIPQGGSIDNDGSMWRVLDHGAITLADRWDLMYVGMYQNIDRDNNNGTEWWTVGVRPMFKWTPIMSTLLEVGYDNVKSQKTDDKNSQYKITLAQQWQAGDSIWSRPAIRVFATYAKWDEKWGYANNDSGAGYTSGVAYSDTSAKTFSRGDNDEWTFGAQMEIWW

SEQ ID NO: 9549 - protein, 331 aa, Enterobacter cloacae
GAARYCLATAVLTLSEVITMKMKKSLVALCLSAGLLACAPALTYADVNFVPQNTSAAPAIPAAALQQLVWTPVDQSKTQTTQLAAGGQSLNVPGISGPVAAFSVPANIGELTLTLTSEVNKQTSVFAPNVLILDQSMTPSAFFPSDYFSYQEPGVMSADRLEGVMRLTPALGQQKIYVLVFTTEKDLQQTTKLVDPAKAYAKGTGNAVPDIPDPHARHTTDGLIKLKVSTNSASSVLVGPLFGSSGPGPVTVGNTAAPVYAAPAATPAAAPAPAKKAEPVLNDTETYFNNAIKQAVKNGDVDKALKLLDEAERLGSTTARSTFISSVKGKG

SEQ ID NO: 9550 - protein, 74 aa, Enterobacter cloacae
HEDTIMNKDEIGGNWKQFKGKAKEQWGKLTDDDMTVIEGKRDQLVGKIQERYGYEKDQAENEVKDWETRNDYRW

SEQ ID NO: 9551 - protein, 483 aa, Enterobacter cloacae
SFDPLFISVTPFTMAGNKPFNKQTEPRERDYQVAGLKVPPHSIEAEQSVLGGLMLDNERWDDVAERVVAEDFYTRPHRHIFTEMARLQESGSPIDLITLAESLERLGQLDSVGGFAYLAELSKNTPSAANISAYADIVRERAVVREMISVANEIAEAGFDPQGRTSEDLLDLAESRVFKIAESRANKDEGPKNIADVLDATVARIEQLFQQPHDGVTGVNTGYDDLNKKTAGLQPSDLIIVAARPSMGKTTFAMNLVENAAMLQDKPVLIFSLEMPSEQIMMRSLASLSRVDQTRIRTGQLDDEDWARISGTMGILLEKRNIYIDDSSGLTPTEVRSRARRIAREHGGIGLIMIDYLQLMRVPSLSDNRTLEIAEISRSLKALAKELHVPVVALSQLNRSLEQRADKRPVNSDLRESGSIEQDADLIMFIYRDEVYHENSDLKGIAEIIIGKQRNGPIGTVRLTFNGQWSRFDNYAGPQYDDE

SEQ ID NO: 9552 - protein, 245 aa, Enterobacter cloacae
QTEYSGENMRKITLALSAACLLFSLNSTVVARASAPTPLYTGTTAAILAEQAPIHWVSVAQIENSLTGRPPMAVGFDIDDTVLFSSPGFWRGKKTYSPDSEAYLKNPEFWEKMNNGWDEFSIPKEVARALIAMHVKRGDSIYFVTGRSQTKTETVSKTLQDDFLIPAASMNPVIFAGDQEGQNTKTQWLEKKNIKVFYGDSDNDITAAHDVGARGIRVLRASNSTYRPLPMAGKFGEEVIVNSEY

SEQ ID NO: 9553 - protein, 127 aa, Enterobacter cloacae
NYRNATRGIKMTISEILQYCMSKPGAEQSVHSDWKATQIKVGDVLFAMVKEVDARPAASLKTSPELADLLRQQHDDVRPSKHLNKAHWSTVFLDGSLPDSQIYYLVDASYQQAVELLPETIRQQLSV

SEQ ID NO: 9554 - protein, 195 aa, Enterobacter cloacae
HHRRAARQFQRRFKGFRQTRRQIFTDLKPVNHHFDGVFLLQLQLWRIGQVTHFAVDTGADIALACQIFQRFSMFALTLFNDRRQQHQAFAFRLRQHVIHHLADGLGRQRNVVIRAARLAHARIQQTQVVMDFGNGTDRGSRVMRRGFLLNGDSRRQPFNVVDIRFFHQRQELTRVRRERFNVTTLSFGIQSVESQ

SEQ ID NO: 9555 - protein, 549 aa, Enterobacter cloacae
FMQRNHLFIKAAGLHCYRRTTCRDTEREMNRSARRKMLKVVGIIMVVMLPVMLALWFAQLSAVSEISAQLRTFAELALNKTERVIQQVDLARKDAEKYQGKVCTPEHRQYMLNVSRGRLFVADLIYADGQDFLCSTLFTPEHPYIIPAANYTRKPDVAIYYFRDTPFFNGYKMIYMQRGNYVAVVNPLSYSEVMSDDRSLSWGVYDTVSNAFFSVSQKANISLLHSMLRHQETTFQKDDRFYTIVKSEQRPIAAIVSTSSARFYKTLYHQATLTLPLGIICSIIILLVWSRTHREFNSPGRLLHRALNKRQLCVHYQPIIDIKNNQCVGAEALLRWPGFNGQVMSPAEFIPLAEKEGMIERITDYVVEEVFSDLGHFLAAHPDLYVSINLSASDFHSSRLIALISDKARFYSVRAQQIKIEVTERGFIDVPKTTPVIQAFRQAGYEVAIDDFGTGYSNLHNLYSLNVDILKIDKSFIDTLTTNSTSHLIAEHIIEMAQSLRLKTIAEGVETGEQVSWLLKRGVQYCQGWHFAKAMPPQAFMAWQQQPLR

SEQ ID NO: 9556 - protein, 158 aa, Enterobacter cloacae
FISVDTVRSLYWRLVSFLRKTPMAVALSRVTPAVVQRLQVPVQVLLYAGLFVFAEYLVDWLHLPLPANLVGMVLMLTLILCRALPLNWVRAGARWLLAEMLLFFVPAVVAVVNYAQLLMVDGWRIFAVIALSTLMVLGATAWVVDKVYRFEISRQKHD

SEQ ID NO: 9557 - protein, 510 aa, Enterobacter cloacae
RLNINDAGLAKISSSVPLVVSFLILISKDWTFIRHISASFLLIICLSGSKETGEIMLTFLELLIGVVVIVGVARYIIKGYSATGVLFVGGLTLLIISALMGHQVLPASEASTGYTATDIVEYIKILLMSRGGDLGMMIMMLCGFAAYMTHIGANDMVVKLASKPLQYINSPYLLMVAAYFLACLMSLAVSSATGLGVLLMATLFPVMVNVGISRGAAAAICASPAAIILSPTSGDVVLAAKAAEMSLIDFAFKTTLPISITAILGMGVAHFFWQRYLDKKENVSHEMMDVSEITTTAPAFYSILPFMPIIGVLIFDGKWGPQLHIITILVICMLLAAILEFVRGFNTQKVFTGLEVAFRGMADAFAGVVMLLVAAGVFAQGLSTIGFIQSLISIATSFGSASIILMLVLVVLTMLAAMTTGSGNAPFYAFVEMIPKLAHSSGINPAYLSIPMLQASNLGRTISPVSGVVVAVAGMAKISPFEVVKRTSVPVLVGLIIVIIATEVLVPGAA

SEQ ID NO: 9558 - protein, 117 aa, Enterobacter cloacae
SWRYLQEEFHMAKKLIALCACPMGLAHTFMAAQALEDAATEAGYEVKIETQGADGIQNRLTPQDIADADIIIHAIAITPEDNERFEMRDVYEITLQDAIKNAAGTLKEIEEMIAAEQ

SEQ ID NO: 9559 - protein, 424 aa, Enterobacter cloacae
SSHPGVFVMAIKKRSAVRPDSHEGDTLAIKSAPVAAGASFWKELPQHIMSGISRMVPTLIMGGVILAISQLIAYVWLEIPPDTGILDALNSGKFTGFNLSLLKFGYLTESFGGLLFSFAIPMFAAFVANSIGGKLAFPAGFIGGLVATQPTLVLNFDAEKLTWLATKPVPSTFIGALIIAIAAGYLVKWLNSRINVPQYLLAFKSTFLIPILSALFVMLAMYYIITPIGGWLNAGMRTVLLAAGQAGSMMYAIGMAAATAIDLGGPINKAAGFVGLGLTTDHVLPITSRAVAIVIPPIGLGLATLIDHRLTGKRLFSPQLYPQGKTAMFLAFMGISEGAIPFLLENPLATLPAYMAGAIAGAMTATALGAVQWFPESAIWAWPLVTNLGAYMLSIVVGAAITALLVVIIRNSLHKRGKLAIDTL

SEQ ID NO: 9560 - protein, 373 aa, Enterobacter cloacae
RCGAGDGNGRRGALYLRQTAIADGRIRVDRDLLRALSEADAIAASEQEVRDILLSEAQKYHKEVQFDGLGSVLIRVNQSRGPKVMVCAHMDEVGFMVRSVSREGAIDVLPIGNVRMMARTLQPVRITTRNGEKIPGLLDGDLKGENVDNLRVDIGATSAEEVFAAGIDAGDRVTFDTPFQTLPHNRVMGKAFDDRLGCYLLIALLRELHQTPLDCELWLVASSSEEVGLRGGQTATRAIHPDIALVLDTACWSKNFDYGSANHRQIGAGPMLVLYDKTLIAPAKLIALAETIARSQGIPLQKDMFSNGGTDGGAIHLSGTGVPTLVLGPPTRHGHCAASIADEKDIHHTQQLLVALVAGMNRETVDHLTDFRC

SEQ ID NO: 9561 - protein, 327 aa, Enterobacter cloacae
LPSVVLQDGITTANSTHSGRNMANLYDLKKFDLNLLVIFECIYQHLSISRAAETLYITPSAVSQSLQRLRGQLNDPLFIRSGKGITPTTVGTNLHHHLEKNLNQLEQTINMMHHSDIKKKFVIYCSQMVSPGSMLEPLKLLISEENYEIEQRDMLISSESAEDLLAYRKADLIFSIAPIHNRSVVCTHFTTVPIALICRADHPRLADAVTLEVLYQEKFTFYQSAHPGVKEFQSRANDAFPERNIAFRTDSLSSLISMVCSSDLLGFIPVSIYETYKEPLKLKRLEPPFELPELKIYMLYSRSSLNSTVFSTFIEKMHKLCVSPPSA

SEQ ID NO: 9562 - protein, 206 aa, Enterobacter cloacae
KEMTDNLQLTHLVEACRWIGAKGWAPATGGNMSMRQDEHLCWLSESGKDKGSLTTADFLQVEIATNRAPSGRKPSAETGLHTLIYRLFPEANAVLHVHTVNATVLSRLVNEAELKITGFEMQKSLTGQTTHRDTVAIPVFDNDQDIDALASRIAHYAQERPLNYGFLLRGHGLTCWGRDVAEARRHLEGLEFLFECEMRLRQWERV

SEQ ID NO: 9563 - protein, 436 aa, Enterobacter cloacae
CLHVVNSLLRCCSTLCQDEIQMYRRLHVLISKTEEQAMSQYRTFTAQDAVEYARQFGGLDDPSSLVEAQEVGDGNLNLVFKIFDSAGVSRIVVKQALPYVRCVGESWPLTLDRARLEAQTLVEHYQHSPQHTVKIHHFDPELAVMVMEDLSSHRIWRGELIRNNYYPQAARQLGEYLAHTLFHTSDFYLHPHEKKAQVAKFINPEMCEITEDLFFNDPYQIHARNSYPAELENDVAALRDDAQLKIAVASLKHRFFSHAEALLHGDIHSGSIFVADGSLKAIDAEFGYFGPIGFDVGTAIGNLLLNFCGLPGHLGIRDAAAAREQRLTDIQELWNTFAERFQVLANEKARDAALSAPGYASAFLKKVWHDAIGFCGTELIRRSVGLSHVADIDTIQDEAMRHECLRHAISLGKALIVIADRIDSAEELVARVRQYS

SEQ ID NO: 9564 - protein, 370 aa, Enterobacter cloacae
RLLKKDNFMSNTDIRVVPGPANYFSHPGSLAHLDNFFTPEQLSRAVWIYGERAIEGARPYLPQSFNATGAKHLLFKGHCSERDVTRLVNESGSETSVVIGVGGGAVMDTVKAVARRLGVPFVGIPTIAATCAAWTPLSVWYNDAGQALQFEIFDDANFLVLVEPQIILNAPAEYLLAGIGDTLAKWYEAAVLAPQPESLPLTVRLGLNGALAIRDVLLERSEEALADQQRGEQTQAFRDVVDAIIAGGGMVGGLGERYTRVAAAHAVHNGLTVLPQTEKYLHGTKVAYGILVQSALLGQDDVLAQLVAAYRRFNLPITLRELDVDIHNRDELDKVIGHTLRPVESIHYLPVTLTPEVLRAAFAKVESFSR

SEQ ID NO: 9565 - protein, 266 aa, Enterobacter cloacae
LRRRAIPNDDSLHSCNEVIMQIDLSGKKALVTGASRGLGRAIALSLARAGADVVITYEKSVDKAQAVADEIKALGRHGEAIQADSASAQAIQDAVTQAARSLGGLDILVNNAGIARGGPLESMTLADIDALINVNIRGVVIAIQEALVHMSDGGRIINIGSCLANRVAQPGIAVYSMTKSALNSLTRGLARDLGPRGITVNLVHPGPTNSDMNPEDGEQADSQRQLIALGHYGQPEDIAAAVTFLASPAAGQISGTGLDVDGGLNA

SEQ ID NO: 9566 - protein, 123 aa, Enterobacter cloacae
KFGIYLIVLLFPYILCGRTVEVRMKIVWSKTAEKQFSKIDPRYQNRIKFRLEKMDDKTSPVADIKKLSSPENHYRLRLGDYRVIYTFGDPPGDICYVVAVKRRTTTTYLHEEHTEYDYSVHQG

SEQ ID NO: 9567 - protein, 296 aa, Enterobacter cloacae
YPKSACGRFLCFNNPQKLIAPNQSGKQMFRKDIVIPSGAVALALCVFSIQADPLKPTQYGDFDRYVLALSWQTGFCQSMVERNRDEPEECRLQKESSNKTDFLTVHGLWPALPKSIAARGVDERRWMRFGCATRPVPNMPEAKASRKCDAAETGLSLTGAAKLNSVMPGAGGNSCLERYEYAKHGVCFGFDPDAYFGTMVRMNQEVKHSAAGKFLAENYGKSVRRSDFDAAVAKSWGKQSVKAFKLTCHGNPAYLTEMQISLNASTINNPLSAGSFAPQPHPGNCGKQFVIDKAGY

SEQ ID NO: 9568 - protein, 148 aa, Enterobacter cloacae
FRRPTPGVLLGYDKDLSCRRAKHAAGGTPLYAVYQIVLAAQQAAIDAIRPGVSCHQIDSAVRSVIERAGYGPQFGHNTGHAIGIDVHENPRFSPTDRTPLQPGMVLTVEPGIYLEHLGGVRIEDVVLVTETGAEVLYTFDKRLLLTGE

SEQ ID NO: 9569 - protein, 818 aa, Enterobacter cloacae
RTSDADLTRPGGSMLSIEFFCPLPNGLHARPAWALKEQCSAWRSDIRFINRRLHTHADAKSSLALISTGTLFNDSCVLEINGSDEEQARRVLEAYLTGAFIDSDSIPSGDAPHVAHPLPRSLVRLAPHLQHGITLASGIGAGTLRGWQSDNLKRYCQIPASPEDITRLEHSLATLAEQLNYRLRGLDGESKTILSAHLSLIQDEEFGGTIRRLIAEERLSLAEAIIRNMELICDKLSLSASDYLRERVSDIRDISEQLLNITWPELQQTSAFTLSAPTILVAEDLTPSQFLSLDTQYLKGMVLEKTGRTSHTLILARAASVPVLSGLTVASLAPLMGKEVILDGICSVLVVEPNDAVNDYYSVAQRLADRRHQQQIKDAGLPALTRDNVPVEIAANIGSALEAPGAFTCGAQGIGLFRTEMLYMDRDTAPDEQEQFEAYQQVLLSAQGKPVIFRTMDIGGDKQIPYLNIPQEENPFLGYRAVRIYPEFADLFRTQLRAILRAGASGNALLMIPMVHSLDQILWIKQELQNVRDALASQGLRHTARLPLGIMVEVPSVCFIIDHFCEEVDFFSIGSNDMTQYLYAVDRNNPRVSGLYNPITPSFLRMVRQIVTAAHRHGKWVGICGELGGEQRYLPLLLGLGLDEFSMSGPRIPAVKTQLRQLDMATCRALADKACDSRSAEEIEALLADFTPEAPPRPLLALETIVVNEPLTSKEQVLQFLCGNLAIHGRTGNPLELEEDLWQREEIVTTAVGFGVAIPHTKSQWIRHSSISIARLDKAIDWESDLGDVELVIMLTLGAQEGINHVKVFSPAGAEAGQ

SEQ ID NO: 9570 - protein, 141 aa, Enterobacter cloacae
RHGVKMSRPTIIINELDAERIDRLLEKPEFASLPVADALNEELDRAQMCTPETMPHDVVTMNSQVKFRNLTTGEELTRTLVYPAQMTDSSTQLSVLAPVGAALLGLRTGDTIHWELPGGASAHLEVLELFYQPEAAGDYLR

SEQ ID NO: 9571 - protein, 227 aa, Enterobacter cloacae
TLSALQRQSESKTQGMGDFMQQRIITEMETYLQALSEEERIAAINAFRQALHEISPFRDQPVDCVLWIKKTNITANDYNPNNVAPPEKRLLSKSLELDGFTQPIVVTENAPQHYEIVDGFHRHDIGSNRAILKRQLKGYLPVTCLRKARQEKFDRMAATIRHNRARGRHQINAMSEIVRELVLMGWSEQKIGQELGMDSDEVLRLKQINGLLELFADRRFSEAWTVK

SEQ ID NO: 9572 - protein, 193 aa, Enterobacter cloacae
EAQLRQNRHHQHDDHNGRHLPQQAERRRNGPFRHVAARQHHVLSNRPAVAVGHRHALDDKQAGKGREHVRNAQDDDQKRVKQADQRTERESDYNRLGGAEAVPDEERNHQRVRQRRGGSHREIEPADGQGDRHADGNHRHDGNRAQNVNDVVRIEEAVRRQAKNGHQRDDGQQHAPLVEKIENLLTARRRRAH

SEQ ID NO: 9573 - protein, 276 aa, Enterobacter cloacae
TMELLRRLRAWLAAEKLDGVLISSRQNKQPHLGISTGSGYVLVTQTAAHILVDFRYYSDIASRAAGYEMHLLNTENPFAQAVNQIIAKEALTRLGFEGEYVSWQTGVLWRDTLNTALCSTSLDALRQIKTADEIDRIRAACGIADRAAQHIRRFIQPGMREREVAAELEWFMKQEGADKPSFDTIVASGPRGALPHGKASDKVIMPGEMITLDFGAQHQGYCSDMTRTFLVAGQNTPPEEHLSMRCTRSFWRHNRQLLMPSAPAFPVIRSIAPYVP

SEQ ID NO: 9574 - protein, 147 aa, Enterobacter cloacae
QGETVMYQTIIMPVDVFEMELSDKAIRHAEFLAQQDGIIHLLHVLPGSASLSLHRFAADVRRFEEHLQHEAETRLQTMVGHFSIDPSRIKTHVRFGSVRDAVNELAGELNADVVVIGSRNPSITTHLLGSNASSVIRHTHIPVMVVR

SEQ ID NO: 9575 - protein, 86 aa, Enterobacter cloacae
PPVHSSARTRDVNSCPSGEPAKRGPWSDPGLAIRKEGLRTASVLSSLKVTFGDSSAISVSSALISADFALSSSVAISSTGLVSFSR

SEQ ID NO: 9576 - protein, 426 aa, Enterobacter cloacae
FHNIVLFFSRHLTRRTRLIMSIYKIPLQENVLDASAERIDWTLNNFSRVCVSFSGGKDSTVMLHLVAQKARQLKRKIDVIFLDWEAQFSSTIQHVDTMRTLYRDVIHLFWWVALPLTTQNALSQFQPEWQCWEPGTNWVRQPPEDAITDYHYFDFYQQGMTFEAFVREFAEWYAQRRPAAVMVGIPADESYNRFLAIASARKQRFSDDKPWTTVAPGGHAWYIYPLYDWKTADIWTWFAKSKCCYNPLYDLMYKAGVPPRYMRICEPFGPEQRQGLWLYHVIEPERWAAMCERACGVRSGGIYAGHDNHFYGHRKILKPDHLGWREYAMLLLDSMPQNTAEHYRNKIAVYLHWYQKRGMNDIPDTQEGDIGAKDIPSWRRICKVLLNNDYWCRALSFSPNKPKHYQRYSDRVKAKRKEWGILCNNE

SEQ ID NO: 9577 - protein, 240 aa, Enterobacter cloacae
MRNAFTTMGESMIRAIVTDIEGTTSDIRFVHDVLFPYARERLAAFVTAQQYAEPVKSILDNLRDEISAPHASVSDLINVLFTFMDEDRKSTALKALQGIIWQDGYVNGDFTGHLYPDVLPALEKWKAQGIDLYVYSSGSVAAQKLLFGYSDEGDITHLFSGYFDTHIGAKREVQSYQNIAAQTGIAPSQILFLSDIHQELDAAEQAGFRTLQLIRGEDDGASHHHQIHQFDEINPEQIPS

SEQ ID NO: 9578 - protein, 175 aa, Enterobacter cloacae
NCPSAGDCCDRAVPGIRCRQPYHLAGYRGGRRLHAGGVMIWKRHLTLEELNATSLNTMVGHLGIVYTRLGDDTLEAEMPVDARTHQPFGLLHGGASAALAETLGSMAGFLMTRDGQNVVGTELNATHHRAVSHGKVRGVCQPLHLGRSSQSWEIVVFDEQGRRCCTCRLSTMVLG

SEQ ID NO: 9579 - protein, 547 aa, Enterobacter cloacae
QALTRCYVWTSGWLIIFRFILCLFRRCQSTGAVKNSLNQKSNEGFTRMVSSRLEMRGISLAFSGFQALSRVDFTLNGGSVHALTGANGAGKSTLMAVLCGTHDHYEGEICINNQPVSIREPLDAKRLGIHLVQQEVDVALIPGLSIAENIMLDQLAQPGHRYRWRDIRQQARQALAQLDVSLDVRRSIDGCTLAEKQQILLARALSHHCRFLILDEPTAPLDAHESERLFAVVRRLQQQGIGVVFISHRIHELKAICDTLTVLRDGRLIESGPMADLSGEAIVEKMLGHELSDIYPPPRPPHGDETLLRVEGLHDDALLKDISLHLRKGEILGIAGLAGAGKTELCKALFGASKSRVANGELNHQDWKPRDPADSVLRGLALVPEERRKEGIFIDEPVSMNLAVCADNSFSRWSLFGHRQAWRWAEEVIARVGVRARGPGQVLRRLSGGNQQKVAIGKWLRNDASVLIFDEPTKGVDVKAKTDLFQLIDGLAREGKGVIYASGEFAELVGLCDRICVLWDGRIVAEIAGAEAREETLLYYSTGGTAS

SEQ ID NO: 9580 - protein, 355 aa, Enterobacter cloacae
KMKKIALSLVALGLFTALPGFAATPAPLPAAIANHDGPIRIAVIRNLGSDDNTTQFVAGAIQEGKKLGFKVSTFLSNGDDAKFQDFVNQAISQKYDGIILSQGRDPYSTALVKKAVDAGIKVAVFDTAVNGEIPGVTVTQQDDASLTNLSFGQLAKDFNGKANIVKLWVAGFPPMERRQAAYKELQKQYPEIKELESIGAVSSDVQGDTANKVGAILAKYPKGKIDAIWGTWDAFSQGAYKALKENGRTEIKLYSIDISNQDLQLMREPGSPWKVSVAVDPKLIGATNVRLIANKIAGEATPATYDFKAAAIPQALLTAQPGAVNVASLGKIIPGWGQTEDFIAPWFATLEAKNK

SEQ ID NO: 9581 - protein, 360 aa, Enterobacter cloacae
TSIHLDFILTQCATTTQQGINDMQTLQTTSLRVANNQLFILDQQALPQEKRWVDASTVEALVGHIHALRVRGAPLIGLSASLLLALLAENGKSRDELAVALETLRASRPTAVNLMNNLDRMKLALWEEDFVPALVAEALRLIDEDKRLCDAIAKAGSALVKPGSRLLTHCNTGGLATAGVGTALGVIARAHKEGKVSNVWVDETRPLLQGGRLTAWELGELGVPYQLITDSMAASLMAKGQVDAVWVGADRIAANGDVANKIGTYSLAVLAKFHGIPFYVAAPQTTLDPDCPNGDAIPIEQRAASEVTGVAGSFGAVQWAPQNAQVYNPAFDVTPASLISGWVLDTGVVTPDEVAEGKFA

SEQ ID NO: 9582 - protein, 206 aa, Enterobacter cloacae
PRWIKLVTLHLDENTEEVQMSLINTKIKPFKNQAFKNGEFIEVTEKDIEGRWSVFFFYPADFTFVCPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKVKAAQYVASHPGEVCPAKWKEGEATLAPSLDLVGKI

SEQ ID NO: 9583 - protein, 243 aa, Enterobacter cloacae
IFGNKPGVPIHAERKFRYAGKTEPGQCALQPQRRESDMYFYQPSQGHGLPHDPLNAIIGPRPIGWISSCDRAGQLNLAPYSFFNCFNYRPPIIGFSSNGWKDSVRNITETGEFVWNLATRDLAEAMNETSATLPHGEDEFTFAGLTPVASQLVSSPRVAESPVNFECRLSQCIQLTGADGTPIDTWLVLGEVVGVHIAESLLEEGIYQTAKAQPILRAGGPTAYYAISDSHRFDLVRPDARRG

SEQ ID NO: 9584 - protein, 531 aa, Enterobacter cloacae
RYGWRDVQRGSATVPVKTSGQGLRRRCFPLYAGGGSTDAAQARTHCPGANAGGAVSGCANGVAATAGRGTTVAASTAGGTDGAISLWTVGASGPAGGASWRTGYGTGGEPGGARNGANLGCRELADPAGAGAMKKTTLMAIAIAIAAAGGYFVGQKQTHQPAAAAQPSERKVLYWYDPMVPGQRFDKPGKSPFMDMDLVPRYADEAQAASGVAISTQQQQNLGMKTANVEMRQLVSPFSAFATVATDERNVSVVSAPANGVVSKLFVNAPQQQVKAGEALAQLWIPQWTTAQQEYLAVRQLGDAALTRAARERLALQFMPEEVIRLLERSGKPQTTLILRADQAGYVVKLDVREGAQITATAPLFEIARLDPVWLVVDYPQTQAQSLAVGSNVVATSESWPGEQFHGTVSELLPQMETTTRTLKARIVLENSAHKLKPGMYLSVRRAEEMKGPPVLAVPEEAVINSGESARLLLATGDGYFRPVTVTTGLTAQGWTAILSGVKQGDKVVTSGQFLIDSEASLRSVMPEVTP

SEQ ID NO: 9585 - protein, 331 aa, Enterobacter cloacae
ISQAGARRGKYGADAGDPRRCRAARASEGDDGRHYYGRTAAHHVGEWEWLGGDATYCRADDWWHGNGTVIVDVSYSRTLQIVTSTLNMSTACAYSGMQFMYPQIIPRNGMVIRNNTHAVKRSFKYSVLRSAPNTKYGNGIVIVRIKFPLILLFIIGQLSCAFAVNADSNTADKGWFTTFTDNVAQTWNEPEHYDLYIPAITWHARFAYDKEKTDRYNERPWGAGFGQSRWDEKGNWHGLYLMAFKDSYNKWEPIGGYGWEKTWRPLSDDNFRLGLGYTAGFTARDNWKYIPVPVLLPLASIGYGPATFQMTYIPGTYNNGNVYFAWMRFQF

SEQ ID NO: 9586 - protein, 436 aa, Enterobacter cloacae
TLGLSSIRRGRFARRWTAGRCGIRLADENINDNHYCFFYHFKEDDMDTSLAEEVQHTATTLQADSFFFMSPYRSFTTSGCFARFSEPAVGGDDPAGPFQQKLAQAFRNAKNSGIAHPVMVGAIPFDTRKPSSLFIPQRWQTFSRPARQQSARYASGAQTLNVQQRTEIPPQPIFEEMVARAASLTATPQVNKVVLSRLIDIATDKQIDSSALMERLIAQNPASFNFHVPLEDGGVLLGASPELLLRKEGAHFSSLPLAGSARRQPDDVLDREAGTKLLASEKDRHEHDLVTQAMKTILEPRSHHLSMPASPQLITTPTLWHLATPVEGDARENENALTLACLLHPTPALSGFPHQAAKELIAELEPFDRELFGGIVGWCDSEGNGEWVVTIRCARLHQNTVRLFAGAGIVPASSPVGEWRETGVKLSTMLNVFGLH

SEQ ID NO: 9587 - protein, 539 aa, Enterobacter cloacae
GILMTIPFTRWPEDFARRYREKGYWQDLPLTHILTDHADSDAVAIIDGDRRITYRAFNQAVTNLASALQAQGLHRGETALVQLGNVAEFYITFFALLQIGVAPVNALFSHQRSELNAYAEQIKPAVLIADRDHALFSGDDFLNTFVDAHRSVRVVLLRGDKGEHALEAAISRPADNFIPNPTPADEVAFFQLSGGSTGTPKLIPRTHNDYDYSIRRSNEICGITAHTRYLNALPAAHNYAMSSPGSLGVFTAGGCVVLANDPSATLCFPLIEQHQINVTSLVPPAVSLWLQAIADGAGNAQLKSLELLQVGGARLSATLAARIPAEIGCQLQQVFGMAEGLVNYTALDDAPERIINTQGRPMCPDDEVWVADEDGNPLPRGEVGRLMTRGPYTFRGYFNSPEHNASAFDANGFYCSGDLIAIDEQGYITVQGREKDQINRGGEKIAAEEIENLLLRHDAVIHAALVSMEDSLLGEKSCAYLVVKQPLRAVEVRRFLREQGVAEFKLPDRVESVDALPLTPVGKVDKKQLRLWLAERARG

SEQ ID NO: 9588 - protein, 273 aa, Enterobacter cloacae
FRDAGKKSDPRCLVGAALPRGEVMAFDFTGKTVWVTGAGKGIGYATALAFVEAGAQVTGFDLAFPHGEYPFATETLDVADAAQASDVCGRLLSSLERLDVLVNAAGILRMGATDQLSPEDWQQTFAVNVGGAFNLFQQTMGQFRRQQGGAIVTVASDAAHTPRIGMSAYGASKAALKSLALTVGLELAGSGVRCNLVSPGSTDTDMQRTLWTSDDAEQRRIRGFGEQFKLGIPLGKIARPQEIAATVLFLASDAASHITLQDIVVDGGSTLGA

SEQ ID NO: 9589 - protein, 365 aa, Enterobacter cloacae
ISSVDCHSAFSLPARMGHRLIPGWCSAKSWASISPRVCWKRGFTRPRKRSPFCVRVDRRPTMPSVIAIASTWYARMRAGGNMRATLLPADQQFFADLLSGLVLNPQQLGRVWFAHRGASDAVGSVSRDWPRLDVVLRGEYGNRLVAGQQPLHQGEMLFLPAQAASVPVFERPVMLLSILFAPSWLGLVFHDTRHGRSVPAQRHVELPHPERGECAAMLMALTHLSASPQDQAIIQPLVLSLLHWCRKVVSSLPEPGVSRGDFLYQSICNWVQENYAEPLSRDSVASLFNISANHLSRLFSQQGTMSFVDYVRWVRMAKARTILQKYHLPVGEVAKRCGYADSDYFSRLFRRQFGLTPGEYRARFQ

SEQ ID NO: 9590 - protein, 434 aa, Enterobacter cloacae
RFQDYLADASTLSEVTMKQHTLSLWLGGVLFGLLTSAAQAEPWTLEHTLTEAQRYSAELSASRNEAQALDAMAVSATQLPDPKLKFGIENVPVQGSNDRRLTREGMTMQKVGIMQSYVSSEKRERKAQTLQAQARSVLAKSEAVRAALQRDTAQAWLDLALAQQALNTARTLVRETERQRGVQKASVGAGSAMPDSVLALQMILSAMRDKETLAQRDVQLAQSRLLELTGHAITEVRGPLPRYQRLPANEKTLQEGIVRHPEVEAARREAETAKARSAQSAVAAIPDVDVEVYYAHRAEGYDDMAGVMFSVDLPLFQSKRQDKDYAADVSRSMQAADQLTLLKREHIAQVQTLVAQYQAAQTVWQRQRDEVLPLQRQRLAVLTAQYRSGQSALPALLEARRGVLDTELAVNQAEREMARTWAAVNWLIPQELAQ

SEQ ID NO: 9591 - protein, 707 aa, Enterobacter cloacae
GLGQNADAQAARRVCRGGTGVCAVPVPPALRAGGDGLSAAGDPRGFCGDALSGHNANMMSLGGIAIAIGAMVDAAIVMIENMHKVLELWRHDNPGKEPAPGEYWRLAEKAAVEVGPALFCSLLIITLSFIPVFSLEAQEGRMFSPLAFTKTWSMAVAAGLGITLVPVLMGFFIRGKIPDEKANPINRLLIRLYEPLLDKVLTFPKTTLALACLLLIATLWPLSRLGSEFMPPLDEGDLLYMPSTLPGISAREASRLLQQTDRLIKSVPEVASVFGKAGRAESATDPAPLTMLETTIHFKPREQWRPGMTPQKLVEELDKTVSLPGIANVWVPPVRNRLDMLATGIKSPVGIKVNGNNIADIERVARQIEQVVKDVPGVSSALAERLEGGRYVDIRIDRQKAARYGVSVDELQSLVSTLVGGDNIGEVIQGRERYPINLRYPRDLRDNVDALRVLPVVTASGSQVALGELADIVVTEGPPMLKSENARLSSWIYVDLRGRDLKSAVDEMQKRVEEKVVLPQGVSLSWSGQFEYLERATARLKIVLPVTLMIIFVLLWLTFRRISNVLIIMGALPFALIGGVWLLWLLEYNLSVAGAVGFIALSGVAAEFGVIMVLYLNHAIDKYHRLEPEGGNTVLMRAIHEGAVLRVRPKVMTVATIMAGLLPIMWGSGSGSEVMQRIAAPMIGGMVTAPLLSMLVIPALYKLLHQR

SEQ ID NO: 9592 - protein, 344 aa, Enterobacter cloacae
NSPCARWRCDASCASRALPNLSCRTAWRAWMRFRSRRSAKLIRNSCACGLLNAPGAEEQRMAIPKLTAYALPTAAELPTSKVNWAFEPERAALLIHDMQEYFLNFWGENSDMMQQVVANIAKLRAYCKEHNIPVYYTAQPKDQSDEDRALLNDMWGPGLTRSPEQQRIVAELTPDEADTVLVKWRYSAFHRSPLEQMLKETGRNQLLITGVYAHIGCMTTATDAFMRDIKPFFIADALADFTRDEHLMSLKYVAGRSGRVVMTDELLPSVPATKAALRELILPLLDESDEPMDDENLIDYGLDSVRMMALAARWRKVHGDIDFVMLAKNPTLDAWWALLSREVK

SEQ ID NO: 9593 - protein, 712 aa, Enterobacter cloacae
HLTVSQQRTTTMNNSGKYLTWAVLSVVGAFALGYIALNRGEQINALWIVVASVCIYLIAYRFYGRYIAKTVLGVDGTRMTPAVRHNDGLDYVPTDKKVLFGHHFAAIAGAGPLVGPVLAAQMGYLPGMIWILAGVVLAGAVQDFMVLFVSTRRDGRSLGELVKEEMGATAGVIALVATFMIMVIILAVLAMIVVKALTHSPWGTYTVAFTIPLALFMGIYIRYLRPGRIGEVSVIGLVFLVFAIISGGWVAESPTWAPFFDFTGVQLTWMLVGYGFVAAVLPVWLLLAPRDYLSTFLKIGTIVGLAIGILIMRPTLTMPALTKFIDGTGPVWTGNLFPFLFITIACGAVSGFHALIASGTTPKMLANENQACLIGYGGMLMESFVAIMALVSACIIDPGVYFAMNSPMAVLAPAGTVDVVASAAQVVSGWGFAITPETLTHIANEVGEQSIISRAGGAPTLAVGMAYILHGALGGLMDVSFWYHFAILFEALFILTAVDAGTRAARFMLQDLLGVISPNLKRTDSLPANLLATALCVLAWGYFLHQGVVDPLGGINTLWPLFGIANQMLAGMALMLCAVVLFKMKRQRYAWVALVPTAWLLICTLTAGWQKAFSPDNKVGFLAIANKFQAMIDSGKIPAQYTESQLSQLVFNNRLDAGLTIFFMVVVVVLALYSLKTALAALKVDKPTAKETPYEPMPENLDEIVTQAKGAH

SEQ ID NO: 9594 - protein, 103 aa, Enterobacter cloacae
HYQTPSPQPSPQRGEGVKVPSPLWGEGQGEGNTNEKLIMFDTLSKAGKYLGQAAKMMIGVPDYDNYVEHMRVNHPDQTPMTYEEFFRDRQDARYGGKGGAKCC

SEQ ID NO: 9595 - protein, 344 aa, Enterobacter cloacae
RDTTLLFNRRNGVVSKALSVSAAASGRQQIFDFLYKWGMLLTVVALVAVFGLASDSFLDPNNIINILRSIAIVTVIAIGVSISLTVGGFDLSVGSTASLANALVISLFVWHGFGTTESIVITLALCTLVGLFNAFLIVILRIPDMLATLASLFVIQGVAMTYSYGGSITENMVLPSGDMAEGTIPAAFSLLGQVPTIVIVMLVVTILAQLGLSLTTHGRRMYAIGGNPEAARLSGIRTTRYKVAAYVIASLLAGLGGILLASRIGSSQVNAGGGYLMDAVAAAWIGFSLAGSGKPNALGTLVGAVILGVLSNGLVMLSVPYYAMDIIKGLVLAVALAITYIQKR

SEQ ID NO: 9596 - protein, 413 aa, Enterobacter cloacae
TSKRLDCQRLTSCYSVSNISITGRHTTMSNNPLIPQSKLPNLGTTIFTQMSALAQQHNAINLSQGFPDFDGPKYLQERLAYHVAQGANQYAPMTGVQTLREAIADKTAELYGHKPDANSDITVTAGATEALYAAITALVRTGDEVICFDPSYDSYAPAIELAGGVVKRVALQPPHFRPDWQAFAALLSDKTRLVILNTPHNPSATVWQKADFAALWQAIAEREIYVLSDEVYEHICFAEEGHASVLAHPQLRERAIAVSSFGKTYHMTGWKVGYCVAPAAISAELRKVHQYLTFAVNTPAQLALADMLRAEPGHYRELPHFYRERRDLFVAALSKSRLEILPSEGTYFLLADYSAISDLDDVSFCQLLTKEVGVAAIPLSVFCADPFPHKLIRLCFAKQESTLLAAAERLATL

SEQ ID NO: 9597 - protein, 534 aa, Enterobacter cloacae
GGLHDDVLREGRIMLDTNMKTQLKAYLEKLTKPVELIATLDDSAKSAEIKALLTEIAELSPKVTFKEDNTLAVRKPSFLIANPGSDQGPRFAGSPLGHEFTSLVLALLWTGGHPSKEAQALLEQIRDIDGDFEFETYYSLSCHNCPDVVQALNLMSVLNPRIKHTAIDGGTFQNEITERNVMGVPAVYLNGQEFGQGRMTLTEIVAKVDTGAEKRAAEELNQRDAYDVLIVGSGPAGAAAAVYSARKGIRTGLMGERFGGQVLDTVDIENYISVPKTEGQKLAGALKAHVSDYDVDVIDSQSASKLVPAAVEGGLHQIETASGAVLKARSVIIATGAKWRNMNVPGEDQYRTKGVTYCPHCDGPLFKGKRVAVIGGGNSGVEAAIDLAGIVEHVTLLEFAPEMKADQVLQDKVRSLNNVDIVLNAQTTEVKGDGSKVTGLEYRDRVSGDIHSVALAGIFVQIGLLPNTTWLEGAIERNRMGEIIIDAKCETSVKGVFAAGDCTTVPYKQIIIATGEGAKASLSSFDYLIRTKTA

SEQ ID NO: 9598 - protein, 421 aa, Enterobacter cloacae
AYPHPFGGCMKALTYHGPHHVRVDNVPDPGIEQPDDIILRVTATAICGSDLHLYRGKIPKVQHGDIFGHEFMGEVVECGSEVKNVQKGDRVVIPFVIACGDCFFCQMQQYAACENTNRGQGAALNKKQIPAPAALFGYSHLYGGVPGGQAEYVRVPKGNVGPFKVPQLLSDDKALFLSDILPTAWQAAKNAQIQRGSSVAVFGAGPVGLLTIACARLLGAEQIFVVDHHPYRLRFAQERYGAIPINFDDDNDAAEKIIEQTAGQRGVDAVIDAVGFEAKGSTTETILSNLKIEGSSGKALRQCIAAVRRGGVVSVPGVYAGFIHGFLFGDAFDKGLSFKMGQTHVHAWLGELLPLIEKGLLTPEDIVTHYLPLSDAERAYKIFEKREEECRKVILVPGADTPEAAQQKVKGLVNAFPGGVV

SEQ ID NO: 9599 - protein, 77 aa, Enterobacter cloacae
GTAREFPVDSIACAQSKQRRAHGCQHRQLRAAVGHLRRIDQRTGELLAGGQVAELHLAVHGDHIMRHGLRRTHLRPV

SEQ ID NO: 9600 - protein, 111 aa, Enterobacter cloacae
FVDFIYLTFNRSFIMRTVFLSALVGASVSFASYTAQANQTWQGRGVVQSISDSAVMLRHEAIPELKWPAMTMPFTLSAGATLNGAKPGDEVTFTLERAGDGFKIISLTPAR

SEQ ID NO: 9601 - protein, 395 aa, Enterobacter cloacae
RDAGGDAMIAAVIRASLRNRLLVILAALMMAGWGWWAVQRAPLDALPDLSDVQVIIKASYPGKAPQVIEDQVTWPLTTSMLSVPGAKTVRGFSMFGDAYVYVLFEDGTDLYWARSRVLEYLSQVQAQFPPGVKVSLGPDATGVGWIYEYALIDRSGKHSLADLRALQDWTLKFELKTVPNVSEVASIGGMVRQYQIVADPAKMRALNITHSQLSGAVQAANKESGGALLEMGEAEYMVRTTGYLRSLEDFRNVVIATRDGVPVLLKDVATIGIGPEIRRSVAELNGEGEVAGGVIVMRYGQNALETLHAVKAKLSELQKTLPQGVEIVPVYDRSTLIEDSVKTLTHKLLEEFAVVVLVCALFLFHLRSALVAMVSLPLGILGAFVVMHYQGITRI

SEQ ID NO: 9602 - protein, 333 aa, Enterobacter cloacae
NSSRITSPTPVSSGSFCNIRVRIPSVTTSSRVDGPTQVSARIRYPTVSPGFSFSSSARRCATLRAASLRGSSRIIFPLMFPSRRICRGSQVDLPAPVGALSKTCGACSKAASSSGRTTATGKEDTYGSRGLTLIGVHCSIGAYHYRVLRMSESKRLFFAIELPTTLQRQIVRWRASHFPAEAGRPVVAANMHLTLAFLGEVSAEKQRALSAMAGRISQPGFTLHLDDAGQWLRSRVVWLGTRQPPRGLLQLANMLRAQAARSGCYQSPQPFHPHITLLRDAGQAVAIPPPGFHWSFQVNEFALYESAFVQGRTRYTPLQRWTLGDTLRNPDEV

SEQ ID NO: 9603 - protein, 158 aa, Enterobacter cloacae
CVLRRSNMQEGQNRKTSSLSILAIAGVEPYQEKPGEEYMNEAQLSHFKRILEAWRNQLRDEVDRTVTHMQDEAANFPDPVDRAAQEEEFSLELRNRDRERKLIKKIEKTLKKVEDEDFGYCESCGVEIGIRRLEARPTADLCIDCKTLAEIREKQMAG

SEQ ID NO: 9604 - protein, 300 aa, Enterobacter cloacae
VRRLSGRRTQFPLRSPGVLIIETLPLLRQHIRRARQEGKRIALVPTMGNLHDGHMKLVDEARARADIVVVSIFVNPMQFDREDDLARYPRTLQEDCEKLKKRHADIVFAPAPADVYPQGTTESTYVDVPGISTMLEGASRPGHFRGVSTIVSKLFNLVQPDIACFGEKDFQQLALIRKMVADMGYDIEIIGVPIVRAKDGLALSSRNGYLTAEQRKIAPGLSKVMNTMAEQLLAKELTAEEIIALAEQALNEKGLRADDVQIRDADTLLALTETSKRAVILVAAWLGQARLIDNKVVELA

SEQ ID NO: 9605 - protein, 204 aa, Enterobacter cloacae
KMSFNKLGLATVVAMVLSAGSAMAADIPSDTGTITFHGMVSNNTCKVSLDQKIDQDGNDFDVNLDTVFVKDFANALGTTSTLGEKKFSLTLTGCDSATVKQASAQFDSWAGSSSTSGGLLVPPSNTQGAAKNVNLVLSNDGNSATDQIKLDQTNNTQKATIDTTGAGALYYRVAYTQGQNWDAANNPVSAGVVQAQAAFTMIYE

SEQ ID NO: 9606 - protein, 208 aa, Enterobacter cloacae
STVPNVMMLKQGITPMGNNMKKNHCGYSLIALAMLAMSGSAAAADLNVNFTANIRETTCDMKLVGDTGSDTQQTLTIGNNGQVRLDDVKDGTANANFKIVLVECPASLTSLKTKVSGTRSGYLYSGLINQIQKIDGGADYSAVEIARASAPDAPFIINSEDDNERLVWSPTEIQNKEVALVATLRETQENRMTIGDFQAVATFEFIYE

SEQ ID NO: 9607 - protein, 373 aa, Enterobacter cloacae
RHLRIIIRTGKRMRMFNFIRQGFTVKGTMAFAMASVLLTLSHSCWAADCRMNNGKGGTTTLINSEYSGGTVRLPPPGNYASTLFNVNLTPGIQAECGPGNDGFNLVSQTNPTLLKGSSYGRAMFETNIPGIYYSVRVHTAESDGGMGGYFAMNTTDWTTVASSGNSDPWDEKWINTSVQIYIDAGYRGNPNKETSIRPKPGTLGKMAIGNPNDSNNQPWTFVVNEDSFQIPIVLPTCDMAMLSDGTNDVNLGEYYVSDIKNNRVKDIPFSISLSNCTSVANITTKLTTSKLTGKNNDLLGNTLSSGAEGAGVKIMYNGTSQLLPNNPDSSYVITDYQTPESKQINYVAQLVANGSTVKPGSFKATGVFTLSYD

SEQ ID NO: 9608 - protein, 600 aa, Enterobacter cloacae
PRTHQVPPRQAAAGRNHALPCPALSAGELGLPAVHGSCTGHHAHHPRHGDFRLPDPGLDCDPRRGLYGETEKCQNGESALNVFSLYSRLRVQRLVTFLTNSRQQQNPPYHRLYIATHIFVCQRIILSIPKPGELSMNNNKLSVKEKIGYGMGDAGCNIIFGAIMLFVNYFYTDIFGLAPALVGVLLLSVRVIDAVTDPIMGAIADRTRSKYGRFRPWLLWIAFPYALFSILMFTTPEWSYNSKVIYAFVTYFLLSLTYTAINIPYCSLGGVITNDPKERVACQSYRFVMVGIATLLLSLTLLPMADWFGGDNKAKGYQMAMTVLALIGTCMFLFCFATVRERVRPAVQTHDELKNDLKDVWKNDQWVRILLLTLCNVCPGFIRMAATMYYVTWVMGQSTHFATLFISLGVVGMMFGSMLAKVLTDRWCKLKVFFWTNIALAIFSCAFYFFDPKATTTIVVLYVLLNILHQIPSPLHWSLMADVDDYGEWKTGKRITGISFSGNIFFLKLGLAIAGAMVGFLLSWYGYDAGAKAQSADAINGIVLLFTVIPGIGYLITAGVVRLLKVDRETMKQIQSDLEKRRTNYRELNDYQELKAAETK

SEQ ID NO: 9609 - protein, 328 aa, Enterobacter cloacae
QHAGTPYLWCCYSVQSSMFQYYDSLPIWSFIMPPRRYNPDHRRDALLERINSDIPASVAHALREDLGGDVSADNDITAQLLPKETRSHAVVITREAGVFCGKRWVEEVFTQLAGDEVQVTWHVEDGDAVTANQPLFELDGPSRVLLTGERTALNFVQTLSGVASEVRRYVDLLAGTRTQLLDTRKTLPGLRTALKYAVLCGGGANHRLGLSDAFLIKENHIIASGSVRQAVEKAFWLHPDVPVEVEVETLEELDEAIKAGADIIMLDNFDTEQMREAVKRTNGQAQLEVSGNVTFDTIREFAETGVDYISVGALTKHVRALDLSMRFK

SEQ ID NO: 9610 - protein, 407 aa, Enterobacter cloacae
LRSKSCCASWECQMAANSLWRWRALTTEGEVQTGTLWAIDRNAAYTALVLKQLHPLALKRCQQHHRWQVQHCYDIFRQLATLLQAGLMLSQSLHMLAEQHPLQHWQALLHSLADDLSEGFALSEAMKKWPEVFSPLYVSMVKTGELTGKLEACCRQLAQQQKSQQQLSAKVKKALRYPLIILTLAVFVVLAMVTLVLPEFAAIYKTFNTPLPLLTQAVMGLAALVQAHILTLLALLVAMVVIACKLRRHPRWQYVLLHVPVMGTLMRGQKLGQIFTVLSLTQQAGIAFLQGLESVEETVECGYWQEKLREIRSDIEQGMPVWSSFQKASVFTPLCIQLIRTGEVSGSLDVMLMNLARHHTEQTFQQADNLAALLEPLLLVVTGLIIGTLVVAMYLPIFHLGDAMSAG

SEQ ID NO: 9611 - protein, 212 aa, Enterobacter cloacae
FPGSDLMGYIVALTGGIGSGKSTVAHAFARLGITIIDADIIARHVVEPNTPALNAIEAHFGRRVIQADGTLNRRQLREYIFSDPAEKAWLNALLHPIIHQETQRQIAAARSPYVLWVVPLLVENQLQNKADRTLVIDVSRETQIQRTMARDHVSREHAEQILAAQATREARLAVADDVIDNNGAPDAIASDVARLHAQYLTFAAQAVAQEKP

SEQ ID NO: 9612 - protein, 194 aa, Enterobacter cloacae
HQAPSGRAGSVRRSSAATATVQASRAASHHPPLATPVPAATSRRSADVYDIVQPPASSSVRSALFPECHSASPGVTLPPTASPAVSSRASVCQSGYDGTPSACPGYHPIPRCQIAEAAAGRHASGGQYPRQPPVKYARPGSGCPGVRAARSAIHDASGRHRCPASRPSHLPADSDHPARDGARFCPGRPGPAEG

SEQ ID NO: 9613 - protein, 237 aa, Enterobacter cloacae
GILMKFSPALQPATLIQRYKRFLADVITPAGETLTLHCPNTGAMTGCATPGDTVWYSTSENTKRKYPHTWEMTETQSGAFICVNTLRANQLVKEALTNGMLPELVGYGTQKSEVKYGDEGSRIDFMLQAEDRPECYIEVKSVTLAEQVNGFFPDAVTLRGQKHLRELMSVAAAGKRAVLLFAVLHSAIERFSPARHIDPKYAQLLNEAQKQGVEIFAYKAELSADNMTLRSSLPIVL

SEQ ID NO: 9614 - protein, 162 aa, Enterobacter cloacae
RHGMTLAYIAIGSNLASPLEQVNAAVQALGEIPQSRIVALSSFYRTPPLGPQDQPDYLNAAVVLETTLDAETLLDNTQRIELQQGRVRKAERWGPRTLDLDIMLFGHEVINTERLTVPHYDMKNRGFMLWPLFEVAPDLTFPDGASLQAVLQNLNADKPARW

SEQ ID NO: 9615 - protein, 276 aa, Enterobacter cloacae
NAQRFAFGPSGNSMKPTTISLLQKCKQEKKRFATITAYDYSFAKLFAEEGINVMLVGDSLGMTVQGHDSTLPVTVEDIAYHTRAVRRGAPACLLLSDLPFMAYATPEQAFENAATVMRAGANMVKIEGGAWLVDTVKMLTERAVPVCGHLGLTPQSVNIFGGYKVQGRGDAAQTLFDDAVALEAAGAQLLVLECVPVELAKRITEALSIPVIGIGAGNVTDGQILVMHDAFGITGGHIPKFAKNFLTEAGDMRAAVRQYIAEVESGVYPGEEHSFH

SEQ ID NO: 9616 - protein, 130 aa, Enterobacter cloacae
KVNVMIRKMLQGKLHRVKVTQADLHYEGSCAIDQDFLDAAGILENEAIDIWNVNNGKRFSTYAIAAERGSKIISVNGAAAHCADVGDIVIIASFVMMSDEEARRWQPKVAYFEGDNEMKRTAKAIPVQVA

SEQ ID NO: 9617 - protein, 279 aa, Enterobacter cloacae
STSNFKSIDKMLILSPDVRQGTIDIIPTGSGKMLNTSFYKGFKAACFTVAAVASFQASADIVISGTRIVYQQSQKDVIVSLDNRGKKPLLVQSWLDDGRDDTNPQELKLPFIITPPVSRIDPQKGQSVRISYLGGSLPQDRESLFWFNVLEIPPKSKVKDGENPNQLQLAFRTRIKLFFRPDGLKGTPGNAAARVTWSQQKQGNTLNLIAHNDSPYNVSISNVKLKSANKEYQVEHKSILPFSTQIMQVKGLGSTATGTVAYETINDNGGSDTFESKVN

SEQ ID NO: 9618 - protein, 865 aa, Enterobacter cloacae
SMLFQRSILCLAICAAFPLHASETEKKAVDTSSETESAIEFNDQFLIDNGGGINVDRYAYGNPVLPGTYRVKVNLNGNSKSTVEMAFIDNKTPRASACLTKLTLTQAGVDTSILGDDVKDDETSCVDIKKYYPGASENFDSSKQEMDLNFPQIYVLKLPAGYVDPSLWDNGVPAGLLSYDLNTWHSESNGTNSDTAYAGLHYGLNVGPWRLRSRGSLNWDSDNGTHYSSQDIYLQRDITPLNAQMVMGDSYTRGDVFDSVSLRGARMYNDDRMLPQGTSGYAPVIRGVANSNAKVSVMQSGNKIYETTVPPGAFEINDLSTTGYGNDLIVTVEEADGSKRTFTVPFSSVTQMLRPGSSRWDVGIGELNDDSLHDKPNVGYATYAYGLNNTFTGYVGAQYTDMDFYAGLLGLAMNTRIGAFALDVTGSYADIDGLDTLKGQSYRLTYSKMLEATNTSLNVAAYRFSTEDYLSLNDAASLQDSIHHEEYGNRSYDSNAELYADYQRTKNQIQVSLNQPLNVNGDEYGSLYISGTWQDYWNDSSSTSDYSVGYNNSFAYGSYSVSVQRTYNETGEKDDSVYLNVSIPFSIFNKDNAQSGGFNNVNMSLRTDLKGGTSFNSTASGNSKNSEVSYSVSASSSGGNYGNLNQVSGYSSWNSPYGPLGVSASFGDDNSKQYSASYNGGMVVHSGGVVFTSGSIGETDSLALVKASGATGARLGYGQSRINSSGYGIMPYMSAYRENRVSLDISTLEADVEIKNTSAVAVPRNGSVVFVNFETDEGRSLVLELQRSDNGFIPLGADVLNEKNESIGTVGQAGQAYVRGVENKGALRVVWGSDGSSSCTVHYQIPENAKKAGLTTILSNQQCQM

SEQ ID NO: 9619 - protein, 216 aa, Enterobacter cloacae
CASHVYYHLSIIPGTSMQQSPFTLYQPGLVLLMGLAGGILPGVGQASSGLDVNITANIVNSTCKMTVENDGEIYLPNVMRSWFYNPDGSDRFTATDDAGGTPFKIHVDDCYGDSSTAKKLSFSFSPQSGFWPGQNQVFKSDDTAAGAAKNVGVVVFSERYKKNVLNNDGTSKITYDVSGQDTAFLTDYQFYARYQNIGVVAGGVVTSKVLVDVTYE

SEQ ID NO: 9620 - protein, 298 aa, Enterobacter cloacae
WMLTKEVLPMTEKTVWQETLHDQFGQYFAVDNVLYHEKTDHQDLIIFENAAFGRVMALDGVVQTTERDEFIYHEMMTHVPLLAHGHAKDVLIIGGGDGAMLREVSRHQNVETISMVEIDAGVVSFCRQYLPNHNAGSYDDPRFNLVIDDGVNFVNQTTQTFDVIISDCTDPIGPGASLFTSSFYEGCKRCLKPGGIFVAQNGVCFLQQDEALDSHRKLSTYFADVSFYQAAIPTYYGGIMTFAWATDNDVLRHLSTEIIQARFHQAGLQCRYYNPAIHTAAFALPQYLQDALSSKEVN

SEQ ID NO: 9621 - protein, 264 aa, Enterobacter cloacae
LKKLKLHGFNNLTKSLSFCIYDICYAKTAEERDGYIAYIDELYNANRLTEILTETCSIIGANILNIARQDYEPQGASVTILVSEEPVDPQLIDKTEHPGPLPEVVVAHLDKSHICVHTYPESHPEGGLCTFRADIEVSTCGVISPLNALNYLIHQLESDIVTIDYRVRGFTRDINGMKHFIDHEINSIQNFMSEDMKSLYDMMDVNVYQENIFHTKMLLKEFDLKHYMFHTKPEDLSEEERKVITDLLWKEMREIYYGRNIPTV

SEQ ID NO: 9622 - protein, 463 aa, Enterobacter cloacae
QPHTRFQMEAQQHGDQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWASAAAFFVLINAINLTNVKVFGEMEFWFAIIKVIAVVAMIIFGGWLLFSGNGGPQATVRNLWEQGGFLPHGMTGLVMMMAIIMFSFGGLELVGITAAEADNPEQSIPKATNQVIYRILIFYVGSLAVLLSLLPWTRVTADTSPFVLIFHELGDTFVANALNVVVLTAALSVYNSCVYCNSRMLFGLAQQGNAPKALLTVDKRGVPVNTIIVSAVVTALCVLINYLAPESAFGLLMALVVSALVINWAMISLAHIKFRRAKQQQGVTTRFPALLYPLGNWVCLLFMAAVLVIMLITPGMAISVYLIPVWIAILGVGYMVKQKNAKTVKAH

SEQ ID NO: 9623 - protein, 332 aa, Enterobacter cloacae
TIIRNSKPLRLNKESRMQTWPNPFIEQRADPYILRHDGQYYFIASVPEYDRLAIRRADSLEGLRDAEEVVVWRKPDTGPMSQLIWAPELHHIDGSWYIYFAATHTQALDHLGMFQHRMFAIECADRDPLTGTWVEKGQIKTPFDTFALDATTFVHQGKRWYLWAQKAPDISGNSNLYLCEMENPWTLKGEPVMLSKPEYDWECRGFWVNEGPAVLFHGDKLFISYSASATDENYCMGLMWADLNADPQNPANWHKSPRPVFVTSYENRQYGPGHNSFTQTPEGEDVLVYHARNYTEIEGDPLYDPNRHTRLKLIRWNENGMPEFGIPPADTP

SEQ ID NO: 9624 - protein, 70 aa, Enterobacter cloacae
NSMNFSPFSSTTVPPLSSWPASMPPSITKSAPPPKAFATSPGMVQPPSLMIWPPRPCAASAHSITADSCG

SEQ ID NO: 9625 - protein, 307 aa, Enterobacter cloacae
GGSLSRLVTVDMSESHYIGRFAPSPSGELHFGSLIAALGSYLQARARQGQWLVRIEDIDPPREVPGAAETILRQLEHYGLHWDGDVLWQSQRHDAYRERLAWLAEQGLSYNCTCTRARIQSVGGVYDGHCRTRHNGPENAAVRLIQRSPVTQFTDVVSGTIQADERLAREDFIIHRRDGLFAYNLAVVVDDHFQGVTEIVRGADLVEPTVRQISLYQQFGWTVPDYIHLPLAVNDQGNKLSKQNHAPALPDGDPRPVLIDALRFLNQNVTQEWQDLSLDELLKTAIADWALIAVPKIQHSQMRCAEL

SEQ ID NO: 9626 - protein, 479 aa, Enterobacter cloacae
LAAFLITKHTTRCTIFTRVANFCRKVLSREESMANDAIAQPHMSVIPREQHNISRKDISENALKVLYRLNKAGYEAYLVGGGVRDLLLGKKPKDFDVTTSATPEQVRKLFRNCRLVGRRFRLAHVMFGPEIIEVATFRGHHEAGVNDRTTSQRGQNGMLLRDNIFGSIEEDAQRRDFTINSLYYSVADFTVRDYVGGMQDLKDGLIRLIGTPETRYREDPVRMLRAVRFAAKLNMRISPETAEPIPRLATLINDVPPARLFEESLKLLQAGYGFETYNLLREYNLFQPLFPTITRYFTENGDSAMERMIAQVLKNTDTRIHNDMRVNPAFLFAAMFWYPLLETAQRITQESGLAYYDAFALAANDVLDEGCRTLAIPKRITTLVRDIWQLQLRMSRRQGKRAWKLMEHPKFRAAFDLLSLRAEVERNQELQRLAQWWGEFQVSAPPEQKDMLTDLDDEPAPRRRHRRPRKRAPRREGTA

SEQ ID NO: 9627 - protein, 201 aa, Enterobacter cloacae
IYLRVISAGKRSNIMKFNSTFIALSVSALLFSGMASAAITGTPSVELTIKSKIVSGTCTAKVLNDAGTASTEIAFGDVYKSDLVNKTRVEPLKISFTNCSGVTRATVSAAKGAGGECSGVNKTGDSYSGGLATGFEIWSGVVDTGELMSCNTPPAAKDVTITDGTGEFPMNSRIVIGQGQTIAEVGAGAVNAPVTFTITYP

SEQ ID NO: 9628 - protein, 255 aa, Enterobacter cloacae
IQLTLSSDTRCVVSLKVGLPYSSATQSLGYRSLTSMNDIDTLISNNALWSKMLVEEDPGFFGKLAQAQNPRFLWIGCSDSRVPAERLTGLEPGELFVHRNVANLVIHTDLNCLSVVQYAVDVLEVEHIIICGHYGCGGVQAAVENTELGLIDNWLLHIRDIWFKHSSLLGEMPQERRLDTLCELNVMEQVYNLGHSTIMQSAWKRGQKVSIHGWAYGIHDGLLRNLEVTATNRETLEQRYRSGIANLKLKHVNHK

SEQ ID NO: 9629 - protein, 807 aa, Enterobacter cloacae
  UNSURE (535)
QIINKTDEYFSMAETKTKQPRLLVTLTAAFAAFCALYLLIGGVWLVAIGGSWYYPIAGLVMVGVTVLLLRRKQSALWLYAALLLATMIWGVWEVGFDFWALTPRSDILVFFGIWLILPFVWRRLIVPSSGAVAGLVVALLISGGILTWAGFNDPQEINGTLNAESTPAAAISQVADGDWPAYGRNQEGQRYSPLKQINADNVKNLKEAWVFRTGDLKMPNDPGELTNEVTPIKVGNMLYLCTAHQRLFALDAATGKEKWHFDPQLNSNPSFQHITCRGVSYHEARADNASPEVIADCPRRIMLPVNDGRLFAINAETGKLCETFANKGILNLQTNMPDTTPGLYEPTSPPIITDKTIVIAGSVTDNFSTRETSGVIRGFDVNTGKLLWAFDPGAKDPNAIPSDEHTFTFNSPNSWAPAAYDAKLDLVYLPMGVTTPDIWGGNRTPEQERYASSIVALNATTGKLAWSYQTVHHDLWDMDMPSQPTLADITVNGKTVPVIYAPAKTGNIFVLDRSNGKLVVPAPEKPVPQGAAKGXYVTKTQPFSDLSFRPKKDLSGADMWGATMFDQLVCRVMFHQLRYEGIFTPPSEQGTLVFPGNLGMFEWGGISVDPNRQVAIANPMALPFVSRLIPRGPGNPMEQPKDAKGSGTEAGIQPQYGVPYGVTLNPFLSPFGLPCKQPAWGYISGLDLKTNKIVWKKRIGTPQDSMPFPMPVPVPFNMGMPMLGGPISTAGNVLFIAATADNYLRAYNMTNGEKLWQGRLPAGGQATPMTYEVNGKQYVVISAGGHGSFGTKMGDYIVAYALPDDAK

SEQ ID NO: 9630 - protein, 211 aa, Enterobacter cloacae
MRLRASGASNSGMGKAGLSAAKTARLQRGIALATPSAAENFKKSRRCMCISLFPAGDLLSINPPLTGRSSTAAIIKIVGLASSMLTLIFRDAVVKAMKTFFRTILFASLMAMCANSYALSENEAEDMADLTAVFVFLKNDCGYQNLPNGQIRRALVFFAQQNQWDLSNYDSFDMKALGEDSYRDLSGIGIPTAKKCKALARDSLSLLAYVK

SEQ ID NO: 9631 - protein, 517 aa, Enterobacter cloacae
YSRQQQRLTALHSSRWSQSMKLPFKPHLLVLLCSAGLFAASGVMFVKSRATEPAPAPAPVAPQLPDPAAQPAPVATPAYTAAQIDQWTAPIALYPDALLSQILMASTYPASVIQAAQWSKDNPKMQGDAAIQAVSGQPWNASVKSLVAFPQLMSLMGENPSWVQSLGDAFLAQPKDVMDSVQRLRLLAQQTGTLQSTPQQTVTTVKKSAPASASTAATSTSASPTVIKIEPADPQVVYVPTYNPSTVYGTWPNASYPPVYLPPSPGQQFTNSFVRGFGYSLGVATTYALFSNIDWDDDDDHHHDHDDDHHGGYSHNGDNININVNNFNKITGEHRTDNHQVWQHNPAYRNGVPYANSQLASRYHQTSVPGGLSATRQQPVNRDSQRQAAMAQVQQSTGKTLTQLQHGDAHFPQHSASAQQLKQLSQRSNYRGYDSARPHAQQMNNTLAQTRRPTQVQHQPLRANALSGNDSRSASWQAQHQRGLQSRQHASLNSEQRASFRQQLSEHHTEHHEFHRR

SEQ ID NO: 9632 - protein, 148 aa, Enterobacter cloacae
GADMNRQQGFTLIELMVVIGIIAILSAIGVPAYQNYLRKAALTDMLQTFIPYRTAIELCALDRGGVDRCDAGTNGIPSPTTTRYVSAMSVAKGIVSLTGQESLNGLEVLMTPIWSDGNGMTGWTRDCKIASDTALRQACEDVFRFDNN

SEQ ID NO: 9633 - protein, 463 aa, Enterobacter cloacae
QEWTMNTEQLMTLCQRHHALLLASDTEMISIAVVGNPASELMEALRFATQKRIDIECWTAERMEKRLQSLSSSHLPGIVPNSAADVLSTTLQQAVNQRASDIHIEPTEHGYQIRLRIDGVLYPQPPISAALGTTLAARLKVLGQLDIAERRLPQDGQFTVELASVPVSFRIATLPCSGGEKIVLRLLHQVQQALELEQLGMSADQQARFAEALNSPQGLILVTGPTGSGKTVTLYSALQARNTPDVNICSVEDPVEIPLAGLNQTQINPRAGLTFQSVLRALLRQDPDIIMVGEIRDGETAEIAIKAAQTGHLVLSTLHTNSTTETLVRLQQMGVARWMISSALSMVIAQRLVRRLCPYCRQEASRHTELPRTLWPRPLPRWQPTGCDRCYHGFYGRVAIFEVLVIDDTLRQAIASGASTEVIGSSARQAGMTSLFEHGCMAVEQGLTTLEELLRVLGMPDGC

SEQ ID NO: 9634 - protein, 278 aa, Enterobacter cloacae
RRTRCHCIGCCSSARAVSDLRRAGRCTGKTIMSTHILFEHPLNEKMRTWLRIEFLIQQLSQHLPVNDHATALHFFRNVGDLLDVIERGDVRTELLKELERQQRKLQAWAEVPGVDQSRIDALRQQLKNSSTTLMAAPRVGQFLREDRLIALVRQRLSIPGGCCSFDLPTLHMWLHMPQEQRDRQVNSWLGSLEPMNQTLSLILDLVRNSAPFRKQTSLNGFYQDNGDDADLLRLNLSLSEQLYPQISGHKSRFAIRFMPLDSEHGTVPERLDFELACC

SEQ ID NO: 9635 - protein, 67 aa, Enterobacter cloacae
GVPMSDVTTVNCPTCGKTVVWGEVSPFRPFCCKRCQLIDLGEWAAEEKRIPSEGDLSDSDDWSENQQ

SEQ ID NO: 9636 - protein, 912 aa, Enterobacter cloacae
MRGSFQPRVRLLLIKLLTRVFGSRNDRTLRRMRKAVNVINGMEPAMEKLSDDELKAKTAEFRARLEKGETLESLIPEAFAVVREASKRVFGMRHFDVQLLGGMVLNERCIAEMRTGEGKTLTATLPAYLNALTGKGVHVVTVNDYLAQRDAENNRPLFEFLGMTVGINMSGLPAPAKREAYNADITYGTNNEYGFDYLRDNMAFSPEERVQRKLHYALVDEVDSILIDEARTPLIISGPAEDSSEMYRKVDKIIPHLLRQEKEDSDTFQGEGHFSVDEKARQVNLTERGLVKIEELLVAEGIMEEGESLYSPSNIMLMHHVTAALRAHALFTRDVDYIVKDGEVIIVDEHTGRTMQGRRWSDGLHQAVEAKEGVDIQNENQTLASITFQNYFRLYEKLAGMTGTADTEAFEFSSIYKLDTVVVPTNRPMIRKDMPDLVYMTEAEKIQAIIEDIRERTAKGQPVLVGTISIEKSEVVSNELTKAGIKHNVLNAKFHAKEADIVAQAGYPAAVTIATNMAGRGTDIMLGGSWQAEVAELENPTPEQIAQIKADWQVRHDAVLPSGGLHIIGTERHESRRIDNQLRGRAGRQGDAGSSRFYLSMEDALMRIFASDRVSGMMRKLGMKPGEAIEHPWVTKAIANAQRKVESRNFDIRKQLLEYDDVANDQRRAIYTQRNELLDVSDVSETINSIREDVFKATIDAHIPPQSLEEMWDIEGLQERLKNDFDLELPIKEWLDKEPELHEETLRERIYETALDVYKRKEEVVGAEMMRHFEKGVMLQTLDSLWKEHLAAMDYLRQGIHLRGYAQKDPKQEYKRESFSMFAAMLESLKYEVISTLSKVQVRMPEEVEAMEQQRREEAERLAQMQQLSHQTDESEAAAAIAAQTGDRKVGRNDPCPCGSGKKYKACHGRLS

SEQ ID NO: 9637 - protein, 149 aa, Enterobacter cloacae
EHNKLKRRRYLRLFYGSDMMKTLQIAVGIIRNPQNQIFITQRAADAHMANKWEFPGGKIESGETPEQALVRELQEEVGITPLGATLFDKLEYQFPDRHITLWFWLVESWEGEPWGKEGQPGGWVTLHASDAEKFPPANAPVISRLTGNL

SEQ ID NO: 9638 - protein, 365 aa, Enterobacter cloacae
RHWSCAFNIFASNPRNPHMRIEEDLKLGFKDVLIRPKRSTLKSRSDVELERQFTFKHSGQTWSGVPIIAANMDTVGTFEMATALAQFDILTAVHKHYSAEEWDAFVASASAEVVKHVMVSTGTSDADFEKTKQILNANPALNFVCIDVANGYSEHFVQFVSKAREAWPTKTIIAGNVVTGEMCEELILSGADIVKVGIGPGSVCTTRVKTGVGYPQLSAVIECADAAHGLGGQIISDGGCTMPGDVAKAFGGGADFVMLGGMLAGHEESGGTVVEENGEKFMLFYGMSSESAMTRHVGGVAKYRAAEGKTVKLPLRGPVENTARDILGGLRSACTYVGASRLKELTKRTTFIRVQEQENRVFNSL

SEQ ID NO: 9639 - protein, 192 aa, Enterobacter cloacae
IRSSSMLLENGWLVDARHVPSPHHDCRPEDEKPTLLVVHNISLPPGEFGGPWIDALFTGTIDPDAHPFFAEIAHLRVSAHCLIRRDGEVVQYVPFDKRAWHAGVSKYQGRERCNDFSIGIELEGTDTTPYTDAQYEKLVAVTQTLIGRYPAIADNITGHSDIAPERKTDPGPAFDWSRFHAMLTTSSDKEIT

SEQ ID NO: 9640 - protein, 880 aa, Enterobacter cloacae
RERPPHMTMRARRTVVLEEYRKHVAERAAEGIVPKPLDATQMAALVELLKNPPEGEEEFLLDLLINRVPPGVDEAAYVKAGFLAAVAKGEATSPLVTPEKAIELLGTMQGGYNIHPLIDALDNDKLAPIAAKALSSTLLMFDNFYDVEEKAKAGNVYAKQVMQSWADAEWFLNRPQLAEKITVTVFKVTGETNTDDLSPAPDAWSRPDIPLHALAMLKNAREGIEPDQPGSVGPIKQIEALQQKGFPLAYVGDVVGTGSSRKSATNSVLWFMGDDIPHVPNKRGGGLCLGGKIAPIFFNTMEDAGALPIEVDVSNLNMGDVIDVYPYKGEVRNHETNELLASFELKTDVLIDEVRAGGRIPLIIGRGLTTKAREALGLPHSDVFRQAKDVAESNRGFSLAQKMVGRACGVAGIRPGAYCEPKMTSVGSQDTTGPMTRDELKDLACLGFSSDLVMQSFCHTAAYPKPVDVTTHHTLPDFIMNRGGVSLRPGDGVIHSWLNRMLLPDTVGTGGDSHTRFPIGISFPAGSGLVAFAAATGVMPLDMPESVLVRFKGKMQPGITLRDLVHAIPLYAIKQGLLTVEKKGKKNIFSGRILEIEGLPDLKVEQAFELTDASAERSAAGCTIKLNKEPIIEYLNSNIVLLKWMIAEGYGDRRTLERRIQGMEKWLADPQLLEADADAEYAAVIDIDLADIKEPILCAPNDPDDARPLSEVQGEKIDEVFIGSCMTNIGHFRAAGKLLDTHKGQLPTRLWVAPPTRMDAAQLTEEGYYSVFGKSGARIEIPGCSLCMGNQARVADGATVVSTSTRNFPNRLGTGANVFLASAELAAVAALIGKLPTPEEYQTFVAQVDKTAVDTYRYLNFDQLSQYTEKADGVIFQTAV

SEQ ID NO: 9641 - protein, 184 aa, Enterobacter cloacae
NHLVSNMKHTVEVMIPEAEIKARIAELGRQITEHYKDSGSEMVLVGLLRGSFMFMADLCREVQVPHEVDFMTASSYGSGMSTTRDVKILKDLDEDIRGKDVLIVEDIIDSGNTLSKVREILSLREPKSLAICTLLDKPERREVQVPVEFVGFSIPDEFVVGYGIDYAQRYRHLPYVGKVVILDE

SEQ ID NO: 9642 - protein, 311 aa, Enterobacter cloacae
VEFMAIALELEQLKKTYPGGVQALRGIDLKVEAGDFYALLGPNGAGKSTTIGIISSLVNKTSGRVSVFGYDLQKDVVNAKRQLGLVPQEFNFNPFETVQQIVVNQAGYYGVERKEALERSEKYLKQLDLWEKRNERARMLSGGMKRRLMIARALMHEPKLLILDEPTAGVDIELRRSMWGFLKDLNDKGTTIILTTHYLEEAEMLCRNIGIIQHGELVENTSMKNLLSKLKSETFILDLAAKSALPKLEGYNYRLVDTSTLEVEVLREQGINSVFSQLSAQGIQVLSMRNKANRLEELFVSLVHDKQGDKA

SEQ ID NO: 9643 - protein, 155 aa, Enterobacter cloacae
TTRLLRRDVMLGWVITCHDEEAQEMLLKLEARFGPLAQCRAVNYWRGLSTNMLSRMMCDALHETDTGDGVIFLTDKSGAAPYRSAALMSHKHDNCEVISGISLPLLEAMYPLRATLSSAEFRHAIVAQGSPGVSSLWHQQQKNPPFVLLHDLYKH

SEQ ID NO: 9644 - protein, 436 aa, Enterobacter cloacae
TLVLMSLLLQWRLIFRIDLYPMLMRVIFILLVLVSGGASASLTSQQGLPAQYMQTTEDAAIWAQVGNAVVNVGNVRAGQILAVFPAAADYYEFRFGFGTGFIDKDHLEKVQGKQRVEDSLGDLNKPLSNQNLITWKDTPVYNAPSSGSAPFGTLSANLRYPILNKLKDRLNQTWFQIRIGNRLAWISSLDAQEDNGLPVLTYHHILRDEENTRFRHTSTTTSVRAFNNQMAWLRDQGYTTLTMYQLEGYVRNKMNLPAKAVVITFDDGLKSVSRYAYPVLKEYGFNATAFIISSRIKGHPQKWDPKSLQFMSVQEIKGIQDVFDIQSHTHFLHRVDGYKHPILLSRSYHVILFDFERSRRALAQFNPRVLYVSYPFGGYDNKAIKAANDAGFHLAVTTMKGKVKPGDNPFLLKRLYILRTDSLETMSRLISNQPQG

SEQ ID NO: 9645 - protein, 172 aa, Enterobacter cloacae
QGGRDSRLSRVVRGQALASHLFFADFCQRFTVDAQIGCWTRFQATNTDFNTAGFAVAKIFVLDLLQRFFDLFDQFALAVTVTQFEAELFFLSGTVDRVREVSSFVLHMCNGAIDFIPELITPCFKNTLEVRQLGFVHILFARLLLIRLHPSDGENTQGRCFTVLPFLHVASP

SEQ ID NO: 9646 - protein, 642 aa, Enterobacter cloacae
PASGVRGKRIMAIEINVPDIGADEVEITEILVKVGDKVEAEQSLITVEGDKASMEVPSPQAGIVKEIKVSVGDKTETGKLIMIFDSADGAAAAAPAQEEKKEAAPAAAPAAAAAAKEVNVPDIGGDEVEVTEILVKVGDTVAAEQSLITVEGDKASMEVPAPFAGTVKEIKINTGDKVSTGSLIMIFEVAGSEGAAAPAKAEAAPAPAAAPAAAGGVKDVNVPDIGGDEVEVTEVMVKVGDKVAAEQSLITVEGDKASMEVPAPFAGTVKEIKISTGDKVSTGSLIMVFEVEGAAPAAAPAAAAAPAPAAAPAQAAKPAAAPAAKAEKSEFAENDAYVHATPLIRRLAREFGVNLAKVKGTGRKGRILREDVQAYVKDAVKRAEAAPAAAAGGGIPGMLPWPKVDFSKFGEIEEVELGRIQKISGANLSRNWVMIPHVTHFDKTDITDLEAFRKQQNAEAEKRKLDVKFTPVVFIMKAVAAALEQMPRFNSSLSEDGQKLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 9647 - protein, 160 aa, Enterobacter cloacae
GHQAAGSCSHLFIFIPPTSPAFFLPRCCDNYLNGFAEENAMDYEFLRDITGVVKVRMSMGHEAVGHWFNEEVKENLALLDEVEQAAETVKGSERSWQRAGHEYTLWMDGEEVMVRANQLELSGDEMEEGMSYYDEESLSLCGVEDFLSVVNAYRDFMKQK

SEQ ID NO: 9648 - protein, 809 aa, Enterobacter cloacae
VSSLPVAVVLPELLAALEHAPQVLLSAPTGAGKSTWLPLQILRDGNISGKIILLEPRRLAARNVAQRLAELLNEKPGETVGYRMRAETCVGPSTRLEVVTEGILTRMLQNDPELTGVGLVILDEFHERSLQADLALALLLDVQQGLRDDLRLLIMSATLDNERLRQTLPDAPMISSEGRAFPVERRYQPLPAHQRFDEAVAIATAELLRQEPGSLLLFLPGVGEIQRVQEQLASRVDSDVMLCPLYGALPLADQRKAILPAPAGQRKVVLATNIAETSLTIEGIRLVVDSTLERVASFDPRSGLTRLLTQRISQASMVQRAGRAGRLEPGICLHLTSAEQAERAAFQSTPEILQSDLSGLVMDMMQWGCPDPDQLTWLNPPPVVNLSAARSLLTQLGALEGERLTARGQKMAALGNDPRLAAMLVAAQGDDEIATAAKLAAILEEPPRGGGSDLGQAFSRHQGNWQQRAQQLCKRLNCRGGSPDSDKVIPLLAQAFPDRIARRRGLDGRYQLANGMGAMLDSDDALTRHEWLIAPLLLQGSHSPDARILQAVAVDIDLLTRACPQLLQQSDIVEWDDTQGTLKAFRRSQIGKLTLGTKPLAKPSEEELHQAMLNGIREKGLSVLNWTPEAEQYRIRLHCAAKWLPEQGWPAVDDETLLATLEQWLLPQMSGVHSLRALKALDVKAALQNLLDWSLRQRLDSELPGHYTVPTGSRIAIRYHEDNPPALAVRMQEMFGEATTPSIAEGRVPLVLELLSPAHRPLQITRDLGAFWAGSYREVQKEMKGRYPKHVWPDDPANTAPTRRTKKYS

SEQ ID NO: 9649 - protein, 652 aa, Enterobacter cloacae
MLRRKSMAGNDREPIGRKGKPTRPAKEKVSRRRLRDEEYDDDYEDDYEDEEPMPRKGKGKGRKPRGKRGWFWLLLKLFIVFVVLIAIYGVYLDQKIRSRIDGKVWQLPAAVYGRMVNLEPDMSISKNEMVKLLQATQYRQVTKMTRPGEFTVQAKSIEMIRRPFDFPDSKEGQVRARLTFDGDRLETIENMDNDRQFGFFRLDPRLITMLSSANGEQRLFVARNGFPDLLVDTLLATEDRHFYEHDGISLYSIGRAVLANLTAGRTVQGASTLTQQLVKNLFLSSERSYWRKANEAYMAVLMDARYSKDRILELYMNEVYLGQSGDNEIRGFPLASLYYFGRPVEELSLDQQALLVGMVKGASIYNPWRNPKLALERRNLVLRLLQQQQVIDQELYDMLSARPLGVQPRGGVISPQPAFMQMVRQELQSKLGDKVKDLSGVKIFTTFDSVAQDAAEKAAVEGIPALKKQRKLSDLETAMVVVDRNTGEVRAMVGGAEPQYAGYNRAMQARRSIGSLAKPATYLTALSQPNLYRLNTWIADAPISLRQPNGQVWSPQNDDRQFSGQVMLVDALTRSMNVPTVNLGMALGLPAITDTWQKLGVPKDQLHPVPAMILGALNLTPIEVAQAFQTIASGGNRARVQPRVLARSPRSS

SEQ ID NO: 9650 - protein, 173 aa, Enterobacter cloacae
QRSQPVGCQRGSGRGHSVRGNSVWRLASCRQYGHKRRTSRWAITIESAEEIIQRATPICCSRTSVSVVELVWRVDSTRCPVCAALMAISAVSPSRISPTIMMSGSCLSRARSTLWKVSPARGLICVWFKPASGISTGSSTLQILTSGVFRACNALYSVTVFPLPVGPVTRINP

SEQ ID NO: 9651 - protein, 287 aa, Enterobacter cloacae
GDNMTLFTMLLVMIAERLFKLGEHWHLDHRLEVLFRRIRHFSMLRTLLMAAGVMAITFLLLRSLYGLFFNVPLLVVWILLGVLCIGAGKVRLHYHAYLKAASRDDAHARGAMASELTMIHGVPPDCDEREFLRELQNALLWINFRYYLAPLFWFVVGGPWGPVLLMGYAFLRAWQTWLARYLTPHERLQSGIDAILHVLDWLPVRLVGVVYALIGHGEKALPAWFVSLADRHTSQYQVLTRLAQFSLAREPHTDKVATPKAAVSMAKKTSFVVVVIVALLTIYGTLV

SEQ ID NO: 9652 - protein, 264 aa, Enterobacter cloacae
LRAKRRKTGNMAYSKIRQPKLSDVIEQQLEFLILEGTLRPGEKLPPERELAKQFDVSRPSLREAIQRLEAKGLLLRRQGGGTFVQNSLWQSFSDPLVELLSDHPESQFDLLETRHALEGIAAYYAALRSTDEDRVRIRELHQAIERAQQSGDLDAESSAVVQYQIAVTEAAHNVVLLHLLRCMEPMLAQNVRQNFELLYARREMLPLVSNHRTRVFEAIMAGEPEQAREASHRHLAFIEEILLDRSREQSRRERSLRRIQQRKD

SEQ ID NO: 9653 - protein, 892 aa, Enterobacter cloacae
IRNTPMSERLQNDVDPIETRDWLQAIESVIREEGVERAQYLIDQLLSEARKGGVKVASGAGASNYVNTIAVEDEPEYPGNLDLERRIRSAIRWNAIMTVLRASKKDLELGGHMASFQSSATIYEVCFNHFFRAANEKDGGDLVYFQGHISPGIYARAFLEGRLTEEQMNNFRQEVHGKGLSSYPHPKLMPEFWQFPTVSMGLGPIGAIYQAKFLKYLEHRGLKDTSEQTVYAFLGDGEMDEPESKGAITIATREKLDNLCFIINCNLQRLDGPVTGNGKIINELEGIFAGAGWNVIKVMWGGRWDELLRKDTSGKLIQLMNETVDGDYQTFKSKDGAYVREHFFGKYPETAALVADWTDEQIWALNRGGHDPKKVYAALKKARETKGKATVILAHTIKGYGMGDTAEGKNIAHQVKKMNMDGVRYIRDRFNVPVTDEQVEKLSYITFPEGSEEHKYLHERRQALKGYLPARQPNFTEKLELPALEDFSQLLEEQNKEISTTIAFVRALNVMLKNKSIKDRLVPIIADEARTFGMEGLFRQIGIYSPNGQQYTPQDREQVAYYKEDEKGQILQEGINELGAGASWLAAATSYSTNNLPMIPFYIYYSMFGFQRIGDLCWQAGDQQARGFLIGGTSGRTTLNGEGLQHEDGHSHIQSLTIPNCISYDPSYAYEVAVIMHDGLQRMYGEAQENIYYYITTLNENYHMPAMPAGAEEGIRKGIYKLETIEGSKGKVQLLGSGSILRHVREAAQILAKDYGVGSDVYSVTSFTELARDGQDCERWNMLHPMETPRVPYIAQVMNDAPAVASTDYMKLFAEQVRTYVPADDYRVLGTDGFGRSDSRENLRHHFEVDASYVVVAALGELAKRGEIDKKVVADAITKFNIDADKVNPRLA

SEQ ID NO: 9654 - protein, 477 aa, Enterobacter cloacae
EVMMSTEIKTQVVVLGAGPAGYSAAFRAADLGLETVIVERYSTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIELPFIPHEDPRVWDSTDALELKTVPKRLLVMGGGIIGLEMGTVYHALGSEIDVVEMFDQVIPAADKDIVKVFTKRISKKFNLMLETKVTAVEAKEDGIYVSMEGKKAPSEPQRYDAVLVAIGRVPNGKNLDAGKAGVEVDDRGFIRVDKQLRTNVPHIFAIGDIVGQPMLAHKGVHEGHVAAEVIAGMKHYFDPKVIPSIAYTEPEVAWVGLTEKEAKEKGISYETATFPWAASGRAIASDCADGMTKLIFDKETHRVIGGAIVGTNGGELLGEIGLAIEMGCDAEDIALTIHAHPTLHESVGLAAEVFEGSITDLPNAKAKKK

SEQ ID NO: 9655 - protein, 148 aa, Enterobacter cloacae
NHAAGGHFNIRAEGTQPAFRVAFRVGVHADVAFIQVSNHHFRQRAGVFGFVDKLWVNRLFTHQNGDARTLRLIILARDIEDVRADNRAGLCQDLGQTVGVVEFIDIGDVTIALFCCFGVADIVNTKTQAFGQIVKAMQFKLFQLVHLL

SEQ ID NO: 9656 - protein, 587 aa, Enterobacter cloacae
LFAHIAIRLANKIVLKNVFIAFTTASRKINVSILDARPTIFIIAAVLDLPVRGGFMLKRSPAGNKEMHMQRRDFLKFSAALGVASAIPLWSRAVFAADRPALPIPELLAPDARSRIQLVVQAGKTTFGQHAATTWGYNGNLLGPALQLRKGKAVTVDIHNTLAEETTLHWHGLEVPGEVDGGPQGVIRPGGKRSVTFTPEQRAATCWFHPHQHGKTGHQVAMGLAGLVLIEDDESRLLRLPKQWGIDDVPVIVQDKKFSADGQIDYQLDVMSAAVGWFGDTLLTNGAIYPQHAAPKGWLRLRLLNGCNARSLNFATSDKRPLYVVASDGGLLPEPVKVSELPMLMGERFEVLVDISDGKAFDLVTLPVSQMGMAVAPFDKPHPVLRIQPLQITASGTLPETLTTLPALPSLDGLTQRKLQLSMDPMLDMMGMQALMKKYGNQAMAGMHHGQMMGHMNMDHGNMGGMNHGGHGFDFHNANRINGKAFDMNTPMFAATKGQFERWMISGEGDMMLHPFHIHGTQFRILSENGKAPEPHRAGWKDTVRVEGGVSEVLVKFDHEAPKEFAYMAHCHLLEHEDTGMMLGFTV

SEQ ID NO: 9657 - protein, 277 aa, Enterobacter cloacae
QSKPTGRAVCLSGARQTRRQGMTHLYWVALKSIWAKEINRFMRIWVQTLVPPVITMTLYFIIFGNLIGSRIGEMHGFTYMQFIVPGLIMMAVITNAYANVASSFFSAKFQRNIEELLVAPVPTHVIIAGYVGGGVARGLCVGILVTAISLFFVPFQVHSWLFVALTLLLTAILFSLAGLLNAVFAKTFDDISLIPTFVLTPLTYLGGVFYSLTLLPPFWQALSHLNPIVYMISGFRFGFLGITDVPLFTTVVVLVVFIIAFYLLCWYLIQRGRGLRS

SEQ ID NO: 9658 - protein, 78 aa, Enterobacter cloacae
DDMKQSIVKWLFELNAKQREVLARRFGLLGYEAATLEDVGREIGLTRERVRQIQVEGLRRLREILQGQGLNIEALFRE

SEQ ID NO: 9659 - protein, 200 aa, Enterobacter cloacae
MRLIVGMTGATGAPLGVALLQALREMPEVETHLVMSKWAKTTIELETPFTAHDVAALADVVHSPADQAATISSGSFRTDGMIVIPCSMKTLAGIRAGYAEGLVGRAADVVLKEGRKLVLVPRETPLSTIHLENMLALSRMGVAMVPPMPAYYNHPQTADDITQHIVTRVLDQFGLEHKKARRWEGLQAAKHFSQENKDGI

SEQ ID NO: 9660 - protein, 118 aa, Enterobacter cloacae
GGMKMAGKRIAREKETIAKMIALYEKNCPQAVKDEGHYQALNAYADKRLDKCIFGEEKPACKQCPVHCYQPARREEMKQVMRWAGPRMLWRHPILTLRHLIDDRRPVPELPEKYRPKK

SEQ ID NO: 9661 - protein, 207 aa, Enterobacter cloacae
FALRRDDVNAVEMTRRHRGGDSTSLVKSYLNQQIKNWHENCLTAANSINRIPFMTIWEISEKADYIAQRHQQLQDQWHLYCNSLIQGITLSKARLHHAMSCAAQGDMRFVLFGHFTIFVTLAESFNSHTIEYYVETKEGEKQCIAKAQLMADGMVDGHVSNRDRQQVLEHYLEKIAPVYNGLYAAVEHDQSINLKQLIDGKSSANVA

SEQ ID NO: 9662 - protein, 608 aa, Enterobacter cloacae
RGGEMNAIVMMTSGVAWFAAAAVLALLLAFHKTLSGVIAGIGGAVGSLMTLAAGGVVLIDGQSVDTLIPLIHHAVELTPLNAIWLITFGLCGLFISLFNIDWHRHQHTKANGLLVNLLMAAAVCTVVASNLGALVVMAEIMALCGVFLTGCSASGKLWFALGRLGTLLLALACWLVWQRFGTLDFAALNGQPLGNDVWLLGVVGFGLLAGIIPLHGWVPQAHANASAPAAALFSTVVMKVGLFGILTITLTGDQPPLWWGVALLIAGMITAFVGGLYALMEHNIQRLLAYHTLENIGIILLGMGAGVTGLALNQPALIAAGFIGGLYHLINHSLFKSTLFLGAGSVWFRTGHRDIEKLGGIGKKMPVISLAMLVGLMAMAALPPLNGFAGEWVIYQSFFALGQSEAFIGRLLGPLLAVGLAITGALAVMCMAKVYGVTFLGAPRTREAENACCAPVLMTTSVVALALCCIAGGVAAPWLLPLLGHAIPLPLVTAHTVVSQPMMALLLIAAPLLPFVLMLFFRRDRLASRSRGAAWACGYEHEQSMVITAHGFAMPVKENFAAVLKLRHWLNPVGWVPGWQGAAVPVLFRRLALIELAVLVVIVISRGA

SEQ ID NO: 9663 - protein, 268 aa, Enterobacter cloacae
PHRFNPPYERGQLMENLLGPRDANGIPVPLTVEESIASMKASLLKKIKRSAYVYRVDCGGCNGCEIEIFATLSPLFDAERFGIKVVPSPRHADILLFTGAVTRAMRSPALRAWQSAPDPKICISYGACGNSGGIFHDLYCVWGGTDKIVPVDVYIPGCPPTPAATLYGFAMALGLLEQKIHAREPGELDNQPATILHPDMVQPLRVKIDRTARRLAGYRYGRQIADDYLRLLSQGDHQVARWLEAEKDPRLNEIVANLNNIVDEARIR

SEQ ID NO: 9664 - protein, 154 aa, Enterobacter cloacae
GDYVTDVLLCVGNSMMGDDGAGPLLAELCAANSPGNWVVIDGGSAPENDVVAIRELHPDRLLIVDATDMGLNPGEIRLIDPDDIAEMFMMTTHNMPLNYLVDQIKGDVGEVLFLGIQPDIVGFYYPMTPPVKEAVDVVYSRLAGWVGDGGFSPL

SEQ ID NO: 9665 - protein, 371 aa, Enterobacter cloacae
  UNSURE (371)
FLVEKGTDLRWGGANRFLEELGMLYHTGFLPNSLNGCHMFKRRYAALLPALILLSACSSKPKTEAVQPTAGAPSGGFLLEPQHNMMQMGGDFANNPAAEQFIDKMVSKHGFDRQQLHAILSQAKRLDYVLRLMDRQAPTAQVPTGPNGAWLRYRKQFITPDNVQNGVVFWNQYEDALNRAWQVYGVPPEIIVGIIGVETRWGRIMGKTRILDALATLSFNYPRRAEYFSSELETFLLMARDEQDDPLDLKGSFAGAMGYGQFMPSSYKQYAVDFNGDGHINLWDPEDAIGSVANYFKAHGWTPGGQVAVQANGEAFGLENGFKTKYSVAQLAAAGLTPSQPLGNVDQVSLLRLDGLHHGARRSRAKRIKEX

SEQ ID NO: 9666 - protein, 506 aa, Enterobacter cloacae
PVFSTSLVWSIKKPDAGKVCRQRNIFHRRIKMAFDDLRSFLQALDEQGQLLKIEEEVNAEPDLAAAANATGRIGDGAPALWFDNIRGFTDARVVMNTIGSWQNHAISMGLPANTPVKKQIDEFIRRWDKFPVSPERRANPAWAQNTVDGEDINLFDILPLFRLNDGDGGFYLDKACVVSRDPLDPDHFGKQNVGIYRMEVKGKRKLGLQPVPMHDIALHLHKAEERGEDLPIAITLGNDPIITLMGATPLKYDQSEYEMAGALRESPYPIATAPLTGFDVPWGSEVILEGVIEGRKREIEGPFGEFTGHYSGGRNMTVVRIDKVSYRTKPIFESLYLGMPWTEIDYLMGPATCVPLYQQLKSEFPEVQAVNAMYTHGLLAIISTKKRYGGFARAVGLRAMTTPHGLGYVKMVIMVDEDVDPFNLPQVMWALSSKVNPAGDLVQLPNMSVLELDPGSSPAGITDKLIIDATTPVAPDNRGHYSQPVQDLPETKAWAEKLTAMLAARQ

SEQ ID NO: 9667 - protein, 164 aa, Enterobacter cloacae
RTSLMTKKATVLLFLVFFLAGALAAWLYRLHQQNSENTEACSASIVVYHEDIRANLTMDFMYTMKKQTGVIALSGAYYKNDKLAGVIRRDVSYVWTENKDSFHFTSVNIHDINGQQTAPNEIMNEILPDFFLYPKKNLNYSITQQGPRGFMFSVGKRPIFYCSR

SEQ ID NO: 9668 - protein, 209 aa, Enterobacter cloacae
PSPEDDPVNRFVIADSTVCIGCRTCEAACSETHRLHGLQSMPRLRVMRNEKESAPQLCHHCEDAPCAGVCPVNAITRVDGAVQLNESLCVSCKLCGIACPFGAIEFSGSRPLHIPANANTPKAPPAPPAPARVSTLLDWVPGIRAVAVKCDLCSFDEQGPACVRTCPTRALVLVNIRDIARTSKRKRELTINTDVGDLSLLRALNEGAK

SEQ ID NO: 9669 - protein, 315 aa, Enterobacter cloacae
LSFHEEPDMSLLLAILQALVLFAAAPLLSGITRVARARLHNRRGPGVLQEYRDLFKLLSRQSVAPDAAGWVFRLTPFVMVGVMLTIATALPVVTVASPLPVLGDLITLIYLFAIARFFFAIAGLDTGSPFTGIGASREAMLGVLVEPILLLGLWVAAQVAGSTHISFITDTVYHWPVSRSLPLVLALCACAFATFIEMGKLPFDLAEAEQELQEGPLTEYSGYGFAVLKWGISLKQLVVLQMFVGVFFPWGQMTHFSAGGLLLAVVVAVLKLLIGVLVIALFENSMARLRFVETSRITWAGFGFAFLAFVSLLVA

SEQ ID NO: 9670 - protein, 574 aa, Enterobacter cloacae
LKRVFMSEEKKGQQYLAALHQAFPGVVLEESWQTKDQITVTIKVNYLPEVVEFLYYQQGGWLSVLFGNDERQLCGSYAVYYVMSMEQGEKCWITVRVEVDPNKPEYPSVTPRVPAAVWGEREVRDMYGLVPVGLPDERRLVLPDDWPDELYPLRKDSMDYRQRPAPTTDSETYEFINELGSKKNNVVPIGPLHVTSDEPGHFRLFVDGENIIDADYRLFYVHRGMEKLAETRMGYNEVTFLSDRVCGICGFAHSTAYTTSVENGMGIVVPERAQMIRAILLEVERLHSHLLNLGLACHFVGFDSGFMQFFRVREASMKMAEILTGARKTYGLNLIGGIRRDLLKDDMIQTRQLAQQMRRDVQELVDMLLSTPNIEQRTVGIGRLDPEIARDFSNVGPMVRASGHARDTRADHPFVGYGLLPMTVHSEQGCDVISRLKVRINEVFTALNMIDYGLDNLPGGPLMVEGFTYIPNRFALGFAEAPRGDDIHWSMTGDNQKLYRWRCRAATYANWPTLRYMLRGNTVSDAPLIIGSLDPCYSCTDRMTVVDVRKKKSQVVPYKELERYSIERKNSPLK

SEQ ID NO: 9671 - protein, 183 aa, Enterobacter cloacae
GFAMFTFIKKVIKTGAQTSSYPLEPIPVDKNFRGKPEHNPQQCIGCAACVNACPSNALTVETDLKTGELAWQFNLGRCIFCGRCEEVCPTVAIRLSQEYELAVWKKEDFLQQSRFALCNCRVCKRPFAVQKEIDYAIALLKHNGDVRAEHHRESFETCPECKRQKCLLPSDRIDLTRHMREAS

SEQ ID NO: 9672 - protein, 790 aa, Enterobacter cloacae
PLLPPRRRSGVYGSLSDACAGLRRSRQARTDECRKTSPRGVRHLVITAVLNRMSSNGVQLRVRGKVQGVGFRPFVWQLAHRLKLVGDVCNDGEGVLVRLAGSGGDFTARLRQDCPPLARIDRVETQPYSWNTLPDEFVIRHSESGAMDTQIVPDAATCPACLAEMRDPRERRYRYPFINCTHCGPRFTIIRAMPYDRPATSMAPFPLCMPCETEYRNPADRRFHAQPVACPDCGPQLEWRAGEATATRESALSAAVAMLEGGGIVAVKGLGGFHLVCDALNPQAIRKLRARKQRPTRPLAVMIPHANDLPKTIQTLLRSPAAPIMLTPKACLPAFPEEIAPGLNTVGVMLPANPLQHLLMLDCQRPLVMTSGNLSGYPPVINNQQALEELSDIADGFLLHNRDILQRMDDSVMDQEGTMLRRARGFVPDAITLPAGFRDIPPMLCTGAEMKNTFCLVRGNQAVLSQHFGDLSDEGVEAQWRSALSTMQEIYAFQPERVVCDAHPGYHARQWARTQALPVETVLHHHAHAVACLAENGWPLDGGDVIALTLDGIGMGENGALWGGECLRVNYRDCERLGGLPAVALPGGDLAAKQPWRNLLAHCLAFVPDWQQYPETVVVQRQNWPLLATAVSRGINAPRASSCGRLFDAVACALGIETQRYEGEAACRLEALAERCAGVDHPVTLQTDNLALFWQQWLAWRAEPGERAWAFHDALAKGLSELAATHARRRSLSTVCFSGGVLHNRLLRARLRHYLSDFTLLFPSRLPAGDGAISFGQAVVAAARSCSQRI

SEQ ID NO: 9673 - protein, 356 aa, Enterobacter cloacae
TKGAGAFVTEAQAGHLFHQSGNFRHHHVIHGGGTHQHAFGAEDVGQYLILIAARHVEDFHRHVRVNFVDALGNGVRHHAGVVGHGVVEDRNAVFLIVRRPLQVQFDNLGWIFTPYHAVGGGNHIHRQVEAEDLGDFWRDQTAERGQDVGVVALALFEQLGLIHFVVEQTFVAVVLAEGVVTEQHRVTGHVGHHAVRPVQHWGFHEDQLFAVADIQRVAGFHSVEVPLRMVVVAVDGVNGVSGAVDRGIRNVGHQLGQRPGMILFRVVDDNVVDLIQIDFAAQVLHELAAEFVIDGIDQDVFTFTNEIAVVAAAAQRFVFRPVKITYFPVTLTHPMNVIFNQNRHSNLNLIRRFQIR

SEQ ID NO: 9674 - protein, 301 aa, Enterobacter cloacae
QLTRQAMLNLQRTAMFIAVADTGSFTAAAEAMGLTKAVVSFHIRQLEEELGVTLLLRTTRRLTLTEAGKLFHQRSVMLLRDAERLQDDVRANHAGLTGELRITTTPEYGSQVVVPLLAEFSQLHPDLRVRHVSSSLHADLIAERFDVAIRLGTLADSRYHAALMTSFTILPVATPGWLANHPVDSLEQLAEADWIIHERLTSPLRWQVRGVDGHPVSFEIKKAPRLYADSAQALMAFALAGCGVALLPEWLVRNALDAGELVSLLPAYTFAQQGIYAVYPDARHVPAKVRTFIDFMRVRVT

SEQ ID NO: 9675 - protein, 85 aa, Enterobacter cloacae
PRCWRHVNKEEKMICPRCADEHIEVMATSPVKGVWTVYQCQHCLYTWRDTEPLRRTSREHYPEAFRMTQKDIDEAPQVPTIPPLL

SEQ ID NO: 9676 - protein, 299 aa, Enterobacter cloacae
QGLTAEYNYTSPRQLTILFIVSERHMFWIINDKIKFCPERNLLISLTRPDLNVILTTPASRCLNLLLESFPEVVTQKYFFDKVWGEDGMLVPANTLYQNISIIRRGLRTTGETDDTLVATVPRKGFQIEKNVRVTRVDTDCVDDGKKATATGVETSPVETKDKPVENIPVMPGGRKKQRQLRQYIFPTALMIIAFCAGFFAFQYLLHDNPEKDFFRDYPITLTQNGCHFSSQNDDIRGVGNFRRFIKIILDTGLDCKKYPWVYFSSSSHAPALSVLACREPFEIKANAGCISLYFRGHL

SEQ ID NO: 9677 - protein, 140 aa, Enterobacter cloacae
GAYPMSETVVFSQLSRKFIDENDATPDAAQQVVYYSLAIGHHLGVIDCLEAALTCPWPEYLAWIVTLEEGSTARRKMEGVPKYGEIVIDANHIAMLANAFDAALSVQTPAQQAWSKTLLGMLHDIHQESAIYLMVRRLRD

SEQ ID NO: 9678 - protein, 350 aa, Enterobacter cloacae
STLRLIGFEWNNTMTTMLEVAKRAGVSKATVSRVLSGNGYVSQETKDRVFQAIEESGYRPNLLARNLATKRTQTLGLVVTNTLYHGVYFSELLFNAARMTEEKGRQLILADGKHSAEEEREAIQYLLDMRCDAVIIYPRFLSVEALDEIIEKCEQPIMVLNRRLRKNSSHSVWSDHKASCQDAVSQLIAKGHREIAFITGSLDSPTGVERLSGYREALAQHGIAVRDALIAEGKWSPASGAAAVSQLLTRGEAFTALVASNDDMAIGAIRQLHESGVATPGAVSVIGFDDVAIAPYIVPSLSSVRIPVTEMIQETISRLIFMLDGGEFKLQQTFSGELILRDSVIDGPHR

SEQ ID NO: 9679 - protein, 193 aa, Enterobacter cloacae
IASRITVMPEKQMNRFIMADASKCIGCRTCEVACVVSHQAEQDCASLTPDTFLPRIHVIKGVNISTAAICRQCEDAPCANVCPNGAIKREKGFVHVMQERCIGCKTCVVACPYGAMEVVVRPVVRNSGIGLSVRAEKAEANKCDLCYHRDAGPACMEACPTHALVCVDRDKLEQMSAEKRRRAAFDTSSSLLF

SEQ ID NO: 9680 - protein, 412 aa, Enterobacter cloacae
ANWRQRMPADGRSLRCASAAASFTTACCARAFVITFLISRFFFLRACPQATERSPSGRRWLLPPDHVHKGFKMLRLLRNEPRAACLLLALGMANLLAWGLAWHTFSDSTALMAASLLAWCYGLRHAVDADHIAAIDTVTRKMMQQGKRPSGVGAWFSLGHSTIVVLASIAIAATATAFQKNMAWFHETGSLIGTAVSATFLLAMALVNMVILRGVWRSFQALKHGRPVQGDITLPAQGGVMNWLFGKTFRLVNKSWQMYLVGFLFGLGFDTATEIGVLGISAASASSGMSVWSIMIFPALFASGMALVDTLDNLLMVGAYGWAFNKPQRKLYYNMTITGTSVVVALFIGGLEALGLLMDKFSLSGGVWDLIGAVNDNLGDAGFVVVGLFVACWLISMANYRWRGYDALVVRS

SEQ ID NO: 9681 - protein, 532 aa, Enterobacter cloacae
CSQMGSHFDYLKNCQYDTMHCQNDSEAEMSFSVDVLAKIAIELQTGIGHQDRFQRLISTLRHVLDCDASALLRYEGRQFIPLAIDGLAKDVLGRRFTLEGHPRLETIARAGDVVRFPADSDLPDPYDGLIPGQESLKVHACIGLPLFAGQNLIGALTLDGMSPDQFDTFSDEELRLIAALAAGALNNALLIEQLESQNILPGSPTAFEQVAHTEMIGLSPGMAQLKKEIEIVAASDLNVLIFGETGTGKELVAKAIHEASPRAVNPLVYLNCAALPESVAESELFGHVKGAFTGAISNRSGKFEMADNGTLFLDEIGELSLSLQAKLLRVLQYGDIQRVGDDRSLRVDVRVLAATNRDLREEVLAGNFRADLFHRLSVFPLTVPPLRERGEDVVLLAGFFCEQCRLKMGLSRVVLSPGARTHLLSYGWPGNVRELEHAIHRAVVLARATRSGDEVVIHARHFALHEETTPSVKPVIPESVNENLREATNAFQRQMIARALEQNNRSWAACARALEMDVANLHRLAKRLGLKG

SEQ ID NO: 9682 - protein, 282 aa, Enterobacter cloacae
GSGSAGCHPRLHVKIYFVIKERHMSQVAVVIGGGQTLGEFLCHGLAAEGYRVAVVDIQSEKAARVADAINTEFGEGMAYGFGADATSEQSVMALARGVDEIFGRIDLLVYSAGIAKAAFISDFELGDFDRSLQVNLVGYFLCAREFSRLMIRDGIQGRIIQINSKSGKVGSKHNSGYSAAKFGGVGLTQSLALDLAEYGITVHALMLGNLLKSPMFQSLLPQYAAKLGIKAEEVEQYYIDKVPLKRGCDYQDVLNMLLFYASPKASYCTGQSINVTGGQVMF

SEQ ID NO: 9683 - protein, 119 aa, Enterobacter cloacae
GGVMHEITLCQRALELIEQQAVQNHAKRVTGVWLKVGAFSCVETSALTFCFELVCRGTLAEGCALHIEEQQAECWCEQCQEYVTLLSSKVQRCPQCQSSGLRIVADDGMQIQRLEIEKE

SEQ ID NO: 9684 - protein, 288 aa, Enterobacter cloacae
SMCSTCGCAEGNLYIEGDEHRPHSAFRSAPFSPAPRPAAALTGITFAPQRSDAGDLHYGRGEAGTHAPGISQRQMLEVEINVLDKNNQLAVRNRARFAAREQLVLNLVSSPGSGKTTLLTETLKRLNKRVSCAVIEGDQQTVNDAARIRETGTPAIQVNTGKGCHLDAQMIADAAPRLPLANNGILFIENVGNLVCPASFDLGERHKVAVLSVTEGEDKPLKYPHMFAAASLMLLNKVDLLPYLNFDVDKCLAYAREVNPDIEILLVSATRGDGMDAWLNWLENERCA

SEQ ID NO: 9685 - protein, 702 aa, Enterobacter cloacae
ISLFASFYWKATMPYTPMSDLGQQGLFDITRTLLQQPDLGALSDALTRLVRQSALADSAAIVLWHSATHRASYFSTRDNGKIFEYEDETFLAHGPVRRILSRPEALHCNFDQFRQAWPKLAESNLYHPFGHYSMLPLAVEGQIFGGCEFIRDTDQPWSEAEYERLHTFTQIVAVVAEQIQSRVTNNVDYDLLSRERDNFRILVAITNAVLSRLDMDELVSEVSKEIHHYFKIDAISIALRGNRKGKLNIYSTHYLDEANPAHEQSEVDEAGTLSERVFKSKEILLLNLNEQDPVAPYERMLFNTWGNKIQTLCLLPLMSGNTMLGVLKLAQCDEAVFTTANLKLLRQIAERISIALDNALAYQEIHRLKERLVDENLALTEQLNNVDSEFGEIIWRSDAMYSVLKQVEMVAQSDSTVLILGETGTGKELIARAIHNLSNRNSRRMVKMNCAAMPAGLLESDLFGHERGAFTGASSQRLGRFELADKSSLFLDEVGDMPLELQPKLLRVLQEQEFERLGSNKLIQTDVRLIAATNRDLKKMVADREFRSDLYYRLNVFPICLPPLRERPEDIPLLVKAFTAKIARRMGRNIDSIPAETLRTLSAMEWPGNVRELENVIERAVLLTRGNVLQLSLPEVSLAETTVAATEVAKDGEDEYQLILRVLRETNGVVAGPKGAAQRLELKRTTLLSRMKRLGIDKESLN

SEQ ID NO: 9686 - protein, 109 aa, Enterobacter cloacae
RVFTVILYRQSEHTLPTVTGGSMQGMAITKPYRHLKVGYFRKRHEDRKTKIPTRYSVHAALNLKGDWLEKAGFLTHSQVRVEVGPGKIIIELIKEPDDGHPGHVVQREQ

SEQ ID NO: 9687 - protein, 329 aa, Enterobacter cloacae
TESPSFRSHSMNRIRIEKGTGGWGGPLEFDATEGKKIVYITAGTRPAIVDKLRELTGWEAVDGFKEGEPPEAEIGVAVIDCGGTLRCGIYPKRRIPTVNIHSTGKSGPLAQYIVEDIYVSGVKEDNITLVNGTSAPQKAAPREYDTSKKITEQSDGLLAKVGMGMGSAVAVLFQSGRDTIDTVLKTILPFMAFVSALIGIIMASGLGDWIAHGLAPLASHPLGLVTLALICSFPLLSPFLGPGAVIAQVIGVLIGVQIGLGNILPHLALPALFAINAQAACDFIPVGLSLAEARQETVRVGVPSVLVSRFLTGAPTVLIAWFVSGFIYQ

SEQ ID NO: 9688 - protein, 124 aa, Enterobacter cloacae
EVPAMTVIYQTTITRIGQSAADALSDQMLITFREGAPADIEEFCFIHCHGELNGELKAGSQLELGKARYAVTAVGDVAEQNLRELGHITLRFDGQPQAEYPGTVHVEGPVPQAVTPGCTLKFIS

SEQ ID NO: 9689 - protein, 123 aa, Enterobacter cloacae
QGADMVTALITVAALAWICQMAFGGWQIYQFNRAFDALCQKGRVGVGRSGGRFKPRVVVAVALDEHNRVSDSLIMRGVTVFARPTKIQAINGISLHELQPDVIFPHDSLCQNALSLALNLKHG

SEQ ID NO: 9690 - protein, 278 aa, Enterobacter cloacae
FRCESYKLAELSFRNVRNEAPMKPRQRQAAILEHLQKQGKCSVEDLAHYFDTTGTTIRKDLVLLENSGAVIRTYGGVVLNKDEADPPIDHKTLINTHQKALIAEAAVKFIHDGDSIILDAGSTVLQMIPLLSRFNNITVMTNSLHIVNALSEFDSEQTILMPGGTFRKKSASFHGQLAENAFDHFSFDKLFMGTDGIDLNAGVTTFNEVFSVSKAMCNAAREVFLMADSSKFGRKSPNIVCSLESVDKLITDAGIDPAFKKALEAKGIDVIVTGEKNE

SEQ ID NO: 9691 - protein, 383 aa, Enterobacter cloacae
TGNGGKMSHGIVIIGSGFAARQLVKNIRKQDANVPLTVIAADSMDEYNKPDLSHVISQNQRADDLTRQTAGEFAEQFNLRLFPYTWVTDIDADAHVVNAKDKTWHYDKLVLATGASAFVPPVEGRELMVTLNSQQEYQASETLLRDATRVMIVGGGLIGTELAMDFCRAGKSVTLVDHAASILSALMPAEVSSRLQHRLTDMGVHLLLKSQLQSLSKTETGICATLDRNRSVEVDVVIAATGLRPETALAHRAGAEINRGVKVDSYLQTTQPDIYALGDCAEINGQVLPFLQPIQLSAMFLAKNLLGGNAPVKLPAMLVKVKTPELPLHLAGETQRQDLDWQIALSPQGMVARGTDTAGQMRAFVVSEDRMKEAFALLKSLPA

SEQ ID NO: 9692 - protein, 113 aa, Enterobacter cloacae
HPRRRAASRSPPDTLPHAHDDAARSQRAALASGPTVGRDIPDGHRTPHALAGKRRSPASSRAHCATAPLRPRRSDRQNAGSAPPGCHVPGRRYFSSPRRCITWAGCRGIRRAM

SEQ ID NO: 9693 - protein, 337 aa, Enterobacter cloacae
SMNTVEMAHGSGGQAMQQLINRLFMDAFDNPWLAEQEDQARIALSTLTAHGDRLAFSTDSYVIDPLFFPGGDIGKLAVCGTANDVAVSGAIPRYLSCGFILEEGLPMETLTAVVNSMAHTAREAGIAIVTGDTKVVQRGAADKLFINTAGMGAIPADIHWGAQQLCAGDVLIVSGTLGCHGATILNLREGLRLDGELRSDCAVLTPLIQTLRDMPGVKALRDATRGGVNAVVHEFAASSGCGIELTERGLPVKGAVRGLCELLGLDPLNFANEGKLVIGVERTAAEAVLAQLRAHPLGKDAAIIGDVVERKGVRLTGLYGVKRTLDLPHAEPLPRIC

SEQ ID NO: 9694 - protein, 254 aa, Enterobacter cloacae
VMSICAEKITWKVGKKIIVNHVSLKVSRGETVGLLGPNGCGKSSLLRILAGLRRPDAGCVTLDGQDIARIAKKQLARRVAFVEQHGMTDANMRVRDVVKLGRIPHHSPFSNWSAQDDETVTAALQRVDMLDRSEQGWLSLSGGERQRVHIARALAQTPTEILLDEPTNHLDIHHQMQLMQLISELPVTSIVAIHDLNHASMFCDSLIVMQQGQIVATGTPQEILSEELLWDVFRVKTRIEISPYHGKKHIHFIV

SEQ ID NO: 9695 - protein, 409 aa, Enterobacter cloacae
VKTMPLRTATTLWPPVLLGSQFVFNIGFYAVVPFLAIFLRDDMLLSGGLIGLVLGLRTFSQQGMFIVGGALSDRFGAKSVILSGCIVRVVGYLLLAFGQSLWPVILGACLTGVGGALFSPSIEALLAKAGTQSEAKGKRSRAEWFALFAVCGELGAVLGPVMGALLTGLGFRQVALAGAGIFIVALVVLFFCLPAAHRSTKPLKILPWWTTFRQPRFVAFIIAYSSWLLSYNQLYLALPVEIQRAGGNEKDLGPLFMLASVLIIVLQLPLARFARNVGAVRILPVGFLLLSASFASVALFAATEPPEGWLRLLPSASLVTLLTLGQMLLVPSAKDLIPRFAEESTLGAHYGALSTAGGIAVLVGNLGLGSLLDKALVPSTEAIYPWLLLAVFPLCSAVALSVICRPLRR

SEQ ID NO: 9696 - protein, 860 aa, Enterobacter cloacae
EHGHQDFMSTLENFDAHTPMMQQYLKLKAQHPEILLFYRMGDFYELFYDDAKRASQLLDISLTKRGASAGEPIPMAGIPHHAVENYLAKLVNQGESVAICEQIGDPATSKGPVERKVVRIVTPGTISDEALLQERQDNLLAAIWQDGKGFGYATLDISSGRFRLSEPADRETMAAELQRTNPAELLYAEDFAEMALIEGRRGLRRRPLWEFEIDTARQQLNLQFGTRDLIGFGVENAPRGLCAAGCLLQYVKDTQRTALPHIRSITMERQQDSIIMDAATRRNLEITQNLAGGMENTLASVLDSTVTPMGSRMLKRWLHMPIRNTETLTGRQQTIAALQDRYTELQPVLRQVGDLERILARLALRTARPRDLARMRHAFQQLPELRAQLGEIDSAPVQKLRETMGEFTELRELLERAIIDAPPVLVRDGGVIAPGYNEELDEWRALADGATDYLDKLEIRERERLGLDTLKVGYNAVHGYYIQISRGQSHLAPIHYVRRQTLKNAERYIIPELKEYEDKVLTSKGKALALEKQLYDELFDILMPHLADLQLSAAALAELDVLVNLAERADTLNYTCPTFTDKPGIRITEGRHPVVEQVLNEPFIANPLNLSPQRRMLIITGPNMGGKSTYMRQTALIALLAYIGSYVPAQKVEIGPIDRIFTRVGAADDLASGRSTFMVEMTETANILHNATENSLVLMDEVGRGTSTYDGLSLAWACAESLANKIKALTLFATHYFELTQLPEKMEGVANVHLDALEHGDTIAFMHTVQDGAASKSYGLAVAALAGVPKEVIKRARQKLRELESLSPNAAATQIDGTQMSLLAVPEETSPAVEALENLDPDSLTPRQALEWIYRLKSLV

SEQ ID NO: 9697 - protein, 87 aa, Enterobacter cloacae
FSAVFCRVAASPYPAYKTRRTGKRSATGLFLQQRRDRRHLRCFINILLRHAERFRVMLAAGTAQRFGIAPGIQTVLTLIYRPDTFHR

SEQ ID NO: 9698 - protein, 197 aa, Enterobacter cloacae
TKTNALQERRMIETITHGAEWFIGLFQKGGEVFTGMVTGILPLLISLLVIMNALINFIGQQRIERFAQRCAGNPLSRYLILPFIGTFVFCNPMTLSLGRFMPEKYKPSYYAAASYSCHSMNGLFPHINPGELFVYLGIASGLTTLGLPLGPLAVSYLLVGLVTNFFRGWVTDLTTAIFEKKMGIQLEQKVHLSGATA

SEQ ID NO: 9699 - protein, 325 aa, Enterobacter cloacae
PERKMSDFLLNAGRQTLLLELQEASRLPERLGEDFVRAANTIIHCEGKVIVAGIGKSGHIGKKIAATLASTGTPAFFVHPAEALHGDLGMIESRDVMLFISYSGSAKELDLIIPRLQEKSVALLAMTGKSRSPLALAAKATLDISVEREACPMHLAPTSSTVNTLMMGDALAMAVMQARGFNEEDFARSHPAGALGARLLNKVHHLMRTDDAIPQVKLDTSVMDAMLELSRTGLGLVAVCDNDRQVKGVFTDGDLRRWLVGGGKLEARVSEAMTQGGLTLNADSRAIEAKEVLMKRKITAAPVVDEHGRLCGAINLQDFYQAGII

SEQ ID NO: 9700 - protein, 486 aa, Enterobacter cloacae
VEVAMSILVKNNIHWVGQRDWEVRDFHGTEYKTLRGSSYNSYLIREGKNVLIDTVDHKFSREFVQNLRSEIDLNEIDYIIINHAEEDHAGALTELMSHIPDTPIYCTTNAIDSINGHHHHPEWNFHTVKTGDTLDIGNGKQLIFVETPMLHWPDSMMTYMTGDAVLFSNDAFGQHYCDERLFNDEVDQTELFEQCQRYYANILTPFSRLVTPKITEILGFNLPVDMIATSHGVVWRENPTQIVELYLKWAADYQEDRITIFYDTMSNNTRMMADAIAQGINEVDPNVAVKIFNVARSDKNEVLTNVFRSKGVLVGTSTMNNVMMPKIAGLVEEMTGLRFRNKRASAFGSHGWSGGAVDRLSTRLQDAGFEMSLSLKAKWRPDLDALEICRQHGRDIARQWALAPLPETAPAAAVAPEAVAEAAPAAADLGPCMQCSVCQWIYDPELGEPLQDVAPGTPWSEVPDNFLCPECSLGKDVFDELATEAK

SEQ ID NO: 9701 - protein, 498 aa, Enterobacter cloacae
NRFPTLLTTITGSHPMAKNYAALANDVVSALGGKENIVAVTHCMTRLRFVLKDESLTDTARLKSISGVLGVVRNDNQCQVIIGNTVSQAYREVVSLLPANLQPAVAEGPQKLTLRRIGAGILDALIGTMSPLIPAIIGESMVKLLAMILEMTGVLGKGDPTLTILTVIGDGAFFFLPLMVAASAAVKFKTNMSLAIAIAGVLVHPSFIELMAKAAQGEHVEFAFIPVTAVKYTYTVIPALVMTWCLSYIERWVDRITPAVTKNFLKPMLIVLIAAPLAIVLIGPLGIWIGSAISALVYTIHGYLGWLSVAIMGALWPLLVMTGMHRVFTPTIIQTIAETGKEGMVMPSEIGANLSLGGSSLAVAWKTKNPELRQTALAAAASAIMAGISEPALYGVAVRLKRPLIASLISGFICGAVAGMAGLASHSMAAPGLFTSVQFFDPANPMTIVWVFGVMGLAVVLSFVLTLLLGFEDIPVEDEAEKARALQTAPVQNKAAEA

SEQ ID NO: 9702 - protein, 480 aa, Enterobacter cloacae
TESEVRMSVFPQGFLWGGALAANQSEGAYREGGKGLTTVDMIPHGANRLAVKVGKEKRFSLRDDEFYPSHEAIDFYHRYKEDIALMAEMGFTVFRTSIAWSRLYPNGDEPLPNQEGIAFYRAVFEECKKYNIEPLVTLCHFDVPMHLVTEYGSWRNRKMVDFFARYARTCFEAFNGLVKYWLTFNEINIMLHSPFSGAGLVFEEGENEDQVKYQAAHHELVASALATKIAHEVNPENQVGCMLAGGNFYPYSCKPEDVWMALEKDRENLFFIDVQARGSYPAYSARVFREKGVVIVKDPGDDELLKNTVDFVSFSYYASRCASADMNAGNTSAANIVKSLRNPHIQVSEWGWGIDPLGLRITMNMMYDRYQKPLFLVENGLGAKDVVDENGEINDDYRISYLREHIRAMGDAIEDGVPLLGYTTWGCIDLVSASTGEMSKRYGFVYVDRDDAGNGTLERKRKKSFGWYKKVIASNGGDLE

SEQ ID NO: 9703 - protein, 80 aa, Enterobacter cloacae
SSPQSATPRPTTAAADRPSGLSSGCRKDRPSSPRWRTAQRPGLRHWHAPAAPSRAAGLSRPAGQNRLRPTARRRCPAAGR

SEQ ID NO: 9704 - protein, 113 aa, Enterobacter cloacae
DPAGFRHARRRDGRLAELAGERTMCIGVPGQIHSIDGNQAKVEVCGILRDVDLTLVGSHDETGASRLGQWVLVHVGFAMSVINEEEARDTLDALQNMFDVEPDVGALLYGEER

SEQ ID NO: 9705 - protein, 374 aa, Enterobacter cloacae
HMRYVDEYRAPEQVLQLIDRLKSRASLLDYTKEKPLRIMEVCGGHTHAIFKFGLDQLLPENIEFIHGPGCPVCVLPMGRIDSCLDIASRPGVIFCTFGDAMRVPGKNGSLLQAKARGADVRIVYSPMDALTLAMANPERKVVFFGLGFETTMPATAITLQQAKARNVTNFYFFCQHITLIPTLRSLLEAPDNGIDAFLAPGHVSMVIGTEAYGFIAEQYNRPLVVAGFEPLDLLQGVTMLVEQKIAALSAVENQYRRVVPDAGNRRAQEAIADVFSVEGDSEWRGLGLIAESGVHLTPAYRAFDAEAHFRPQPQQVCDDPRARCGDVLTGKCKPHHCPLFGNACNPQTAFGALMVSSEGACAAWYHYRNQECEA

SEQ ID NO: 9706 - protein, 334 aa, Enterobacter cloacae
RLMKKVLCALGLAVASMSTALATTYPLTIENCGYKETFTKAPERVVALGQNTVEILLLLGLEDKVKASAFWPTKVLPQLAEQNAKIKTLTVEIPTLESILAQNPDFVPAQLPLLLGPESKVAKREDLATVGVNSYLSPGMCATKKAAGDMYGSRQTLWDMTYLYQEIEDFAKIFNVEARGQAVIADFKKREADLRQEFGKNNKDLSFVFWFSSSSPSADAYVGGKNSASGFIANVLGGHNAITSETEWPTVGWESIIAANPDVIVVSSLDRNRWALDNAEEKIKFLKSDPAVSQMEAVKKGHIVVMDGQAMNPTIRTLYGAEQVGEQIRKLGLD

SEQ ID NO: 9707 - protein, 248 aa, Enterobacter cloacae
RMHWRNLTCSACRRERQPGRCQSSYWVSAPGAVSLSAGAFAGAFAAFAFVAFLTNGARGGNERTILAGVAASQLFNAITAYTISTSASAQQARDVMFWLLGSFSGVRWPEFQLALVVVLAGLAVCLYYSRALDAFTFGDDAAASLGIAVPWVRLALFTTTALITATIVSMAGSIGFVGLVVPHVMRFLFGPLHRTLLIASALAGAILMVLADIASRMLIAPQSLPVGVVTALVGVPFFAVIIYRSRNK

SEQ ID NO: 9708 - protein, 144 aa, Enterobacter cloacae
REYFSVGVSMELRQEAFHLLRQLFQQHTAQWQHALPELTKPQYAVMRSIAENPGIEQVALTEVAVSTKATLAEMLSRMEARGLVRREHDPADKRRRFVFLTAEGEALLESSKPIGNEVDEAFLGRLNGAEREQFSALIKKMMQG

SEQ ID NO: 9709 - protein, 471 aa, Enterobacter cloacae
KLTTAFVSPIASAAAVKLPVSATAINIAVRCKLSIACLVNCQNNVDSISCFVAFIRNVRADTIRHLTGGTSMTYRSKIAVVFLLGFFLDLINMFIASVAFPAMARAFNTTPSALAWVSNGYIAGLTLVIPFSSILTRRVGPKRVILLSLLLFSAASVAAGLSSSLESLIAWRVVQGAGGGLLIPVGQALTWQQFKPHERARLSSAVMLVALLAPACSPAVGGMLVQTFSWRWIFFATLPVVIVTFALACAWLKTEPSPITPTRTVNLSLLTDPLLRLSMLIYVCVPGIFIGVNVTGMYYLQSEANMTPAATGMLMLPWSVASFLAITATGRYFNRIGPRPLVVIGCLLQATGILLLVNVGPAMLLPAVAFALMGAGGSLCSSTAQSSAFLTMRPEDMPDASALWNLNRQLSFFAGALLLAQALSFMQAYLSPLAAWHGMFVFAAVITLLPVLYVYRLNNTQLLAQLQQEQP

SEQ ID NO: 9710 - protein, 404 aa, Enterobacter cloacae
NCSLMTSRPVALRLPGLRLRHTTMKIVIAPDSYKESLSATEVAQAIEKGFREIFPDAHYVSVPVADGGEGTVEAMIAATQGTWQQAVVTGPLGEKVKASWGISGDGTTAFIEMAAASGLVLVPPAQRNPLVTTSRGTGELILRALDKGARNIIIGIGGSATNDGGAGMMQALGAKFTDANGTEIGYGGGSLMALNRIDISDLDPRLQGCAIRVACDVTNPLVGESGASRIFGPQKGATEEMILELDASLSHYAEVIKKTLRIDVNRVPGAGAAGGMGAALMAFLGAELKSGIEIVTQALNLEEHIHDCTWVLTGEGRIDSQSINGKVPVGVASVAKKYHKPVIGIAGSLTQDVGVVHQYGIDAVFSVLTRIGSLEEAFQGAYDNIYRASRNIAATLQVGMRSQG

SEQ ID NO: 9711 - protein, 478 aa, Enterobacter cloacae
SPHINNSHLHLLTRNRWRSESYKNNQLPYKISECPMNMATNSSVIVSDSPAARRAGMSESEWREAIKFDSTDTGWVIMSIGMAIGAGIVFLPVQVGLMGLWVFLLSSIIGYPAMYLFQRLFINTLAESPECKDYPSVISGYLGKNWGILLGALYFVMLVIWMFVYSTAITNDSASYLHTFGVTDGLLSENPFYGLFLICILVAISSRGEKLLFKVSSLMVLTKLFVVAALGLSMIGLWHLANVGMLPPMGLLIKNAIITLPFTLTSILFIQTLSPMVISYRSREKSVEVARHKALRAMNIAFGVLFVTVFFYAVSFTLAMGHDEAVKAYEQNISALAIAAQFISGDGAGWVKIVSVILNIFAVMTAFFGVYLGFREATQGIVMNILRRKMPAEKINENAVQRGIMLFAILLAWSAIVLNAPVLSFTSICSPIFGMVGCLIPAWLVYKVPALHKYKGVSLVIIVITGLLLCVSPFLAFS

SEQ ID NO: 9712 - protein, 504 aa, Enterobacter cloacae
TELRPFEVDMQYIKIHSLDNVAVALADLAEGTEVTFDNQSVTLRQAIGRGHKFALIPIAKGENVVKYGLPIGHALADIAPGEYIHSHNTRTNLSDLDEYSYQPDFQAEEGQAADREVQIYRRASGEVGIRNELWILPTVGCVNGIARQIQTRFLKETNNAEGTDGVHLFSHTYGCSQLGDDHINTRTMLQNMVRHPNAGAVLVIGLGCENNQVDAFRDTLGEFDPERVHFMVCQHQDDEVEAGVEQLHQLYEVMRHDKREPGKLSELKFGLECGGSDGLSGITANPMLGRFSDYVIANGGTTVLTEVPEMFGAERILMSHCRDEETFEKTVTMVNDFKQYFIAHNQPIYENPSPGNKAGGITTLEEKSLGCTQKAGASQVVDVLRYGERLKTHGLNLLSAPGNDAVATSALAGAGCHMVLFSTGRGTPYGGFVPTVKIATNSELAAKKKHWIDFDAGQLIHGKAMPQLLTEFVDTIVEFANGRQTCNEKNDFRELAIFKSGVTL

SEQ ID NO: 9713 - protein, 464 aa, Enterobacter cloacae
DTGFSDPAYTARGLCQSRNHACPGSVFPAPHRAFPRQSGHEPGKVNAPDSPGDKSAGSSKPQNSVKTGILTHPFQGYAKFYHSGGPMSHLDNGFRSLNLKRFPETDDVNPLQAWEAADEYLLQQLDETEISGPVLILNDAFGALACALAEHAPYSIGDSYLSELATRENLRHNDIEESSVKFLDSTADYPQAPGVVLIKVPKTMALLEQQLRALRKVVTPETRIIAGAKARDIHTSTLELFEKVLGPTTTTLAWKKARLINCTFSAPALADAPETLSWKLEGTDWTIHNHANVFSRTGLDIGARFFMEHLPENLEGEIVDLGCGNGVIGLTLLAKNPEASVVFSDESPMAVASSRLNVETNLPEALDRCEFMINNALSGVEPFRFNAVFCNPPFHQKHALTDNVAWEMFHHARRCLKINGELYIVANRHLDYFHKLKKIFGNCVTIATNNKFVVLKSVKLGRRR

SEQ ID NO: 9714 - protein, 313 aa, Enterobacter cloacae
  UNSURE (313)
VSRPRGSGAGNASGRAQRRAAAPRRQPRPDDGAGVWRAIMKILLKNRELSAFLAILALFAVLVALNPSYLSLQTLGMIFASAQILILLAIGAALVMLTRNIDVSVGSTVGLSAIAVGVALNSGYSLPVSILFALSIGALAGAFNGFLVVGLRIPAIVATLGTLGLYRGAMLLWTGGKWIEGLPPGLKSLSEPAAVGISPLGMLVLIIAATGAWTLSRTAFGRIFYAVGDNLAAARQLGVAVNRTRMIAFTLNGLLAACAGIVFAAQIGFVPNQTGSGLEMKAIAALRAGGHLAAGRHRHADLIQPPGWKDQRX

SEQ ID NO: 9715 - protein, 257 aa, Enterobacter cloacae
VMSNDIFPNKFKAALAAHQIQIGCWSALANPISTEVLGLAGFDWLVLDGEHAPNDINTFIPQLMALKGSHSAPVVRVPTNEPVIIKRLLDIGFYNFLIPFVETEEEAVQAVAATRYPPEGIRGVSVSHRANMFGTVPDYFSQSNKNITILVQIESQQGVDNVDAIAATEGVDGIFVGPSDLAAAFGHLGNASHPDVQRAIQHIFARAKAHGKPCGILAPVEADARRYLEWGATFVAVGSDLGVFRAATQKLADAFKK

SEQ ID NO: 9716 - protein, 303 aa, Enterobacter cloacae
PSLRKQIMTLKVGFIGLGIMGKPMSKNLIKAGYSLVVLDRNSDAVAEVIAAGAETATTAKAIAEQCDVIITMLPNSPHVKEVALGENGIIDGAKPGLVVIDMSSIAPLASREISEELKAKGVEMLDAPVSGGEPKAIDGTLSVMVGGDKAVFDKYYDLMKAMAGSVVHTGEIGAGNVTKLANQVIVALNIAAMSEALTLATKAGVNPDLVYQAIRGGLAGSTVLDAKAPMVMDRNFRPGFRIDLHIKDLANALDTSHGVGAQLPLTAAVMEMMQALRADGLGTADHSALACYYEKLAKVEIAR

SEQ ID NO: 9717 - protein, 310 aa, Enterobacter cloacae
AQNIMNTIILPKTQHLVVFQEVIKSGSIGSAARQLGLTQPAVSKIISDIESYFGVEVMVRKNTGVKLTAAGQVLLSYAESITREMKNMVSEINSLSFSTVMDVSFGYPSLIGFTFLSGMIKKFKEVFPKARVSMYEAQLSSFLPAIRDGRLDFAIGTLSDGMQLQDLHVEPLFESEFVLVASKSRTCTGPTRLASLTHEQWVMPQTDMGYYNELLTTLQDNHISIENIVQTDSVVTIYNLVLNADYLTVIPRDMIAPFGSDQFIVLPVEDELPVARYAAVWSKNYSIKKSASVLVELAKQYSSMNTEKRR

SEQ ID NO: 9718 - protein, 342 aa, Enterobacter cloacae
LCLKTMNYYNEDIMHITYDLPVTIEDIQDARKRLAGKIYKTGMPRSNYLSERCKGEIFLKFENMQRTGSFKIRGAFNKLSSLTDAEKRKGVVACSAGNHAQGVSLSCAMLGIDGKVVMPMGAPKSKVAATRDYSAEVVLHGENFNDTIAKVSEIVEMEGRIFIPPYDDPKVIAGQGTIGLEILEDLYDVDNVIVPIGGGGLIAGIATAIKSINPTINIIGVQSENVHGMAASYQAGEITNHRITGTLADGCDVSRPGNLTFEIVRELVDDIVLVSEDEIRNSMIALIQRNKVVTEGAGALACAALLSGKLDHYIQGRKTVCIISGGNIDLSRVSQITGFVDA

SEQ ID NO: 9719 - protein, 502 aa, Enterobacter cloacae
LTKKTSDSGNWCDNFAASEHKLSDAPVMRKTIMTPFMTDDFLLDTEFARRLYHDYAKDQPIFDYHCHLPPQQVAENYRFKNLYDIWLKGDHYKWRAMRTNGVAERLCTGDATDREKFDAWAATVPHTIGNPLYHWTHLELRRPFGITGKLLSPATADEIWDQCNDLLAQDSFSARGIMKQMNVKMVGTTDDPVDSLEHHAVVAKDSTFDIKVLPSWRPDKAFNIELPTFNDYMAKLAEVSDTDIRRFGDLQTALTKRLDHFAAHGCKVSDHALDVVLFAESSEAELDSILARRLSGEALSEHEVAQFKTAVLVFLGAEYARRGWVQQYHIGALRNNNQRQFKLLGADVGFDSINDRPMAEELSKLLSKQNEQNLLPKTILYCLNPRDNEVLGTMIGNFQGEGMPGKMQFGSGWWFNDQKDGMERQMTQLAQLGLLSRFVGMLTDSRSFLSYTRHEYFRRILCQMIGRWVHAGEAPADIQLLGEMVRNICFNNARDYFAIELN

SEQ ID NO: 9720 - protein, 524 aa, Enterobacter cloacae
SLHGCKYSSPSTLLNIIKSKNHLFNSGAMMTPLLDARDISKQFSGVPVLKGIDFTLLAGQVHALMGGNGAGKSTLMKIIAGVETPDCGELSVAGESFTRLTPAQAHRLGIYLVPQEPLLFPNLTVRENILFRLPRERDREKRLAEKLRQLQCQLNLDATASTLEVADQQMVEILRGLMRNARILILDEPTASLTPGETERLFRQIRALQDLGVGIVFISHKLPEIRQLASHVSVMRDGAVVLSGETAQFDDNALIAAMTPVSRETSLSDTQKLWLALPGNRRTQAQDFPVLRVEDLTGEGFIDLSLEIYAGEIVGLAGLVGSGRTEFAETLYGLRPVRGGRVWLENQEITTEPVGSRLEKGLVYLPEDRQVSGLFLDAPIRWNTVALNEPSLWQQRKRESAVVERYHRALGIKLNHADQTVRTLSGGNQQKVLLARCLEANPLLLIVDEPTRGVDVSARADIYQLLKSVAAQNVAVLMISSDLDEFPGLADRVLVMHQGVLSGELPRHAVSLDRMMALAFGGQS

SEQ ID NO: 9721 - protein, 270 aa, Enterobacter cloacae
GARMSSTDSSAEKRITGTSERREQIIQRLRAQGSVQVNDLSLLFGVSTVTIRNDLAFLEKQGIAVRAYGGALICEGNAPGVEPSVEDKSSLNTAVKRSIAQAAVELVKPGHRIILDSGTTTFEIARMLRQHTDVIAMTNGMNVANALLEAEGVELLMTGGHLRRQSQSFYGDQAEQSLQNYHFDLLFLGVDAIDLDRGVSTHNEDEARLNRKMCEVAERIIVVTDSSKFNRSSLHKIIDTHRIDMIIVDEGIPAESLEGLRKSGIDVVLV

SEQ ID NO: 9722 - protein, 444 aa, Enterobacter cloacae
LMSNTESIIVGQTKTSSWRKSDTTWTLGLFGTAIGAGVLFFPIRAGFGGLIPILLMLVLAFPIAFYCHRALARLCLSGSNVSGNITETVEEHFGKTGGVVITFLYFFAICPLLWIYGVTITNTFMTFWENQLQMPALNRGVVALFLLLLMAFVIWFGKDLMVKVMSYLVFPFIASLVLISLSLIPYWNSAVIDQVNLSDIAFTGHDGILVTVWLGISIMVFSFNFSPIVSSFVVSKREEYEPEFGKEFTEQKCSKIIGRASLLMVAVVMFFAFSCLFTLSPQNMADAKAQNIPVLSYLANHFASMSGSKSTFATVLEYGASIIALVAIFKSFFGHYLGTLEGLNGLIIKFGYKGDKKNVSVGKLNTISMVFIMGSTWIVAYANPNILDLIEAMGAPIIASLLCLLPMYAIRKAPALAKYKGRTENIFVTVVGLLTILNIVYKLF

SEQ ID NO: 9723 - protein, 412 aa, Enterobacter cloacae
TKAQEERSHTMIEFPVVLVINCGSSSVKFSVLDAASCDALMTGIADGINTEKAFISVNGGEPVRLAHQDYEGALAAIALELEKRNLMGSVALIGHRIAHGGDLFSESTLITEEVMAQIRQVSPLAPLHNYANLSGVEAAERLFPGVQQVAVFDTSFHQTMPPQAYLYGLPYRYFEELGVRRYGFHGTSHRYVSAQAHALFGLSPDDSGLVIAHLGNGASICAVRNGVSVDTSMGMTPLEGLVMGTRCGDVDFGAMAWIARQTGQSFEDLERVVNKESGLLGISGISSDLRALEKAWHDGNERARLAIKTFVHRIARHIAGHAASLHRLDGVVFTGGIGENSVLIRALVAEHLKVFGIILDESKNALPGSAGERVISTESSRAACAVIPTNEEKMIALDALRLGKVTPAAAYA

SEQ ID NO: 9724 - protein, 768 aa, Enterobacter cloacae
SENLMKVTIDTGVAPYSDAWAGFRGEEWKNAINVRDFIQHNYTPYEGDEAFLAQATPATTALWQKVMVGIRQENATHAPVDFDTNIATTITAHGPGYIDQELETIVGLQTDKPLKRALHPYGGINMIRSSFEAYGREMDPQFEYLFTDLRKTHNQGVFDVYSPEMMRCRKSGVLTGLPDGYGRGRIIGDYRRVALYGISYLVRERELQFADLQGKLERGEDLEATIRLREELAEHKRALLQIQQMAANYGFDISRPAMNAQEAVQWLYFAYLAAVKSQNGGAMSLGRTASFLDIYIERDMQAGRLNEVQAQELIDHFIMKIRMVRFLRTPEFDTLFSGDPIWATEVIGGMGLDGRTLVTKNSFRYLHTLHTMGPAPEPNLTILWSEKLPIAFKKYAAQVSIVTSSLQYENDDLMRTDFNSDDYAIACCVSPMVIGKQMQFFGARANLAKTLLYAINGGVDEKLKIQVGPKTEPLLDEVLDYDTVMASLDHFMDWLAVQYISALNLIHYMHDKYSYEASLMALHDRDVYRTMACGIAGLSVAADSLSAIKYATVKPVRDHTGLAVDFIIEGDYPQYGNNDDRVDSIACDLVERFMKKIQALPTYRNAVPTQSILTITSNVVYGQKTGNTPDGRRGGTPFAPGANPMHGRDRKGAVASLTSVAKLPFTYAKDGISYTFSIVPQALGKDEPVRKTNLVGLLDGYFHHEATIEGGQHLNVNVMNREMLLDAIAHPENYPNLTIRVSGYAVRFNALTREQQQDVISRTFTQAM

SEQ ID NO: 9725 - protein, 465 aa, Enterobacter cloacae
RRIAGNYRNYRAAALCFSFPRLLMRLNKVVTMSEQINPLWNHFIRAVQEEVKPALGCTEPVSLALACAMAAGQLSGEVTRIEAWVSPNLMKNGLGVTVPGTGMVGLPIAAALGATGGNAHAGLEVLKDASAEALTRAKALLNAGLVQVKLQEPCDEILYSRACVYAGESSAMVTIAGGHTRVVEVVCQGETCFRLDDRQSQNNDDPLAVLSTTTLSQILEFVEQVPFDAIRFILDAGRLNDALSREGLRGNWGLHIGATLNKQRARGWMAQDLGSDIIIRTSAASDARMGGATLPAMSNSGSGNQGITATMPVVVVAEHVQADDERLARALMLSHLSAIYIHYQLPRLSALCAATTAGMGAAAGMAWLMGGSYQTIAMAIGSMIGDVSGMICDGASNSCAMKVSTSVTSAWKAVMMALDDTAVTGNEGIVAHDVEQSISNLCALACRSMQATDRQIIEIMASKVL

SEQ ID NO: 9726 - protein, 323 aa, Enterobacter cloacae
RYGRCIVSQIFCLVCSNFLNENEMAKERALTLEALRVMDAIDRRGSFAAAADELGRVPSALSYTMQKLEEELDVVLFDRSGHRTKFTNVGRMLLERGRVLLEAADKLTTDAEALARGWETHLTLVTEALVPTEALFPLVDRLAAKANTQLSIITEVLAGAWERLETGRADIVIAPDMHFRSSSEINSRKLYSVMNVYVAAPDHPIHQEPEPLSEVTRVKYRGVAVADTARERPVLTVQLLDKQPRLTVTSLEDKRQALLAGLGVATMPYPFVEKDIAEGRLRVVSPEYTSEVDIIMAWRRDSMGEAKSWCLREIPKLFAHHNK

SEQ ID NO: 9727 - protein, 536 aa, Enterobacter cloacae
QRGKLMSYLLALDAGTGSVRAVIFDLQGNQIAVGQAEWKHLSVENVPGSMEFDLDTNWRLACRCIQQALERARLSAADIQSVACCSMREGIVLYDRNGEAIWACANVDARASREVAELKEIHDYRFESEVYEVSGQTLALSAMPRLLWLAHHRPDIYRKAATITMISDWLAAKLSGELAVDPSNAGTTGMLDLFSRDWRPALLDMAGLRADILSPVKETGTVLGAITRQAAQQCGLREGTPVVMGGGDVQLGCLGLGVVRAGQTAVLGGTFWQQVVNLPQVRTDPEMNIRVNPHVIPGMAQAESISFFTGLTMRWFRDAFCAEEKLIAERMGMDTYSLLEEMASRVPAGSHGVMPIFSDAMHFKQWYHAAPSFINLSIDPEKCNKATLFRALEENAAIVSACNLAQISRFSGVTFESLVFAGGGAKGALWSQILSDVTGLPVRVPEVKEATALGCALAAGAGAGLFADMASTGERLVKWSREFTPNPQHRELYDGMMQKWQAVYADQLGLVDSGLTTSMWQAPGLVRASPSPRPSP

SEQ ID NO: 9728 - protein, 334 aa, Enterobacter cloacae
TFMIRFAVIGTNWITRQFVDAAHETGKYKLTAVYSRSLEQAQSFANDYLVEHLFTSLDEMAQSDAIDAVYIASPNSLHFPQTKLFLSHKKHVICEKPLASNIEEVEAAIALARENQVVLFEAFKTASLPNFLLLQQSLPKIGKVRKAFINYCQYSSRYQRYLDGENPNTFNPAFSNGSIMDIGFYCLASAVALWGEPHGVTATASLLESGVDAHGVVVLDYGDFSVTLQHSKVSDSVLPSEIQGEDGSLVIEKISECQKLSIVPRGGKAQELTQPQHINTMLYEAEVFARLVEDNEVNHPGLAISRTTAKLQTEIRRQTGVIFPADGVNVEAVA

SEQ ID NO: 9729 - protein, 414 aa, Enterobacter cloacae
RMSTQSRGLFARLAQGSLVKQILVGLVLGILLAMVSKPAAEATGLLGTLFVGALKAVAPVLVLMLVMASIANHQHGQKTNIRPILFLYLLGTFSAALTAVVFSFLFPSTLHLTSAAGDITPPSGIVEVLRGLLMSMVSNPITALMSGNYIGILVWAIGLGFALRHGNETTKNLVNDLSNAVTFMVKLVIRFAPVGIFGLVSSTLATTGFDALWGYAQLLVVLVGCMLLVALVINPLLVFWQIRRNPYPLVLTCLRESGVYAFFTRSSAANIPVNMALAEKLNLDRDTYSVSIPLGATVNMAGAAITITVLTLAAVHTLGIPVDLPTALLLSVVASLCACGASGVAGGSLLLIPLACNMFGIPNEIAMQVVAVGFIIGVLQDSCETALNSSTDVLFTAAACQAEDARLAKNALRS

SEQ ID NO: 9730 - protein, 448 aa, Enterobacter cloacae
VVAVSRHGNNITMRFYMRKIKGLRWYMIALVTLGTVLGYLTRNTVAAAAPTLMEELHISTQQYSYIIAAYSAAYTVMQPVAGYVLDILGTKIGYAFFAVAWAVFCGATALAGSWGGLALARGAVGAAEAAMIPAGLKASSEWFPAKERSIAVGYFNVGSSIGAMIAPPLVVWAIVMHSWQMAFIISGVLSFAWAMAWLIFYKHPRDQKKLSDEERDYIINGQESQHQTDNGKKMSVWQILGTRQFWGIALPRFLAEPAWGTFNAWIPLFMFKVYGFNLKEIAMFAWMPMLFADLGCIVGGYLPPLFQRWFGVNLIVSRKMVVTMGALLMIGPGMIGLFTSPYVAIALLCIGGFAHQSLSGALITLSSDVFGRNEVATANGLTGMAAWTASTLFALVVGALADTIGFSPLFAVLAVFDLLGAVVIWTVLKSKSADELAKESLGGPATQS

SEQ ID NO: 9731 - protein, 137 aa, Enterobacter cloacae
FWNTAYAVTQWKVSIMKYRITLALALFSLSTASFAMSLCQEKEQDIQREISYAEKHNNQHRIDGLKKALSEVKDNCTDSKLRADHQEKIAEQKDEIAERRQDLQEAKEKGDAEKIAKRERKLQEAQDELKALEARDY

SEQ ID NO: 9732 - protein, 99 aa, Enterobacter cloacae
VVSDKAERQKRKAYLLSQIQQQRLDLSASRRDWVEATHRFDRGWNTVLSLRSWALVGSSVMAIWSVRHPNMLIRWARRGFGAWSAWRLVKTTLRQQQLR

SEQ ID NO: 9733 - protein, 238 aa, Enterobacter cloacae
REVKFMITTRTAKQCGQADFGWLQARYTFSFGHYFDPKLLGYASLRVLNQEVLAPGASFQPRTYPKVDILNLILEGEAEYRDSEGNHVQAKAGEALLISTQPGISYSEHNLSKDKTLTRMQLWLDACPERENPLVQKIDLKGDQQQLIASPDGSKGSLQLRQQVWLHHIELKKGEQASFQLHGPRAYLQSIHGTVHAVTHTEEKEALTCGDGAFIRDEANITLVADTPLRALLIDLPV

SEQ ID NO: 9734 - protein, 524 aa, Enterobacter cloacae
TMADIEIRQASPTAFYIKVHDTDNVAIIVNDNGLKAGTRFPDGLELIEHIPQGHKVALVDIPAHGEIVRYGEVIGYAVRAIPQGSWIEESLVELPTAPPLETLPLATRVPEPLPPLEGYTFEGYRNADGSVGTKNLLGITTSVHCVAGVVDYVVKIIERDLLPKYPNVDGVVGLNHLYGCGVAINAPAAVVPIRTIHNIALNPNFGGEVMVIGLGCEKLQPERLLQGTEDVKAIPVDDASVVRLQDEHHVGFRSMVDDILQVAERHLEKLNKRQRETCPASELVVGTQCGGSDAFSGVTANPAVGYASDLFVRCGATVMFSEVTEVRDAIHLLTPRAVNEEVGKRLLEEMAWYDNYLDMGKTDRSANPSPGNKKGGLANVVEKALGSIAKSGQSAIVEVLSPGQRPTKRGLIYAATPASDFVCGTQQVASGITVQVFTTGRGTPYGLMAVPVIKMATRTELANRWYDLMDINAGTIATGEESIEEVGWKLFHFILDVASGRKKTFSDQWGLHNSLAVFNPAPVT

SEQ ID NO: 9735 - protein, 441 aa, Enterobacter cloacae
MPTPSEMERKVKHLTEMVEQHKRGNTNGIYAVCSAHPLVLEAAIRYAHSQQTPLLIEATSNQVDQFGGYTGMTPADFYGFVCKLAGSLGFPTSQLILGGDHLGPNRWQNLPALQAMANADDLIRSYVAAGFKKIHLDCSMSCEDDPVPLTDAIVAGRAARLAKIAETTCLEQFGVADLVYVIGTEVPVPGGAHETLTELEVTTPEAARATLEAHRHAFEKEGLSDIWPRIIGLVVQPGVEFDHAHVCDYQPHKAVALSKMVEAYDTLVFEAHSTDYQTPQALRQLVKDHFAILKVGPALTFALREALFSLAAIEEELLPAKACSGLRHVLENVMLDRPEYWQSHYHGDGNARRLARGYSYSDRVRYYWPDSQIDDAFERLVRNLADEPIPLPLISQYLPLQYSKVRDGALSSTPRELILDHIQDILHQYHAACEGVTTQHA

SEQ ID NO: 9736 - protein, 313 aa, Enterobacter cloacae
STCCANRLNPRRLRPRKRNLKMASNHTTLPGVSESEETLLTGVNENVYEDQSIGAELTKKDINRVAWRSMLLQASFNYERMQASGWLYGLLPALKKIHTNKRDLARAMKGHMGFFNTHPFLVTFVIGIILAMERSKQDVNSIQSTKIAVGAPLGGIGDAMFWLTLLPICGGIGASLALQGSILGAVVFIVLFNVVHLGLRFGLAHYAYRMGVAAIPLIKANTKKVGHAASIVGMTVIGALVATYVRLNTTLEIKAGDAVVKLQTDVIDKLMPAFLPLVYTLIMFWLVRRGWSPLRLIGITVVLGVVGKFCHFL

SEQ ID NO: 9737 - protein, 349 aa, Enterobacter cloacae
SVLSRGSHFHVAPSRTYDLNFYKSSIMSDKRTAEEGRFAGLALAEEELVARVAWCYYHDGLTQNDIGERLGLPRLKISRLLEKGRQSGVIRVQINSRYEGCLALETELQQRFGLKLVRVMPALNTPPMNVRLGIGAAQSLMGVLEPGQLLAVGFGETTMSSLQHLSGFISSQQIRLVTLSGGVGPYMTGIGQLDAACSVSMIPAPLRVSSAEVAGILKRETSVRDVILAATAADVAVVGIGSVNQRRDATILRSGYISEGEQLMYARKGAVGDILGYFLNAEGECVEELEIHKELLGVTLDELAQLPTIVGVAGGEEKADAIYAALKGRRINGLVTEETTARAVLALAG

SEQ ID NO: 9738 - protein, 687 aa, Enterobacter cloacae
LIRPHNNNFTLEETMSRYPSLFAPLDLGFTTLKNRVLMGSMHTGLEERPDGAERLAAFYAERARHGVALIVTGGVAPAPSGVTMEGGAVLNDASQLSHHRIVTDAVHREGGKIALQILHTGRYSYQPNLVAPSAIQAPINRFTPHALSHDEILALIDDFARCAALAREAGYDGVEVMGSEGYLINEFLAARTNQRDDEWGGDYARRMRFAVEVVRAVRERAGADFIIIFRLSMLDLVEGGGTFDETVQLAQAIEAAGATIINTGIGWHEARIPTIATPVPRAAFSWVTRKLKGKVSVPLVTTNRINDPQVADDVISRGDADMVSMARPFLADAELLSKAQSGRADEINTCIGCNQACLDQIFAGKVTSCLVNPRACHETKMPVVTTVNKKRLAVVGAGPAGLAFAVNAASRGHGVTLFDAQGEIGGQFNIAKQIPGKDEFYETLRYYRRMIEVTGVDLRLNQFVSAADLIGFDEVILASGIAPRTPAIEGIDHPKVLSYLDVLRDKAPVGEKVAIIGCGGIGFDTAMYLSQPGEATSQNIAEFCVEWGIDTSLSQSGGLRPEGPQLPKSPRQIVMLQRKASKPGEGLGKTTGWIHRATLLSRGVKMIPAVSYQKIDDDGLHVLIGGEPQLLRVDHVILCAGQEPKRDLADPLREAGKTVHLIGGCDVAMELDARRAIAQGTQLALVI

SEQ ID NO: 9739 - protein, 172 aa, Enterobacter cloacae
NAGLYEIRRPTDVLPDAAARRSAGVWPGRVPGRTVEEEIRGQGLTMVISPLALRRFSYAIVALMMFSALILLWSALQHQESTLAIRPVSQGTSVPDGFSIWHHLDANGIRFKSITPQNDVLLIKFDSSAQSAAAKAVLDRTLPQGYIIAQQDDDSHVASWMSRLRDTSHRFG

SEQ ID NO: 9740 - protein, 156 aa, Enterobacter cloacae
SLDGCGYWRRSGCGAGCPADASLIMEDPRHAQGPAKNVLGIGQRILTTLVGIAETRVRLAVVELEEEKANLFQMLLMLGLTMLFAAFGLMSLMVLIIWAIDPQYRLNAMIATTVVLLVAALIGGIWTLHKARTSTFLRHTRQELANDRALLEDDKS

SEQ ID NO: 9741 - protein, 137 aa, Enterobacter cloacae
CGSLESKMKKLEDVGVLVARILMPILFITAGWGKITGYAGTQQYMEAMGVPGFLLPLTILLEFGGGLAVLFGFLTRTTALFTAGFTLLTAFIFHSNFAEGVNSLMFMKNLTIAGGFLLLAITGPGAYSIDRLLNKKW

SEQ ID NO: 9742 - protein, 352 aa, Enterobacter cloacae
AGYTDYIQSEETSPRFCYLTEEKKMGQLVDGVWQDVWYDTKSTGGRFKRSVSAFRNWLTADGAPGPSGEGGFAAEKDRYHLYVSLACPWAHRTLIVRKLKGLESLIPVSVVNPLMLENGWTFDSDFPAATGDELYHHDFLYQLYLRADPHYTGRVTVPVLWDKKNQTIVSNESAEIIRMFNTAFDAHGARAGDYYPVELREKIDELNGWIYDNVNNGVYKAGFATSQEAYDEAVGNVFGSLERLEQILGQHRYLTGDRLTEADIRLWTTLIRFDPVYVTHFKCDKHRISDYLNLHGFLRDIYQMPGIAETVNFDHIRTHYFRSHKTINPTGIISIGPWQDLDEPHGRDVRFG

SEQ ID NO: 9743 - protein, 162 aa, Enterobacter cloacae
KEENAMPNIVLCRIDERLIHGQVGVQWVGFAGANLVLVANDEVADDPVQQNLMEMVLAEGIAVRFWSLQKVIDNIHRAADRQKILLVCKTPADFLTLVEGGVPITRINVGNMHYASGKQQIAKTVSVDANDIAAFNGLKAAGVECFVQGVPTETALDLFKLL

SEQ ID NO: 9744 - protein, 391 aa, Enterobacter cloacae
TCTLSRGSARRGRDMSQLLRARRLLTGQGWLDDHQLRMDRGVITAIEPIPAGVNTREADLLCPAYIDIHFHGGAGVDVMDDAPDVLDRLALHKAREGVGAFLPTTVTASLEAIHGALRRIARRCHAGGPGAQLLGSYLEGPYFTPQNKGAHPPELFRELDLAELDELIAVSQNTLRVVALAPEKVDALKAIHHLKQKGIRVMLGHSAATYAQTLAAFDAGADGLVHCYNGMTGLHHREPGMVGAGLTDPRAWLELIADGHHVHPGAMRLCCCCAKDRTVLITDAMQAAGMPDGGYTLCGESVEMQGGVVRTASGGLAGSTLALDAAVRNMVEHTGVAPENAIHMASLHPARLLGMDHLLGSLAPGKRANIIALDAGLHLRQIWIQGQALSL

SEQ ID NO: 9745 - protein, 381 aa, Enterobacter cloacae
VMPQTTTTTGTWTEKEIRQQPASWLRSLNNIDNLRASIDSFLTPLLRKPDLRIVLTGAGTSAFIGDIIAPWLASHTRKNITAIPTTDLVTNPMDYFSPAHPLLLVSFARSGNSPESVAAVELANQFVPECYHLSITCNEAGSLYQNAVDSDNACALLMPAETHDRGFAMTSSITTMMASCLAVFAPETINSKTFRDVSDRCQAILTSLGDFSPGVFGNEPWKRIVYLGSGGLQGAARESALKVLELTAGKLAAFYDSPTGFRHGPKSLVDNETLVVVFVSSHPYTRQYDLDLLAELRRDRQAMRVVAIAAETDPVIEAGPHILLPPSRSFNDMEQAFCFLMYAQVFALTQSLHVGNTPDTPSASGTVNRVVQGVVIHPWQA

SEQ ID NO: 9746 - protein, 294 aa, Enterobacter cloacae
EDRLMSIISTKYLLQDAQAKGFAVPAFNIHNAETIQAILEVCSEMRSPVILAGTPGTFKHIALEEIYALCSAYSLTYDMPLALHLDHHESLDDIRRKVHAGVRSAMIDGSHYPFEQNVKLVKSVVDFCHLNDCSVEAELGRLGGVEDDMSVDAESAFLTDPQEAKRFVELTGVDSLAVAIGTAHGLYTKRPKIDFQRLAEIREVMTVPLVLHGASDVPDEDVRRTIELGVCKVNVATELKIAFSDAVKAWFAENPQGNDPRFYMRVGMDAMKEVVRSKITVCGSANRLLLPAEA

SEQ ID NO: 9747 - protein, 182 aa, Enterobacter cloacae
RRVLKPDSAFHYPKNPRSPYMTQEKSFKSKAWEFFQSLGKTFMFPVSLLAFMGLLLGIGSSVTSPSTIKSFPFLGGELTQLTFGFIAMVGGFAFTYLPLMFAMAIPMGLARRNKAVGAFAGFVGYMLMNMSINYYLTATHQLADAATMRQVGQSIVLGIQTLEMGVLGGIVVGVITYFLHEN

SEQ ID NO: 9748 - protein, 178 aa, Enterobacter cloacae
VYPFSHYFGVLMNQLTYLQGYPEHLLSQVRDLIAAGKLGAVLEKRYPGTHDFATDKALWQYTQDLKNQYLKSAPPINKVMYDNKIHVLKNALGLHTAISRVQGGKLKAKAEIRVATVFRNAPEAFLRMIVVHELAHLKEKEHDKAFYSLCCHMEPQYHQLEFDTRLWLTHLSLKSNAQ

SEQ ID NO: 9749 - protein, 332 aa, Enterobacter cloacae
PFLFFMCKENSMHSVGTPMLWGGFAVVVLIMLAIDLFLQGRRGEHGMSVKQAAVWSLVWVTLSLLFCAAFWWYLASTEGRAVADPQALAFLTGYLIEKALAVDNVFVWLMLFSYFAVPAALQRRVLVYGVLGAIVLRTIMIFAGSWLITQFEWLLYVFGAFLLFTGVKMALAKEDDTGIGDKPLVKWFRGHLRMTDKIESEHFFVRKNGLLFATPLLLVLILVELSDVIFAVDSIPAIFAVTTDPFIVLTSNLFAILGLRAMYFLLAGAAERFSMLKYGLSVILVFIGIKMLIVDFYHIPIAISLGVVFGILLVTLIINTWVNRQHDKKQQV

SEQ ID NO: 9750 - protein, 269 aa, Enterobacter cloacae
QIIRRTLPGAHMEITESRRLYQQLAAELKDRIEQGVYLVGDKLPAERFIADEKSVSRTVVREAIIMLEVEGYVEVRKGSGIHVISSQAKHSPTPDESLEFASYGPFELLQARQLIESNIAEFAATQVTKQDIMKLMEIQDHARKEKCFRDSEWDLQFHVQVALATQNTALAAIVEKMWTQRVHNPYWKKLHDHIDSRTVDNWCDDHDQILKALIRKDPHAAKLAMWQHLENTKQMLFNETSDDFEFNADRYLFADNPVVHLDTATNLAK

SEQ ID NO: 9751 - protein, 220 aa, Enterobacter cloacae
MELLTQLLNALWAQDFETLANPSMIGMLYFVLFMILFLENGLLPAAFLPGDSLLVLVGVLCAKGAMAFPQTVLLLTIAASLGCWVSYIQGRWLGNTRIVQNWLSHLPAHYHQRAHHLFHKHGLSALLIGRFIAFVRTLLPTIAGLSGLSSTRFQFFNWMSGLLWVLILTTLGYALGKTPVFMKYEDQLMSCLMLLPVVLLVFGLVGSLVVLWKKKYGARG

SEQ ID NO: 9752 - protein, 109 aa, Enterobacter cloacae
RKSQQERIMSKDTTSENLRAELKSLADTLEEVLNSSADKSKEEVSKLRSKAEQALKESRYRLGETGDALAKQTREAAARADEYVRDNPWTGVGIGAAVGVVLGVLLTRR

SEQ ID NO: 9753 - protein, 128 aa, Enterobacter cloacae
LIKRQGKMDWYLKVLRNYFGFGGRARRKEYWMFVLVNFVLIMVLGIVDKILGWEREGGEGILTTIYGVLVLLPSWAVLFRRLHDTDRSAWWLLLLLIPLIGWIVILIFNCQSGTPGENRFGPDPKASA

SEQ ID NO: 9754 - protein, 287 aa, Enterobacter cloacae
RRPEWNASFRAFQQRLLWISLNCSEGFTMEISLLQAFALGLLAFIAGLDMFNGLTHMHRPVVLGPLVGLILGDLHTGILTGGTLELVWMGLAPLAGAQPPNVIIGTIVGTTFAITTGVKPDVAVGVAVPFAVAVQMGITFLFSVMSGVMSRCDRMAANADTRGIERVNYLALLALGVFYFLCAFLPIYFGAEHAKTAIDVLPERLIDGLGVAGGIMPAIGFAVLLKIMMKNVYIPYFIIGFVAAAWLKLPVLAIAAAALAMALIDLLRKSPEPTAPAAQKEEFEDGI

SEQ ID NO: 9755 - protein, 156 aa, Enterobacter cloacae
ILSLPVKSKEVAMLGIILTGHGGFASGLQQAMKQILGEQPQFIAIDFPESSTTARLTAQLEQAVNELDAEHDIVFLTDLLGGTPFRVASTLAMQRPGSEVITGTNLQLLLEMVLERDGLSSEAFRLQALECGHRGLTSLVDELARCREEAPAEEGI

SEQ ID NO: 9756 - protein, 613 aa, Enterobacter cloacae
REARLNSHHGPFAMVNNMTDLTAQEAAWQTRDHLDDPVIGELRNRFGPDAFTVQATRTGVPVVWVKREQLLEVVDFLKKLPKPYVMLFDLHGMDERLRTHRQGLPAADFSVFYHLISIDRNTDIMLKVALSENDMHLPTITKLFPNANWYERETWEMFGMTFDGHPHLTRIMMPQTWTGHPLRKDYPARATEFDPFELTKAKQDLEMEALTFKPEDWGMKRGTENEDFMFLNLGPNHPSAHGAFRIILQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALRNSILKGRSQGVAAYGAKEALEWGTTGAGLRATGIDFDVRKARPYSGYENFDFEVPVGGGVSDCYTRVMLKVEELRQSLRILEQCLNNMPEGPFKADHPLTTPPPKERTLQHIETLITHFLQVSWGPVMPAQESFQMIEATKGINSYYLTSDGSTMSYRTRVRTPSFAHLQQIPAAIRGSLVSDLIVYLGSIDFVMSDVDR

SEQ ID NO: 9757 - protein, 331 aa, Enterobacter cloacae
PSGGKSMSWLTPDLIDILLSILKAVVILLVVVTCGAFMSFGERRLLGLFQNRYGPNRVGWGGSLQLVADMIKMFFKEDWVPRFSDRVIFTLAPMIAFTSLLLAFAIVPVSPTWVVADLNIGILFFLMMAGLAVYAVLFAGWSSNNKYSLLGAMRASAQTLSYEVFLGLSLMGVVAQAGSFNMTDIVNNQADIWNVIPQFFGFITFAIAGVAVCHRHPFDQPEAEQELADGYHIEYSGMKFGLFFVGEYIGIVTISALMVTLFFGGWHGPFLPPFIWFALKTAFFMMMFILIRAALPRPRYDQVMSFGWKVCLPLTLVNLLVTAAVILWQQP

SEQ ID NO: 9758 - protein, 230 aa, Enterobacter cloacae
FPVRANTRNITSTGWRVWQSTAKIRAKQRTKPSLSTSRACYRKERAMEFAFYICGLIAILATLRVITHTNPVHALLYLIISLLAISGVFFALGAHFAGALEIIVYAGAIMVLFVFVVMMLNLGGSEIEQERQWLKPQVWIGPAILSAIMLAVIVYAILGVNDQGIDGTPISAKAVGITLFGPYVLAVELASMLLLAGLVVAFHVGREERVGEVLSNRTDDRAKRKTEERA

SEQ ID NO: 9759 - protein, 436 aa, Enterobacter cloacae
QGEVRVHSIFLALQSLRTQLAQALPAIPGLRHFDVSFPLNDAFDPLAWLGVQRCYPQFYWQQRSGDEELAALGSLAQFDSLASASRFLHAHDVANDTRICGLNAFNPAQGKLFLPRLLWRRSGGVATLRLQLWSETSLREDAREALNFVDNLRDAAPIRPLSVQIVQETHHPEKPDWLALIRQATDTLARGDFEKVVLARATDVQCQQPVNAIALMAASRALNLNCYHFCMVFDASNAFLGSTPERLWRRRGTLLRTEALAGTVASHSDDKQAQRLGDWLMNDDKNQRENMLVVEDICQRLQHHTRTLEILPAQVLRLRKVQHLRRCIWTELKQPDDEQCLHILQPTAAVAGLPRQAAREFIAKVEPFDREWYAGSAGYLSRDQSEFCVALRSARVHNAALRLYAGAGIVSGSDPEQEWQEIENKAAGLRSLLLRD

SEQ ID NO: 9760 - protein, 273 aa, Enterobacter cloacae
RRAEAATSACAGESPVILAGVSQPGNPGYPWLVFLHGFSGDCREWQAVGASLHDYPRLYIDLPGHGGSADTGVTGFAEVSELLSHTLVSYNILRYWLVGYSLGGRIAMFHACQHPAGLDGVIVEGGHPGLQDADARQARLISDRRWASRFRSEPLEAVFADWYQQPVFASLTDDQRRALIALRSRNNGPRLAEMLEATSLAVQPDLRPALIARDFSFDYLYGERDGKFAAIATELNATRHAIPHAGHNAHRDNPEAVAASLAQILRYRTKDTL

SEQ ID NO: 9761 - protein, 538 aa, Enterobacter cloacae
ANADRQPRQGARAGCGGPCRRADGGDQFIHRIQPRPDAAGAHRCMVNAGHRSRSRYAKPDAGPADSPVAWQHLAVPRRRGAGAIAMSFTDWPWRHWRTRRADKPALRLDDVTLSWTQLGKRIDRLAAGFQSQGVADGDGVMLLAHNHPQTLLAWLALLQCGARILPVNPQLPRPLLDVLLPQMTLRFALVLNGEYDGLPALALREGEGQGGVTWRAERLASMTLTSGSTGLPKAAVHTCAAHLASAKGVLALMPYGDSDDWLLSLPLFHVSGQGILWRWLQGGGRLTVREKQPLEQALQGCTHASLVPTQLWRLLNSHHPVALKAVLLGGAEIPVALTEQAREQRIRTFCGYGLTEFASTVCAKEADGAPDVGSALPGRDVQVVNGEVWIRAESMAAGYWRDGALLPLVNAQGWFATRDRGEWHDGRLTILGRMDNLFFSGGEGIQPEALERVIATHPQVSQAFVVPLDDAEYGQRPVAVVECEPGTDITLLPEWVQGRLARFEQPVHWLTLPSELKNGGIKISRQALKQWVNALLRG

SEQ ID NO: 9762 - protein, 170 aa, Enterobacter cloacae
DREQTNHHDDKLHAVGEMNAVEGKTINPGVGIHADGGQTEANQRRQKRLQRILRHHAAETGDGEHHQGKILGRTKRQRPLGQRRGEEDDAANGDQGAKERADGGNRERHAAASLLRHWIAIQRGHNGGGIAGHVKQNRGNTPPVFAADINRRQQDQRRFRRQVQRKGQRQ

SEQ ID NO: 9763 - protein, 242 aa, Enterobacter cloacae
NNNLSFPFHCDTNFTGCDMRLLLAEDNRELAHWLEKALVQNGFAVDCVNDGRAADHLLQGENYAVAILDIGMPGFDGLEVVHRLRKRGQTLPVLFLTARSNVADRVKGLNAGADDYLPKPFELEELDARLRALLRRSEGRTQERQRLGELEYDDEGFFLLRDEPLSLTPRELSLLKVLMHRRTRPVSRQQLFDQVFSLNDDVSPESIDLYIHRLRKKLTGSGVRITTLRGLGYVLECGDEVG

SEQ ID NO: 9764 - protein, 121 aa, Enterobacter cloacae
RRKQPVMIEGDDVLLGELCANLLENAIKYTPEQGIVTVYLRTANDAVELSVEDSGPGIAEDQISQAMLPFHRLENVGDAAGSGIGLALANDIARLHRSHLQLMPSENLGGLSVKMRFLMLI

SEQ ID NO: 9765 - protein, 223 aa, Enterobacter cloacae
MPILSNRYKLIACRTWSPLITQAGRLKSRGFWTSLNKLCGITTMKKVALMGLSGLMFVSAAANAISFNGSAGQDYTHLGFGLGTDSAGLAMTGGWTHNDDDGDAASLGLGFNVPLGPFLATVGGKGIYTNPNDGDEGYAAAVGGGLQWKIGDSFGLFGEYYYSPDSLSSGIDSYQEANAGARWTIMRPITIEAGYRYLNLAGKDGNRDNALADGPYVGVSAGF

SEQ ID NO: 9766 - protein, 456 aa, Enterobacter cloacae
KATEAVMLSIFKPAPHRARLPEAEIDPLYRRLRWQIFLGIFFGYAAYYLVRKNFALAMPYLVDQGFSRGDLGFALSGISIAYGFSKFIMGSVSDRSNPRVFLPAGLILAAAVMLFMGFVPWATSSIAIMFVLLFLCGWFQGMGWPPCGRTMVHWWSQKERGGIVSVWNCAHNVGGGLPPLLFLLGMAWFNDWHAALYMPAFGAILVAIIAFALMRDTPQSCGLPPIEEYKNDYPDDYSEKHEEELTAKQIFMKYVLPNKLLWYIAVANVFVYLLRYGILDWSPTYLKEVKHFALDKSSWAYFLYEYAGIPGTLICGWMSDKVFKGNRGATGVFFMTLVTIATVVYWLNPPGNPSVDMACMIIIGFLIYGPVMLIGLHALELAPKKAAGTAAGFTGLFGYLGGSVAASAIVGYTVDFFGWDGGFMVMIGGSVLAVLLLVVVMIGEKRHHAEVLARRQ

SEQ ID NO: 9767 - protein, 147 aa, Enterobacter cloacae
AMSMSTSTEVIAHHWAFAIFLIVAIGLCCLMLVGGWFLGGRARARHKNTPFESGIDSVGTARLRLSAKFYLVAMFFVIFDVEALYLFAWSTSIRESGWVGFVEAAIFILVLLAGLVYLVRIGALDWTPVRSRREHINPENSISNRQQ

SEQ ID NO: 9768 - protein, 229 aa, Enterobacter cloacae
QRGNKMDYTLTRIDPNGENDRYPLQKQEIVTDPLEQEVNKSVYMGKLEHAMHDMVNWGRKNSIWPYNFGLSCCYVEMVTSFTAVHDVARFGAEVLRASPRQADLMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRANMQSERERKRGERIAVTNLRTPDEI

SEQ ID NO: 9769 - protein, 451 aa, Enterobacter cloacae
PAGAVQMKTVIRTAETHPLTWRLRDDKQPVWLDEYQSKNGYAGARKALGGMAPDDIVNAVKESGLKGRGGAGFSTGLKWSLMPKDESMNIRYLLCNADEMEPGTYKDRLLMEQLPHLLVEGMLISAFALKAYRGYIFLRGEYIEAAENLRRAIAEATEAGLLGKNILGTGFDFELFVHTGAGRYICGEETALINSLEGRRANPRSKPPFPASSGVWGKPTCVNNVETLCNVPAILANGVEWYQGISSSKDAGTKLMGFSGRVKNPGVWELPFGTTAREILEDYAGGMRDGLKFKAWQPGGAGTDFLTEAHLDLPMEFESIGKAGSRLGTALAMAVDHEIGMVSLVRNLEEFFARESCGWCTPCRDGLPWSVKILRAIERGEGQPGDIETLEQLCRFLGPGKTFCAHAPGAVEPLQSAIKYFRDEFEAGIKQPFSNTHSINGIQPNLLKARW

SEQ ID NO: 9770 - protein, 919 aa, Enterobacter cloacae
RSVSAEPTGSMLMATIHVDGKEYEVNGADNLLEACLSLGLDIPYFCWHPALGSVGACRQCAVKQYQNAEDTRGRLVMSCMTPAAEGTFISIDDEEAKQFRESVVEWLMTNHPHDCPVCEEGGNCHLQDMTVMTGHSFRRYRFTKRTHRNQDLGPFISHEMNRCIACYRCVRYYKDYADGQDLGVYGAHDNVYFGRPEDGTLESEFSGNLVEICPTGVFTDKTHSERYNRKWDMQFAPSICQQCSLGCNTSPGERYGELRRIENRYNGTVNHYFLCDRGRFGYGYVNLKDRPRQPVQRRGDDVITLNAEQAMQGAADILRQSKKVIGIGSPRASIESNFALRELVGAENFYTGIAQGEQERLQLVLKVLREGGVHTPALREIESYDAVLVLGEDLTQTGARAALAVRQAVKGKAREMAAAQKVADWQIAAILNIGQRAKHPLFVTNVDNTRLDDIAAWTYCAPVEDQARLGFAIAHALDNNSPAVELDRDLQNKVDVIVQALAGAKKPLIISGTNAGSAEIIQAAANVAKALKGRGADVGVTMIARAVNSIGLGMIGGGSLEDALSELESGAADAVVVLENDLHRHASAARVDAALSRAPLVMVIDHQRTAIMDKAHLVLSAASFAESDGTVINNEGRAQRFFQVYDPAYYDSNTVMLESWRWLHSLHSTVQSREVDWTQLDHVIDAVVEKLPQLAGIKDAAPDASFRIRGQKLAREPHRYSGRTAMRANISVHEPRQPQDKDTMFAFSMEGNNQPSAPRSQIPFAWAPGWNSPQAWNKFQAEVGGHLRHGDPGVRLIEASETGLDFFTTVPASFQAQEGHWRIAPYYHLFGSDEMSQRSPVFPQRMPQPYIKLNPADAAKLGVNAGANIAFSYDGQTISLPLIISERLSAGQVGLPMGMPGIAPVLAGAHLDNLQEAKA

SEQ ID NO: 9771 - protein, 616 aa, Enterobacter cloacae
VAWMNMLALTIIFPLIGFVLLAFSRGRWSENLSATVGIGSIGLAALVTAYAGIDFFNNGRQAYSVPLWNWMSVGNFNIGFNLVLDGLSLTMLSVVTGVGFLIHMFASWYMRGEEGYSRFFAYTNLFIASMVVLVLADNLLLMYLGWEGVGLCSYLLIGFYYTDPKNGAAAMKAFVVTRVGDVFLAFALFILYNELGTLNFREMVELAPAHFEAGNNMLWWATLMLLGGAVGKSAQLPLQTWLADAMAGPTPVSALIHAATMVTAGVYLIARTHGLFLMTPEILHLVGIVGAVTLVLAGFAALVQTDIKRVLAYSTMSQIGYMFLALGVQAWDAAIFHLMTHAFFKALLFLSSGSVILACHHEQNIFKMGGLRKSIPLVYVCFLVGGAALAALPLITAGFFSKDEILAGAMANGHINLMVAGLVGAFMTSLYTFRMIFIVFHGKEQIHAHAGKGITHHLPLIVLLVLSTFVGAMIVPPLQGVLPATTELEHGRVLTLEITSGVVAIAGILIAAWLWLGKRTLVTAVANSAPGRLLGTWWYNAWGFDWLYDMIFVKPFLGIAWLLKRDPLNSLMNIPAILSRFAGKGLLFSENGYLRWYVASMSIGAVVVLALLMVLR

SEQ ID NO: 9772 - protein, 511 aa, Enterobacter cloacae
IAMLLPWLILIPFIGGFLCWQTERFGVKMPRWIALITMGLTLALGLQLWLQGGYSLTQSAGLPQWQSEFILPWIPRFGITIHLAIDGLSLLMVVLTGLLGVLAVLCSWREIEKYQGFFHLNLMWILGGVIGVFLAIDMFLFFFFWEMMLVPMYFLIALWGHKASDGKTRITAATKFFIYTQASGLVMLIAILALVFVHYNATGVWTFNYEDLLKTPMSHGVEYLLMLGFFIAFAVKMPVVPLHGWLPDAHSQAPTAGSVDLAGILLKTAAYGLLRFSLPLFPNASAEFAPIAMWLGVIGIFYGAWMAFTQYDIKRLIAYTSVSHMGFVLIAIYTGSQLAYQGAVIQMIAHGLSAAGLFILCGQLYERLHTRDMRMMGGLWGKMKWLPALSMFFAVATLGMPGTGNFVGEFMILFGSFNVVPTITVISTFGLVFASVYSLAMLHRAYFGKAKSEIAAQELPGMSLRELFIILLLVVLLVLLGFYPQPILDTSHSAMGNIQQWFVNSASTTRP

SEQ ID NO: 9773 - protein, 487 aa, Enterobacter cloacae
FAMTITPQQLIALLPLLIVGLTVVVVMLSIAWRRNHFLNATLSVLGLNAALVSLWFVGQAGAMDVTPLMRVDGYAMLYTGLVLLASLATCTFAYPWLEGYNDNKEEFYLLVLIAALGGILLANANHMAALFLGIELISLPLFGLIGYAFRQKRSLEAAIKYTILSAAASSFLLFGIALLYAQTGNLSFLAIGKSLGDGMMHEPLLLAGLGMMIVGLGFKLSLVPFHLWTPDVYQGAPAPVSTFLATASKIAIFGVVMRLFLYAPVGDSEAVRVVLGIIAFVSIIFGNLMALSQTNIKRLLGYSSISHLGYLLVALIALQSGEMSMETVGVYLAGYLFSSLGAFGVVSLMSSPYRGPDADSLFSYRGLFWHRPILSAVMTVMMLSLAGIPMTLGFIGKFYVLAVGVQAGLWWLTAGVVIGSAIGLYYYLRVAVSLYLSAPQQLNRDAPSNWQYSAGGIVVLISALLVLIFGIYPQPLIDIVQRAMPLM

SEQ ID NO: 9774 - protein, 112 aa, Enterobacter cloacae
LPDWCTNMEKNMSFQSWDTRVDDDLTLLSETLEEVLRSSGDPADQKYIELKARAEQALHDVKNRVSNASDNYYYRAKQAVYRADDYVHEKPWQGIGVGAAVGLVLGLLLARR

SEQ ID NO: 9775 - protein, 588 aa, Enterobacter cloacae
GINTDSCNPDSYQNSDFFYYLYCVAFLILDNLMSVSSFNRRWAAVILEALTRHGVRHVCIAPGSRSTPLTLAAAENRAFIHHTHFDERGLGHLALGLAKVSKAPVAVIVTSGTAVANLYPALIEAGLTGEKLILLTADRPPELIDCGANQAIRQPGIFASHPSQTVSLPRPTQDIPASWLVSTLDHAMNALRSGGLHINCPFAEPLYGEMNDTGLVWQQQLGDWWESEKPWLREQTHLESAKQRDWFFWRQKRGVVIAGRMSAAEGKLAAEWAQTLGWPLIGDVLSQTGQPLPCADLWLGNAKAVTELAQAQIVVQLGSSLTGKRLLQWQATCTPEEYWLVDPLEGRLDPAHHRGRRLVSDINSWLELHPAEKRKPWAVEIPALSRQAWELTKAQCEAFSEAGLAHRIRKYLPEQGQLFVGNSLVVRLIDAFSQLPAGYPVYSNRGASGIDGLISTAAGVQRASAKSTLAIVGDLSALYDLNALALLRQASAPFVLIIVNNNGGQIFSLLPTPQSERERFYLMPQNVQFEHAAAMFSLKYHRPENWDALETALNTAWRQPGATLIELVVNDADGAQKLQHLLAQVSHL

SEQ ID NO: 9776 - protein, 355 aa, Enterobacter cloacae
RHHAVLYDRRGSGRAQRVQRKTPARLQQIQTEPVMRRVQVYRWQIPMDAGVVLRERRLKTRDGFFVHLREGEREGWGEIAPLPGFSLETLDEAQAALMAWTHAWREGEDPALPDVPSVAFGISCALAELDGSLPEAANYRAAPLCTGDPDELFALLSAMPGEKVAKIKVGLYEAVRDGMVVNLLLEAIPDLHLRLDANRAWTPLRAQQFAKYVNPAYRSRIAFLEEPCKTRDDSRAFARETGIAIAWDESLREADFAFAAEPGVRAVVIKPTLTGSLDKVREQVAAAHAAGLTAVISSSIESSLGLTQLARIAAWLTPDTVPGLDTLNLMQAQLIRQWPGSTLPCLDVGALEPLR

SEQ ID NO: 9777 - protein, 373 aa, Enterobacter cloacae
PAAACGSPPSGGWATCWSAAMKWVKPQSLYLQLLLFLGLPLLLLWGLSAFNSYVSALQAATQAYDRTLLSSARTVSERLVVHNGKLQVNVPWVVLDSFELNMNDRLYYKVVDPDGRTISGYDDLPNMPPSTSRTSHYPALAWFYHTEYRGQAIRVAKLLQPVNEDSVFGMAEIYVAETLQSRRYLATQLLFSSLVSQGLLVLLTLVLTAWLLRRVLRPMRQLSSLMVRREPGLLAPLPELLPWSETRLLIVAFNRYIDRLRGVLSRQARFNADASHQLKTPLAVLKTQVSVALTRNDPALWQESLRAMNVTLDNTIVLTERLLQLSAVKRKEQGERQFAPVDLVQVVQNCCFSRLAQARSKGIDLGYDGVSSR

SEQ ID NO: 9778 - protein, 406 aa, Enterobacter cloacae
PLKWENTMINVEMLSTGDEVLHGQIIDTNAAWLADLFFEQGLPLTRRNTVGDNLESLVNVLRERSERCDVLIVNGGLGPTSDDLSALAAATAKGEGLVLHEAWLAQMERFFSERGRVMAPSNRKQAEIPASAELIDNPVGTACGFAVQLNRCLMFFTPGVPSEFKVMVEQQILPRLRARFTLPEPPLCLRLTTFGRSESDLAQSLDHLQLPPGVSMGYRSSMPIIELKLTGPASEKAAMLALWPEVRRVAGESLIFEGTKGLPAQIAAHLQSRQLSVTLSEQFTGGLLALQLTRAGAPLLASEVVPFQQETLAQTARWASERRVKHFAGLALFVGGLDEEHLNFALATPEGTHALRVRMSITRHSLAVRQEVCAMMALNMLRRWLNGKEVASEHGWINVVESLFVE

SEQ ID NO: 9779 - protein, 878 aa, Enterobacter cloacae
MSDLAREITPVNIEEELKSSYLDYAMSVIVGRALPDVRDGLKPVHRRVLYAMNVLGNDWNKAYKKSARVVGDVIGKYHPHGDIAVYGTIVRMAQPFSLRYMLVDGQGNFGSIDGDSAAAMRYTEIRLAKIAHELMADLEKETVDFVDNYDGTEKIPDVMPTKIPNLLVNGSSGIAVGMATNIPPHNITEVINGCLAYIDDEDISIEGLMEHIPGPDFPTAAIINGRRGIEEAYRTGRGKIYIRARAEVEADAKTGRETIIVHEIPYQVNKARLIEKIAELVKEKRVEGISALRDESDKDGMRIVIEIKRDAVGEVVLNNLYSQTQLQVSFGINMVALHHGQPKIMNLKEILSAFVRHRREVVTRRTIFELRKARDRAHILEALAVALANIDPIIELIRRAPTPAEAKASLVARSWDLGNVAAMLERAGDDAARPEWLEPEFGVRDGQYYLTEQQAQAILDLRLQKLTGLEHEKLLDEYKELLEQIAELLHILGSAERLMEVIREELELVRDQFGDERRTEITANSSDINIEDLINREDVVVTLSHQGYVKYQPLTDYEAQRRGGKGKSAARIKEEDFIDRLLVANTHDTILCFSSRGRLYWMKVYQLPEASRGARGRPIVNLLPLEANERITAILPVREYEEGVNVFMATASGTVKKTALTEFSRPRSAGIIAVNLNEGDELIGVDLTSGSDEVMLFSAAGKVVRFKENAVRAMGRTATGVRGIKLAGEDSVVSLIVPRGEGAILTVTQNGYGKRTAESEYPTKSRGTQGVISIKVTERNGSVVGAVQVDDADQIMMITDAGTLVRTRVSEISVVGRNTQGVILIRTAEDENVVGLQRVAEPVDDEELDSIDGSVAEGDDEIAPEADIDDEAADDADE

SEQ ID NO: 9780 - protein, 956 aa, Enterobacter cloacae
PRRRSLAPLKYLVSFRTTLKVSRYLFRALALLLWLLVALLSVFYIVNALHQKEAEIRQEFNLSSDQAQRYIQRTSDVMKELKYIAENRLTAENGILAIRGRDEKTEVPDFEPLFPDSDCSAMGKAWRGSLESLSWFMRYWRDNFSAAYDLNRVYLISNENLCMADFGLRDMPVEREDALKSLHERIVKYRNAPQEERGNNIFWISQGPRMGVGYFYALTPVYLGNRLQALLGIEQTIRMENFFTPGSLPMGVTILDENGHPLISLTGPENRLKVEPSWMQERSWFGYTSGFRELVLKKSLPPSSLSIVYSLPVDKVLERIRILILNAILLNIAVGVALFMLARMYERRIFIPAEADAQRLEEHEQFNRKIVASAPVGICILRTQDGTNILSNELAHNYLNMLTHEDRQRLTQIICGQQVNFVDVLTSTHTNLQISFVHSRYRNENVAICVLVDVSARVKMEESLQDMAQAAEQASQSKSMFLATVSHELRTPLYGIIGNLDLLQTKELPKGVDRLVTAMNNSSSLLLKIISDILDFSKIESEQLKIEPREFSPREVMNHICANYLPLVVRKQLGLYCFIEPDVPLTLHGDPMRLQQVISNLLSNAIKFTDIGCIVLHVCRAGEYLTIRVRDTGVGIPAKEVVRLFDPFFQVGTGVQRNFQGTGLGLAICEKLISMMDGDISVDTEPGMGSQFTIRIPLYSAHYPAKTTVDGLSDKHCWLAVHNASLHDFLTSMLTSSGVRVSRYEGQTPGADDMLITDVEPEQAWAGRGVVMFCRRHIGIPLERSPGVWVHSVATPHELLGLLARIYSVQLEDSDGATVLASPDELASVNDDMMILVVDDHPINRRLLADQLGSLGYQCKTANDGVDALNVLSKNHIDIVLSDVNMPNMDGYRLTQRIRQLGLTLPVVGVTANALAEEKQRCLESGMDSCLSKPVTLDVLKQTLSVYAERVRKARQ

SEQ ID NO: 9781 - protein, 178 aa, Enterobacter cloacae
YRFCYVRCGPLIMHENQQPQTEAFELSEAERAAIEHEMHHYEDPRAASIEALKIVQKQRGWVPDGAIYAIAEVLGIPASDVEGVATFYSQIFRQPVGRHVIRYCDSVVCHITGYQGIQAAIEKKLNIKPGQTTFDGRFTLLPTCCLGNCDKGPTMMIDEDTHSHLTPEAIPDLLEQYK

SEQ ID NO: 9782 - protein, 140 aa, Enterobacter cloacae
CWKAGAGCTLCTAPCRAVKWTGRSSTTLSTRLLRNCLSWRVLKMPRRTQASAFAARNWRVSRTATAVVPRCAPTSACTNRVSRRIKTPCSPSRWKGTTSRLRRVRKSRLHGHRAGTPRRHGTNSRLKWAVTCATAIQACV

SEQ ID NO: 9783 - protein, 216 aa, Enterobacter cloacae
PGNVLRLESVPAADARQLVGNGGCHSLAAAIRGFEIMTLKELLVGFGTQVRSIWMIGLHAFAKRETRMYPEEPVYLPPRYRGRIVLTRDPDGSERCVACNLCAVACPVGCISLQKAETVDGRWYPEFFRINFSRCIFCGLCEEACPTTAIQLTPDFELGEYKRQDLVYEKEDLLISGPGKYPEYNFYRMAGMAIDGKDKGEAENEAKPIDVKSLLP

SEQ ID NO: 9784 - protein, 111 aa, Enterobacter cloacae
RPREKKNGGTRMIPLTHGLILAAILFVLGLTGLVIRRNLLFMLIGLEIMINASALAFVVAGSYWGQTDGQVMYILAISLAAAEASIGLALLLQLHRRRQNLNIDSVSELRG

SEQ ID NO: 9785 - protein, 165 aa, Enterobacter cloacae
YNVMNPRKEKHMIQWQDLHHSELTVQSLYALLKLRCEVFVVEQTCPYQDIDGDDLVGENRHILGWRDNELVAYARILKSEEEFDPVVIGRVIISGRARGEKLGYQLMEKTLDACQKQWPDKALYLGAQAHLQSFYGHFGFTPVTDIYDEDGIPHIGMAREAKQAQ

SEQ ID NO: 9786 - protein, 68 aa, Enterobacter cloacae
AILTAGWNCIRRKNANPGRWRSRRCHVRRGNSPKRSARRSVKPGWRTVSANIFPSRDNFLSVTAWWCA

SEQ ID NO: 9787 - protein, 322 aa, Enterobacter cloacae
RHASCYPSRRTQRPPGQPGSCCRESGSDTALSNKGHAMIYPDEHMLYAPVEWQDCSEGYTDIRYHKSADGIAKITINRPQVRNAFRPLTVKEMIQALADARYDDTVGVIILTGEGEKAFCSGGDQKVRGDYGGYQDDAGTHHLNVLDFQRQIRTCPKPVVAMVAGYSIGGGHVLHMMCDLTIAAENAIFGQTGPKVGSFDGGWGASYMARIVGQKKAREIWFLCRQYNAQEALDMGLVNTVVPIADLEKETVRWCREMLQNSPMALRCLKAALNADCDGQAGLQELAGNATMLFYMTEEGQEGRNAFNEKRQPDFSKYKRNP

SEQ ID NO: 9788 - protein, 396 aa, Enterobacter cloacae
LLRLGRRLYGDDRRQRAGGSAAGCCDDRRETSPRGSAGASSIRSIAMKLTPLTTGLLLAGLMTGSALAADKIVIAHRGASGYLPEHTLPAKAMAYAQGADYLEQDLVMTKDDQLVVLHDHYLDRVTDVAERFPDRARKDGRYYAIDFTLDEIRSLKFTEGFEIENGKKVQVYPGRFPMGKSDFRIHTFQEEIEFVQGLNHSTGKNIGIYPEIKAPWFHHQEGKDIAAKTLEVLKQYGYTSKKDKVYLQCFDAAELKRIKTELEPKMGMDLNLVQLIAYTDWNETQEKQPDGKWVNYSYDWMFKPGAMKQIAQYADGIGPDYHMLVAEGSTPGHVKLTAMVKEAHASKMQVHPYTVRADQLPPYATDVNQLYEVLYKQADVDGLFTDFPDKAVTFLK

SEQ ID NO: 9789 - protein, 246 aa, Enterobacter cloacae
FVRKMPLALKNTSATLTLTSRACCSKVALYMNNMNVIIADDHPIVLFGIRKSLEQIEWVNVVGEFEDSTALINNLPKLDAHVLITDLSMPGDKYGDGITLIKYIKRHFPDISIIVLTMNNNPAILSAVLDLDIEGIVLKQGAPTDLPKALAALQKGKKFTPESVSRLLEKISAGGYGDKRLSPKESEVLRLFAEGFLVTEIAKKLNRSIKTISSQKKSAMMKLGVDNDIALLNYLSSVTLSATDKD

SEQ ID NO: 9790 - protein, 775 aa, Enterobacter cloacae
GGGYFLFHGQVKTHMNQSLLVTKRDGTTERINLDKIHRVLDWAAEGLNNVSISQVELRSHIQFYDGIKTSDIHETIIKAAADLISRDAPDYQYLAARLAIFHLRKKAYGQFEPPKLYDHVVKMVELGKYDTHLLEDYTEEEFEQMNGFIDHWRDMNFSYAAVKQLEGKYLVQNRVTGEIYESAQFLYILVAACLFSNYPRETRLDYVKRFYDAVSTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQINKLMYTRLLKGEDITLFSPSDVPGLYDAFFADQDEFERLYTKYEKDDSIRKQRVKAVDLFSLMMQERASTGRIYIQNVDHCNTHSPFDPVVAPVRQSNLCLEIALPTKPLDDVNDENGEIALCTLSAFNLGAIKSLDELEELAVLAVRALDALLDYQDYPIPAAKRGAMGRRTLGIGVINFAYWLAKNGKRYSDGSANNLTHQTFEAIQYYLMKASNELAKEQGACPWFNETTYAKGILPIDTYKKDLDAIVSEPLHLDWEGLRESIKTHGLRNSTLSALMPSETSSQISNATNGIEPPRGHVSIKASKDGVLRQVVPDYETLGDNYELLWEMPNNDGYLQLVGIMQKFIDQSISANTNYDPTRFPSGKVPMQQLLKDLLTAYKFGVKTLYYHNTRDGAEDAQDDLAPSIQDDGCESGACKI

SEQ ID NO: 9791 - protein, 406 aa, Enterobacter cloacae
PSPTGRGNSFPLSLWERAGVRGNNTTGLTAMAYTTFSQTKNDQLKEPMFFGQPVNVARYDQQKYDIFEKLIEKQLSFFWRPEEVDVSRDRIDFQALPEHEKHIFLSNLKYQTLLDSIQGRSPNVALLPLISIPELETWVETWAFSETIHSRSYTHIIRNIVNDPAVVFDDIVTNEQIQKRAEGIAHYYDELIEMTSYWHLLGEGTHNVNGKTVTVNLRALKKQLYLCLMSVNALEAIRFYVSFACSFAFAERKLMEGNAKIIRLIARDEALHLTGTQHMLNLLRSGADDPEMAEIAEECKQECYDLFLQAAQQEKEWADYLFRDGSMIGLNKDILCQYVEYITNIRMQAVGLDLPFQTRSNPIPWINTWLVSDNVQVAPQEVEVSSYLVGQIDSEVNTDDLSDFQL

SEQ ID NO: 9792 - protein, 509 aa, Enterobacter cloacae
LTEHAMDTWIYLSQGFAVAMTPENLVIALIGCFVGTIVGLLPGLGPINGVAILLPLAFALHLPAESALILLATVYIGCEYGGRISSILLNVPGDAAAIMTALDGYPMAQQGRGGVALSISAVSSFFGSLIAIGGIILFAPALAQWSLAFGPAEYFALMVFAIACLGSMMAQNPLKSFLSALIGLSLATVGVDANTGVYRFTFDSVHLSDGVQFIVVVIGLFSVSEILLMLEHTSSGQTLVRKTGRMLFNAKEGAQCVGATLRSSVIGFFVGILPGAGATIASAITYMTEKKLSGNSDSFGKGDIRGVAAPEAANNASACGSFIPMLTLGVPGSGTTAVMMGALTLYNITPGPAMFTEQPDIVWGLIAALLIANVMLLVMNIPLIGLFTRMLTIPLWFLVPAIAAVSAVGVYAVHSTTFDLVLMVLLGVLGYILRKMHFPMSPLILGFVLGEMLEQNLRRALSISNGNMGILWESSVTKILLAMAIMVIVVPPVLRWIRRRQHKPQPDIG

SEQ ID NO: 9793 - protein, 349 aa, Enterobacter cloacae
AGRRVTARSVRCGVDLATGSCVSPSWGSSRYTKPLPIRQRADCVMELIFLGTSAGVPTRSRNVTAILLDLKHPTRGGLWLFDCGEGTQHQMLHTSYHPGKVDKIFITHLHGDHLFGLPGLLCSRSMAGNANPLTIYGPAGIQEFVETTLRLSGSWTDYPLEVVEIGEGLVFDDGDYQVRAYPLNHPVECYGYRVEEHDKPGALNAAALQADGVKPGPLFQRLKHGETVTLEDGRVINGQDYLAPPQPGKKLAIFGDTAPCPSALRLAGGVDVMVHEATLEAAMEEKANSRGHSSTRQAAQLAREAGVRKLIVTHVSSRYDVRGAESLLAECREVFPACELAEDFAQVSV

SEQ ID NO: 9794 - protein, 247 aa, Enterobacter cloacae
GVKAPMNAEKSPVAHNVDHEEIAKFEAVASRWWDLEGEFKPLHRINPLRLGYIAERSGGLFGKKVLDVGCGGGILAESMAREGATVTGLDMGFEPLQVARLHALESGIQVEYVQETVEEHAAKHAHQYDVVTCMEMLEHVPDPQSVVSACANLVKPGGQVFFSTINRNGKAWLMAVVGAEYVLRMVPKGTHDVKKFIKPAELLGWVDQTWLKEQHMTGLHYNPLTDKFKLAPGVDVNYMLHTTAKND

SEQ ID NO: 9795 - protein, 66 aa, Enterobacter cloacae
KPLTSWRKSKARARGSTKPLTRKAFCRSTPIKKTWMRSSASRCTSTGKACASPLKLTACVTPRSLP

SEQ ID NO: 9796 - protein, 95 aa, Enterobacter cloacae
CRPRPLRRSPTPLTVLSHRAGTSALKRRKTACCVRWYRITKRWVTTTSCCGKCQTTTATSNWWVSCRSLSTSRSLPILTTTRRASRPARYRCSSC

SEQ ID NO: 9797 - protein, 552 aa, Enterobacter cloacae
MLKNEHRGKAMTIHDPRYSDVIIIGGGATGAGIARDCALRGLSVTLLERHDIATGATGRNHGLLHSGARYAVTDGESARECIAENQILKRIARHCIEPTDGLFITLPEDDLAFQSTFITACTAAGIQAEAMDPALARRLEPSVNPTLIGAVKVPDGTVDPFRLTAANMLDAREHGAQILTGHHVTGLIREGNTVRGVRVFDAQYNEHRELYAAVVVNAAGIWGQRIAEYADLSVRMFPAKGSLLILDHRINNHVINRCRKPSDADILVPGDTISLIGTTSMHVDYSEIDYNRVTAEEVDILLREGEKLAPVMAQTRILRAYAGVRPLVASDNDPSGRNVSRGIVLLDHAERDGMDGFITITGGKLMTYRLMAQWATDAVCRKLGNTAPCVTAEQALPGSQQSTEKTLHKIISLPAPLRGSAIYRHGDRTPTWLGEGRLSRSLVCECEAVTAGEVQYAVENLTVNNLLDLRRRTRVGMGTCQGELCACRAAGLLQRFHATTSTQSLAQLSDFLNERWKGIQPVAWGDALRESEFTRWVYQGLCGLEKEHNHEI

SEQ ID NO: 9798 - protein, 439 aa, Enterobacter cloacae
KSLRHRLGSGRVRSRGAGLRWRRLRRHRAACRGADYPAQGESTMNDTRFESCIKCTVCTTVCPVSGVDPRYPGPKQAGPDGERLRLKDGALYDEALKYCINCKRCEVACPSDVKIGDIIQRARARYSTQKPTLRDAILSHTDLMGSLSTPFAPVVNAATALKPVRRLLDATLKIDHHRSLPKYSHGTFRRWYKSVAAEQAQFAEQVAFFHGCYVNYNHPQLGKDLLKVLNAMGTGVQLLSKEKCCGVPLIANGFIDKARKQASSNVTSLREAIVDKGIPVLATSSTCTFTLRDEYPHLLDVDNTGLREHIELATRFLWRKLDSGQTLPLGKLPLKVVYHTPCHMEKMGWSIYTLELLRLIPGLELTVLDSRCCGIAGTYGFKRENYPTSQAIGAPLFRQIEESGADIVVTDCETCKWQIEMSTSKRCEHPITLLAKALA

SEQ ID NO: 9799 - protein, 343 aa, Enterobacter cloacae
KASISLEGRMDNFQKDIDDRANLTLSNRFELLLFRLGTSLNENKSELFGINVFKLREIVPMPTFTKPAGMKSPLMGMVNIRDQVIPVIDLAAVAGCKPATGLNILLITEYARSVQAFAVESVENIMRLDWKQVHAAETAVSGRYITSIACLDEKTDTNDLAMVLDVEQILYDITPANHDLHATHLETTKFNIKPGSVAIVAEDSKVARSMLEKGLQAMEIPAQLHITGKDAWEKITQLAAQAQAEGVPVTDKIALVLTDLEMPEMDGFTLTRKIKTDPVLKDIPVVIHSSLSGNANEDHIRKVKADGYVAKFELNELSSVIEEVLDRSMKKIEGPLISRKQLA

SEQ ID NO: 9800 - protein, 181 aa, Enterobacter cloacae
YVSWNNWGASCITPDERFASQEFDLFLTDNPSNLTASGLLLSDDEPGVRKIGPGQLRVNFNMSNAMQEAVLQLIEENLAQEEILESPLGGDENAELHASGYYSLFVDTVPDDVKRLYTESAAQDFAALAQTAHRLKGVFAMLNLVPGKQLCETLEHLIREKDASGIEKYISDIDAYVKSLL

SEQ ID NO: 9801 - protein, 350 aa, Enterobacter cloacae
LGWVFTFRRTFTVAVLGDGQDCAFATRNDQGNNGVFTRQLDTTHAGRRTTHCAHGVLFKAHHFTGGREEHHFIRTGRQIHADQFVAFVQVHRDNPGRTWTAELGQCGFLHGTARGRHKDVHALFVLAYRQYGGDTFVRFQRQQVDDWTSTRATACFRQLIDFHPVQTAPAGEAEDRVMGVRHQQTINEVFFFNTRRRFAFTAPTLSFVVGQRLILHVALVRQRHYHVFAVDQIFNVDIRAVGRDFGATLIAELIANQLQLFTDHFHQALCATQDMQQLGNLLQQLFVLVEQFFMLKAGQFLQTQIQNRLGLLFSQVVLTVTHAEFRLQPLRTRSVIAGTFQHRRHVAQIP

SEQ ID NO: 9802 - protein, 364 aa, Enterobacter cloacae
TRNQRRLRFCWRRRTADQLDDRVDVRQRNGQCFKDMGTVARFAQFEDGTASHHFTAVTHERAQDLFQVHDLRLAMVQRNHVDTEGDLKLSLGVKVVQHNFTHRVALDFNHDAHTVFVRLVTQRADAFNAFFFYQLGDFFNQSRFVHLIRDLVNNNGFTAGFGVRFHFGAGTDVNLAATGTVRFFNTATAIDDCRRREVRARDVFHQPFNADVFIVNVGQAAVDHFRDIVRRNVGCHTDGDTGRTVHQQVWDLRWHDVRNFFRAVVVINEINRLFFQVSHQLMGNLRQTDFRITHCRGGVAVDRTKVTLTIYQHVTQREGLRHTDNGAVHRDITMRMVFTDYVTNDTGRFFVGFIPVIAQYVHGV

SEQ ID NO: 9803 - protein, 96 aa, Enterobacter cloacae
SQHRRPERLPALMTRVTLSLSGTEVLCQEEHPSLLVALEAHQVEVEYQCREGYCGSCRCRLVAGQVDWLTEPLAFISEGEILPCCCRAKGDIEIEM

SEQ ID NO: 9804 - protein, 442 aa, Enterobacter cloacae
TSAGKAFSPSPGAMPCAKANLPAGSIRGFAVWRRSTTMKFDTVIVGGGLAGLLCGLKLTQRGLRCAIVTRGQSALHFSSGSLDLLGALSFADLPPEHPYRLTGAENMARFACETEHLLTACGARMQGDAEQNHQRVTPLGTLRAAWLSPEEVPVAPIAAERVRVVGISGFLDFQPHLAAASLRQQGVQVDTAEIDLPELDVLRENPSEFRAVNIARLLDNESYWPQLYAALQPLGETCDALFMPACFGLTDNRLWRWLSARLPCTLGLLPTLPPSVPGIRLHTQLQRQFVAQGGVWMAGDEVKKITLVEGAVSDIWTRNHGDIPLRARYTVLASGSFFSNGLLSSRDGVREAILGLDVRQSASRADWYQSDFFTPQPWQQFGVIVDSQLRPRLGGEPVENLYAIGSVLGGYDPVAQGCGGGVCAVTALHVAEQIIQRRERAQ

SEQ ID NO: 9805 - protein, 327 aa, Enterobacter cloacae
TMKKQLLSTLAASVLLLSASVVQAQDAPSRTECIAPAKPGGGFDLTCKLIQVSLLETKAIEKPMRVTYMPGGVGAVAYNAIVAQRPAEAGTVVAFSGGSLLNLSQGKFGRYDVNDVRWLATVGTDYGMIAVRADSPWKSLKDLLTAMEKDPNSVVIGAGASIGSQDWMKAALLAQQAKVDPHKMRYVAFEGGGEPVTALMGNHVQAVSGDLSEMVPYLSGDKIRVLAVFSENRLPGQLADVPTAKEQGYNLVWPIIRGFFVGPKVTDAEYQWWVDTFAKLQQTEEFKKQRDLRGLFEFNLNGKQLDEYVKKQVNDYRVQAKAFGLAK

SEQ ID NO: 9806 - protein, 255 aa, Enterobacter cloacae
RYQDSRQRRKGRVKKVSEVLHWTPDHAEHKGKMMKSDYAKQIELISGPLEAAMEALAGTLSANQEIVLHNLTTPEQSVVKIINGHVSGRKAGDNLLSGPEKDKGFALLLKNNKDSTPVTVKNYKTTTASGRILNSASTIYYSEEGVPLMAFCINIDTSPYEQMRKCLDAITGSPLADSDPQDMNLGGIIEQSIQEIIDKHSVPGKKVQKAQRLKIVAEMHAKGIFKMRGGVQHAAQALGVTRYTVYNDLEVMGEK

SEQ ID NO: 9807 - protein, 115 aa, Enterobacter cloacae
DLLMTLTKSFAALMVAVSIEVIATTLLSLSNSFQRPVVGLSAIISYGLSYYFLSIALRRIHLGVAYAIWSAVGLFSMTVIQTRFFDYIVSQRAWMGLGMVIAGTITLNLAIKQNK

SEQ ID NO: 9808 - protein, 820 aa, Enterobacter cloacae
KAAFWKRSELAASSPGWRSSPFNRRNGMTTEMLSLRVVQLREAYLQAKPFVSAHRAVSVTQVYKDNPGMNNSLLRALAFRRACETAPLHVAQNELIVSHPAGGARGGEVSPEISWRWLADELETLPARAQDPYQIDEETKRLLREEVFPYWQGRSLDEMAQTQLKTHGLWHWCHDDGICDVTIKTQNGGGDSCPGYDNILLTKGIKGIREEAAALLLALDPATPEGCDAFNFYTAMLHTCDGVVTYARRYAHYLNALAEKEGDPLRRDELLQLSGICSRVPEQPPQHFHDALQAIWFVHSLFMLEENQTGISLGRVDQYLWPLLERDLHDGTLNLQQAEELLCCWLIKMAETLWICSESTAMYFAGYQPFINLVVGGQKREGGDATNPLTLMIMDCSARLKIYQPGLAVRIHNQSPQPFMRKVVDVVRSGMGFPACHFDDAHIRMMLHKGFSYEDARDYCLMGCVEPQKSGKMYQWTSVGYTTFTAAIELALHNGRTQNGKQCGPATGDVSQFSRYEEVESAVRTQLSAIVRKAAEATLIVQKLHAEHARKPLMSCLIEGCIATAKDVTQGGARLNAGPGLIWTGLADCVNSLMAIRTLVFDTARFTLRQLVEALEHNFVGYQEILTACQRAPKYGNDIREVDDIARELVRFLEQEHRQYRMLYAPFAFGTLSISNNTPFGLITGALPSGRLAGKPLADGISPAQQTDYLGPTAIINSVSRINVEEMDIGMVHNIKLMFGMLETPEGQNSLIHLLRTASILGNAQLQFSYVDDETLRKAQKHPADYRNLMIRVAGYSAFFVELSKEVQDEIISRTTQRHF

SEQ ID NO: 9809 - protein, 77 aa, Enterobacter cloacae
GIGIKMKKLVAVISLAFVTLTVAGCSSDYVLQKKNGEMIITHGKPEVDDDNGLITYEDVAGNEHAINRDQIIQMIEK

SEQ ID NO: 9810 - protein, 382 aa, Enterobacter cloacae
REGVSAGAERGYGLVRSRYEVAFPPSPSPVGEGVVRAYFQDNDFPMPHLSTRVLQGLLTLLLTLFGLLLVTFALSAFSPVDRVLQIVGDHASQSTYDQVRHQLGLDRPLPVQFWHYLQNLAHGDLGTASATGQPVLQDLLHAFPATLELATLALIIGTVLGVIAGVLCARYAGSPLDLAIRTLTLLGNSVPIFWLGLLMLALFYAKLQWSAGPGRLDDIWQFTVEPRTGFALVDTWLSGDREAFRNAISHLVLPVLLLAYYSLASITRLTRSACLSEMNKEYILLARAKGAGEMTILLRHVLPNIRSTLLTVIALAYTSMLEGAVLTETVFSWPGIGRYLTTALFAGDTTAVMGGTLLIGVCFVLINNLTDLLVRATDPRVR

SEQ ID NO: 9811 - protein, 321 aa, Enterobacter cloacae
LPTACRSFLTSGGLPPFQAGRFCLPAWPLTCWAMACATYWSHSMTEHRVIVDALNIDYPAARVVNNLSFTLGKERLALVGESGSGKSMSARALMGLVRKPGIVSAKRLNVLGNDLLTLNSRRWQALRGNGIAMVLQDPRYALNPVKTVAAQLDEALTLHQRLPRAERLARIHDIIRAVGLNEHVLQRYPGELSGGMGQRVMIAIALVNNPQVLIADEPTSALDARLRNQILELLVQQCEARQMAMLLISHDLPLVAEHCDRVLVMYQGENVDEMAASQLPQATHPYTRTLWTCRPNAGTFGKMLPTLDRSQPWKEDDNGTR

SEQ ID NO: 9812 - protein, 297 aa, Enterobacter cloacae
DVFDMELRYLRYFVAVARERHFTRAAKALGISQPPLSQQIKRLEEEVGTPLFRRLTRGVELTEAGEAFYEDACKILALSDAALEKARGIARGLNGSLSIGITSSDAFHPKIFALIRQFQVQNMAVQVHQVEANMSSLTTMLAEGELDIAFVRLPCESSKVFELKILDREPMMVALHRDHPLAACGDLALEELRDTPVVLFPQEVAPGLYDRVYGSCERAGIDMQHTLQSSQLSSSLSMVSAGGGFALVPKSMAAISPPNVTYHALRSPELYTDIALCWRRFERSRTVKRFLAMMSEG

SEQ ID NO: 9813 - protein, 164 aa, Enterobacter cloacae
ASASSLISSRLNIPARRLASTISPATAFCSSLRQATVGKSSESSTAQRVSRSASTTRCACGTSGSVRRGLARSQTEASGSRWAGNQTTEGSTVAPLTKGASWAFCSTPFCSAQTTVFSSHRARSHPALSAFCVVLTAKKTRSTGRVMTLGSVSTGPGTTISPSS

SEQ ID NO: 9814 - protein, 268 aa, Enterobacter cloacae
WVKNNSSRRIPFYQVDAFSDGPFTGNPAAVCLLDAWPEQKVLQRIATENNLSETAFVVQQDGGFALRWFTPAVEVDLCGHATLAAASVLLSRDDACESVHFFTRSGELTVTSHGEQYTLDFPQAIPSRITAPEGLFKALGLEENAGETWQASDLIVVIDDEDKLDALKPDFTALERFNTRGVVVTASSRTFDFRSRWFGPQVGVNEDPVTGSAHTFLAPLWSQKLSKKRLHAQQGGSRKGELICLIKDNGRIELLGKASLMIEGVFIL

SEQ ID NO: 9815 - protein, 324 aa, Enterobacter cloacae
AKRCRMRLSAERRSGISEQAYGWISNIQRFSLHDGPGIRSIIFFKGCQMRCAWCANPEGQTAERDVFFHADRCLHCGNCADLCPTGLHSMNHNVHVLERDRKCVGCQLCEERCPAAALNIVGEHVSAQNAFERVMADEIWFRQSGGGVTLSGGEVAMQPEFARVLIEQLKAEDIHTAIETAGYASWHAIHQATAGCDLILYDLKSAEDVLHTRFTGVSNKRIVRNLARLLQGGQQIIIRIPVIPHFNDAPDQADKLLALISALTQGKKNFQGVELLPYHLFGTGKYKLLNMEYDWNRGSANVDNFLSMAHHYRLPLKVSGTLAG

SEQ ID NO: 9816 - protein, 533 aa, Enterobacter cloacae
NNHNIFSSGIAMTKKLLPLLVLAALSSAAHAATPPNTLVVAQGLDDIVSLDPAEANELSSIQTVPSLYQRLVQPDRDNPEKITPVLAESWDADAAAKTLTIKLKPDAKFSSGNPLRPEDVIFSYTRAVTLNKSPAFILNVLGWDASNIASQLKKVDDHTLTLHWTADVSPSVALNILSTPIASIVDEKQVAANVKDDDFGNAWLKMHSAGSGAFKMRVYQPHQAIVLEANESAPGGAPKLKSIIIKNVPDPASRRLLIQQGDADVARDLGADQISALSGKPGVKVLSIPSAEQNYLVFNTGNSANPLLNNPAFWEASRWLVDYEGITKDLLKGQYFVHQSFLPVGLPGALEDNPFTFDPAKAKAILAKAGIKDAHFTLDVENKPPFITIAQSMQASFAQGGVKVDLLPAAGSQVYARVRAKQHQAAIRLWIPDYFDAHSNASAFAWNDGKSSTVAGLNGWKIPELNKATLAAVAEPDPAKRLDLYKKMQEQLQHNSPYVFVDQGKTQIVVRDNVKGYQQGLNADMVWYDRVMK

SEQ ID NO: 9817 - protein, 287 aa, Enterobacter cloacae
CIRVRTLMKWRRASCRRQPIPTRARSGPAARTPGRLARCCRRSTVRNRGRRTTMALVEVNQLRVSFGEKTAVSAASFAIEKGETFSLIGESGCGKSTLLRVLAGLLPEWNGHISVLGENLRPGRRFEGALRRNVQMVFQDPWASLHPNHTIARTLSEPLNIHGESQVAEKVADALQQVGLAADAGRRYPHQLSGGQRQRVAIARALLLRPQLLLLDEPTSALDMSVQAEILNLLNRLKAQHGMTYLLVSHDADVIAHMSDRAAFMAHGEIQRVFDREAMLRGEHRMG

SEQ ID NO: 9818 - protein, 90 aa, Enterobacter cloacae
RSDRIDSIKDLHWDIRPSPHISTMQVRSTDKPLTLNNAINIAWLIQATSHWLLTTRPYKHQERDFLRYLFTVFRCVATDRWIFRRAVMRF

SEQ ID NO: 9819 - protein, 178 aa, Enterobacter cloacae
TIRSFQDFLKWSFKQMAIPAYLWLKDDGGADIKGSVDIYGREGSIEIIALNHGIMQPTDKHNGKATSLRIHSPYSFDKEIDASSPYLYKAVSTGQKLKSAEIKFYRINDAGQEVEYFSTLLEGVKIASVCPMMLDIKDPDYEKHNHLELVELLYEKITWRYVDGNIMHSDSWNDRKTA

SEQ ID NO: 9820 - protein, 250 aa, Enterobacter cloacae
QVSAVMMAFTVISFMVRVPVLSEQTTVIAPRVSTVGSLRIIARLRAIACTPRERMMEIIAGRPSGTEATARLIRESSSSPIGISRNTRLKTNSAAIIARMMAKIALPSLSICTSSGVRCFSMPAIIWLMWPSSVSWPVAMTTPTPPPALTVVPEKTRFVRSPSGNSPLSGFVCLSTTVDSPVRIASSTRKLCASIKRISAGIRSPARNTIISPGTISVVGIVSWLPLRITRASLESILRILFRDFSALLS

SEQ ID NO: 9821 - protein, 220 aa, Enterobacter cloacae
HSALQRIKARVSIRAFTIDGRKNLVARPKSEDKKQALLEAATAAFAQSGIAASTALIARNAGVAEGTLFRYFATKDDLLNALYLHLKQDLCQTMLANLDRTITEPKEHTRNIWNSYVDWGIRNPLAHAPIRQIGVSEKLNAETEQAVKDMFPELHELCRRSIRPVFMSDEFKTFGDAMFLSLAETTMEFAARDPSRAVDFKALGFEAMWRGLAEEDNHGQ

SEQ ID NO: 9822 - protein, 483 aa, Enterobacter cloacae
RNGVTMNTSVVSPGRAGLILLLTGQMLPLIDTSITNVALDSITHSLHATATELELIVALYGVAFAVCLAPGSKLGDNLGRRRLFMWGVACFGLASLLCGMAGNIEQLLGARIIQGAGAALIMPQILATLHVTLKGTAHAKAISLFGGIGGIAFIVGQMGGGWLVSADIAGLGWRNAFFINVPICLVVLALSRRYVPETRRDTPSRIDWTGTVLLTAILCCLLFPMALGPQWHWSWPLKAALLAIVPLVCVMVLNARKKERENAHPLIAPRLLQLRSIRFGVLIGILFFSVWSGFMFCMALTMQSGLGMAPWQSGNSFIALGVTYFISAWFAPRLIARYSTSAILLTGLAIQLVGLVALIATFRHWGMQNTALTLAPATGLVGYGQALIVNSFYRIGMRDIQPDDAGAASAILSTLQQAALGLGPAIFGAILLHGLQNHHGDYTQAVNVFLMVETAMMVVLALATLRMRHRLCLPVVKACPATK

SEQ ID NO: 9823 - protein, 142 aa, Enterobacter cloacae
LYCIAESMDGSGNGYRWNNYAQSGDQAKQITPKLNMYIILNCLFWLIISVTMEVTGTLLLPETRNFKNIPLTIHCLTCYVISFYSLSMLMGYISPVMAYSIWAGLGIVLITVMSSLFYRLKSSILEKIGIGCIVTGLAIIAF

SEQ ID NO: 9824 - protein, 292 aa, Enterobacter cloacae
PYRPACAGDRSQGALMPFYLFLRRLRRSPAAFCGLIAIALLVLISLFAPWLAPQDPNWQDAAARLQPPNAQHWLGTDSYGRDLLSRLIYGTRPALGLVALVTVITLPAGLLVGILSGYYGGWMERILMRFSDVVMSMPRLILAFAFVAMLGPGLVNGALALALTTWPAYARQARSEIQRLRHSDYLAAAEMMGIRGPRLLVGHILPLCLPSAIVRLALDLAGIILAAAGLGFLGLGARPPMAEWGAMIADGMQVIFDQWWIAAIPGGAILFASLAFNLLGDGLRDVLEPQHD

SEQ ID NO: 9825 - protein, 379 aa, Enterobacter cloacae
QTTECAMPLPDFKSSEPYTLGIELELQVVNPPGYDLSQDSSALIAAVKDDIKGGEVKHDITESMLEIATGVCQTIDQAAAQFSVMQQSILRAAAEHHIQICGGGTHPFQKWQRQEVCDDERYNVTLERFGYLILQATVFGQHVHVGCRTGDDAIYLLHGLSRFVPHFIALAAASPYMQGTDTKFASSRLNIFSGFPDNGQMPWVNSWQEFEGLFRRLSSTSMIDSIKDLHWDIRPSPHFGTVEVRVMDTPLTLGHAINIAGLIQATSHWLLTARPYKHQERDFLLYRFNRFQACRYGLEGILTDVHTGEHKTVAEDIAWLLEQVAPSAEKLGATSAIKEIALLLKQGKSEAQRMRDFIADGGSLISLVQKHCELWATSP

SEQ ID NO: 9826 - protein, 88 aa, Enterobacter cloacae
LTINITMKHPLESLLTAGGILLMALLSCLLLPAPSLGLVLAEKLVQTFHMVDLNQLYTILFCLWFLVLGAIEFFILRFIWRRWFSLAS

SEQ ID NO: 9827 - protein, 726 aa, Enterobacter cloacae
FYGDSNQGRSIKMFKNNKIMRLWLLSLATTSVAAQAETKEETITVTQGVSEEPTAPVKGIVATKTLSATKTSAEIVKTPQSVSVITRDQMNMQDVTSVSQALRYSAGVFTEYRGSSNRNDEVFVRGFSYVPKFLDGLSFGATASSQTGTVDPWLLERVELVRGPASVLFGQVNPGGLISMTSKRPTAEAIHNVQFRTGNNDLAEGAFDFGGRLSDDGRVLYRVNGIARTQHNQVDDYKETRMAIAPAITWYPNDQTRFTLLTSYQKDPDAGYRNFLPAYGTVKSADGKYIPRDFNVSDPNYNQSWREQTMIGYELEHQFADNLTFRQNARYATIKQKYRYLVYANSAANSTVLTRRAQREARTTNEFGLDNQLEYQLETGSVSHTLLGGFDYKTSKDKQLLARGSGSQYDLDWTNPVYGVNVDESTFKTASDEQQNLDQMGLYLQDQMSWNNWEWLVSGRYDWSEVRTSDFTDNSVTQQNDSKFTWRTGLLYAFDSGLSPYISYSTSFEPNLQTNRAPGVAPFRPTTGEQTEIGVKYQPVDTTLMTLALYDLTQNNVATYNSAEGWFENAGKVRSKGAEAEIHATLMDNINLIGSYTYTDAKTESTTVAGTEGKTPARIPAHMASAFASYTVPGGALKSLTAGVGMRYIGTSYGDAKNTFKVPSVDLYDAMLRYDLGEMNRSLKGASVQFNVNNVADTKYVASCASDTACFYGIGRTVTATVNYSW

SEQ ID NO: 9828 - protein, 192 aa, Enterobacter cloacae
KTCSRNCMNCVVVRSARCLCLTSLRPSVMQCSYRWLKPPWSLPPAIRPVPSILKRWALKPCGAGLLRKITMDSKSLQEHARRVALEMPFTEHCWPFGPEYDVFKVGGKIFMLMATAHGRAHVSLKSDPEKSLLNQQIYRGVEPGYHLNKKHWISLYGTDDITPELVTDLITDSWNLVVDKLPKKDQKWIRPA

SEQ ID NO: 9829 - protein, 257 aa, Enterobacter cloacae
LFVSDEQNKRSNRTYLFPLRAVICFPFTPARGRISSPGVVMDIISVALKRHSTKAFDPAKKLTAEEAEKIKTLLQYSPSSTNSQPWHFIVASTEEGKARVAKSAAGTYVFNERKMLDASHVVVFCAKTAMDDAWLERVVDQEEADGRFATPEAKAANHKGRCYFADMHRVDLKDDDQWMAKQVYLNVGNFLLGVAAMGLDAVPIEGFDAAILDEEFGLKEKGFTSLVVVPVGHHSVEDFNATLPKSRLPLCTIVTEC

SEQ ID NO: 9830 - protein, 433 aa, Enterobacter cloacae
ICIIDPQPPLWGCINTGDVMQELIAQVEELGIEINHTTSLVIIFGIIFLTAIIVHFILHKVVLRAFEKRAQASSHLWLQIITQNKLFHRLAFTLQGIIVNVQAVLWLQKGSEAAELLTTCAKLWVMVYALLSFFSLLDVIFNLSQKMATASQLPLKGIFQGIKLVSAILVGILIISLLIGQSPAILISGLGAMAAVLMLVFKDPILGLVAGIQLSANDMLKLGDWLEMPKYGANGTVTDIGLTTVKVRNFDNTITTIPTWALVSDAFINWSGMSASGGRRIKRSLNIDTTSIHFLDEQEQQKLIQAKLLKPYLAARHEEINLWNQQNGEGESVLNLRKMTNIGTFRAYLNEYLRNHPRIRKDMTLMVRQLAPDANGLPIEIYAFTNTVIWAEYEDIQADIFDHIFAVVDEFGLRIHQSPTGNDIRSLAGVIAQ

SEQ ID NO: 9831 - protein, 261 aa, Enterobacter cloacae
RLLFSCLLHLHTVLRYPGRLEAGSEQDDGVTAPEQTGFPSCVQHISHDITGIKLEPIVALSSSRAVGAEVLSVLSPHQQSESFFQDWSATRALVLLEAQIAALKNPFPCDNLFINLPITVLTIPEMFQRLLQLNSPPLNIELVEPASFFSLSDPVRQRVSCALQQLTARGHRIWLDDIDEASGQAFLSCRLPLCGIKIDKIAFWRLRETPALTQLVTLCSKIAANVLIEGIETERDRTCALHAGARFGQGYYWPSWRWQED

SEQ ID NO: 9832 - protein, 98 aa, Enterobacter cloacae
LISRKKVMKKTTAILMGAAFLFTTNTFAAELLTKNEFEKVESQYEKIGTVSTANEVSVDDAKKELVEKADKEGADVLVLTSGNTNNKIHGTADIYKKK

SEQ ID NO: 9833 - protein, 661 aa, Enterobacter cloacae
QEAAMGRPLKSVFKKEHRDDISNRSANPVFSEVAEVFLSRRRFLQMGAVAGAAVSFPYLITPENAIAAVSKPSALAKAVSLGFTSIDVSTEDTVRVPEGYIARPFYRWGDPTGIKDNMPAFKPDASNTTDEQAVQAGMHHDGMAWFSLPQGAQNPEHGLLALNHEYIDNGMLFTDGTANWSLDKARKGQNAMGVSVVEVKKTGSGWEVVRPSSFARRITVNTPMQLTGPARHQDLMKTAADPQGERVLGTMQNCANGHTPWGTYLTCEENWSDIFVKKADLNPLEKRYGISDSDESYRWNEVDERFSVDKTPNEPNRFGWVVEIDPYNPTSTPRKHTALGRFKHEGAAVTLAADNRVVVYMGDDQKFEYIYKFVSDKKYDPANREANMQLLTSGTLYVARFNEDGSGDWLPLIFGQNGLDKSNGFASQGDLLIKTRLAADVVGATKMDRPEWIAVDPHASGSVYCTLTNNSDRGKEGKAPVDAANPRANNVFGHIMHWHEEGADPAAARFKWDILVMAGRTDGDDPKAKGSMQGAAFGSPDGLSFDHQGVLWIQTDVSSSTINKKAYEGMGNNQMVATIPGTNEYRRFLTGPRGCEITGIAFTPDNRTLFINIQHPGEGGDDITDPANPRAVSNWPDASPNGRPRSSTVVITKADGGIIGS

SEQ ID NO: 9834 - protein, 463 aa, Enterobacter cloacae
GVKDASSASGHGSAEASSDQNPTLQRGLQNRHIQLIALGGAIGTGLFLGIGPAIQMAGPAVLLGYGIAGIIAFLIMRQLGEMVVEEPVSGSFAHFAYKYWGPFAGFLSGWNYWVMFVLVGMAELTAAGIYMQYWLPDVPTWIWAAAFFIIINAVNLVNVRLYGETEFWFALIKVLAIIGMIGFGLWLLFSGHGGERATIDNLWQHGGFLATGWKGLILSLAVIMFSFGGLELIGITAAEARDPHKSIPKAVNQVVYRILLFYIGSLVVLLALYPWVEVKSDSSPFVMIFHDLNSNVVASALNFVILVASLSVYNSGVYSNSRMLFGLSVQGNAPKFLTRVSRRGVPVNSLFLSGAITSLVVLINYLLPKEAFGLLMALVVATLLLNWIMICLAHLRFRAAMRRKGRETQFKALLYPAGNYLCIAFLGLILVLMCTMDEMRLSAMLLPVWVVFLFIAFKLSRKK

SEQ ID NO: 9835 - protein, 431 aa, Enterobacter cloacae
SITFYLNCFVIDYFFRVRLIMVSTESSEKAITQHRLLVPRLSLMMFLQFFIWGSWSVTLGLVMTRHNMSLLIGDAFSAGPIASILSPFVLGMLVDRFFASQKVMAVMHLAGAVILWFVPGALIAENGALLIGLLFGYTLCYMPTLALTNNIAFHSLANVDKTFPVVRVFGTIGWIAAGIFIGVTGVASSVTIFQVAAVSSVLLAVYSLTLPHTPAPAKGLPVKVRDLFCADAFALLKTRHFFVFSVCAMLISVPLGTYYAYTASYLADAGIADVSTAMSFGQMSEIVFMLVIPLLFRRLGVKVMLLIGMLAWFVRYAMFALGVSEEGRILLYLGILLHGVCYDFFFVVGFIYTDRVAGEKVKGQAQSMIVMFTYGIGMLLGSQISGALYNRLVAGQTVPQAWVTFWWIPAVAAAAIALIFLLTFKYDDDKA

SEQ ID NO: 9836 - protein, 346 aa, Enterobacter cloacae
RSGGGMRTMKGPGIFLSQFIGAEAPFNSLDGLAEWAAGKGYKAVQIPCNHPHIFDVEKAAESQAYCDDITARLAAHGLVISELSTHLEGQLVAVNPVYSEAFDHFAPAAVRGNEAARRAWATEKLKQAAVASARLGLKAHATFSGSLAWPFFYPWPPHNQQRFQEAFEELATRWRPILDTFDEQGVDVCFELHPGEDLHDGVTFERFLALVDNHPRCNILYDPSHMLLQQMDYLAFIDIFHARIKAFHVKDAEFRPSGRSGVYGGYQPWINRAGRFRSPGDGQIDFKGIFSKLTQYDYDGWAVLEWECCLKDGDTGASEGSEFIRRHIIPVSGRAFDDFAAGGCHD

SEQ ID NO: 9837 - protein, 139 aa, Enterobacter cloacae
YHATISRVVGIMFKREAEGESSMTISAQVIDTIVEWIDDNLHQPLRIEEIARHAGYSKWHLQRLFMQYKGESLGRYIRERKLLMAARDLRESDERVYDICLRYGFDSQQTFTRIFTRIFTRTFNQPPGAYRKENHGRAH

SEQ ID NO: 9838 - protein, 906 aa, Enterobacter cloacae
RKNTMTKKNFSQNMPPAGGQAYQQTVEQVLAQAQSQANGLDRAEAQARLQKHGPNALPEKKGKPGWLRFLAHFNDVLIYVLLAAAVLTAVMGHWVDTLVILGVAVINALIGHIQESNAEKSLKSIRNMLSSEARVIRNGNHETIPTTEIVPGDIIVLRAGDRIPADMRLIEAHNLRVEEAILTGESTVVDKHTNPLSGELPLGDRTNLVFSGTTVSAGGGVGVVIATGQETELGHINQMMAGIEKHRTPLLVQMDKLGKAIFAIILAMMAALFVFSLVFREIPMGELLLSLISLAVASVPEGLPAIISIILSLGVQAMARKRAIIRKLPTVETLGAMTVVCSDKTGTLTMNEMTVKAIITADTCYRVDGNSYEPVGNIYLEGSDEPVQIQPGTVLEQYLRTIDLCNDSQLIQDERGLWGITGGPTEGALKVLAAKAHLEPVVTTLVNKIPFDSQYKYMSTHYQIGGEEQILITGAPDVIFALCEQQQTRNGAQAFDRAYWETEMERYARQGLRMVAAAFKPANGEQALTHDDLSHGLIFLGIAGMMDPPRPEAIEAINACQQAGIRVKMITGDHPQTAMSIGQMLGITNSEQAVTGYQLEKMDDAELAEAAVKYDIFARTSPEHKLRLVKALQDKGEIVGMTGDGVNDAPALRQADVGIAMGIKGTEVTKEAADMVLTDDNFATIASAVKEGRRVYDNLKKTILFIMPTNLAQGLLIVIALLAGNIIPLTPVLILWMNMATSATLSFGLAFEAAERNIMRRPPRQTGQHVMDAYAVWRVAFVGTMIAIAAFALEAWLAPRGHSAEFIRTVLLQMLVCAQWVYMINCRNTEGFSLNRGLLANKGIWLVTGVLFLLQAAIIYLPFMQMLFGTEALPLRYWFVTLAVAGVMFFVVEIEKRLTRRFRKAA

SEQ ID NO: 9839 - protein, 363 aa, Enterobacter cloacae
GKTTPRYFLMKLPLLFALLACTLQPAFAAVIPVRVATVEQTAHAAERQIPGRIEAIHTVELRARTEGVITRIHFRDGQYVKKGDVLFELDDAEPRAALRLAQAEVRSAEATLRQAQQQLSRFESLGSSNAISRHDVDNARMQRDVASAALEQAKARLDTRSVTLDYTRIISPIDGRVGHSNFHVGSLVNPASGVLVEVVQLDPIRIAFALEEGAFATKAGQHADISAMKQAWQALIDSNGQRISGELTSVDNRIDPRTASVMLRAEFANPRHQLLPGGNVNVYLRPASELPVLTLPAAAVQQNGDGFFAWVINAEDKAEMRPLKVAGQIGQQFQIASGVKPGERAITDGAQRVQPGVAVQILN

SEQ ID NO: 9840 - protein, 1054 aa, Enterobacter cloacae
GAIMLTFFIKRPRFAMVIALVITLLGAIALRIIPVEQYPQITPPVVNVSASWPGASSADVAEAIATPLETQLNGVDHMLYMESTSSDEGTYSLNITFAAGTDPDLAAIDVQNRVAQAVAQLPTEAQQNGVQVRKRATNLMMGVSLYSPNNTHTPLFVSNYASTQVREALSRLPGVGQVQMFGARDYSMRIWLRPDRMNALNVTSDDVAQALREQNVQGAAGQVGTPPVFNGQQQTLTINGLGRLNQADDFANIIIRAGEMGQLVRLKDVATIELGSLSYSSGAQLNGHDSAYLGIYPTPSANALRVADAVRAELERLSTRFPDDLVYEVKFDTTSFVAATIKEIGVSLALTMLAVVVVVSLFLQSWRATLIVALAIPVSLVGTFAVLYTLGYSANTLSLFAIILALTMVVDDAIVVVESVETLMAEGQSRTAATALALRQIAGPVIATTLVLLAVFVPVALLPGIVGELYRQFAVTLSTAVTLSSLVALTLTPALCALLLRPRPAQPAAVFRGFNRGLDATRTLYTRIVSVFNLRPWLALLATAGAAAVVVFSFMSMPKGFLPQEDQGYFFASVQLPEAASLERTEAVMTTARELIAKNPAVEDVIQVSGFNILNGTSASNGGFISIMLKDWSERPPLDEVMGTLQRQLLALPEATIMTFAPPTLPGLGNASGFDLRIQAQAGQSPAELERVTREVLAKANQHPQLSRVFTTWSSNVPQMTLTVDRERAARLDVPVSRIFSSLQTAFGGTRAGDFSVNNRVYHVVMQNEMQWRERAEQISELFVRSNSGERVRLSNLVTITPTVGAPFIQQYNQFPSVSVSGSAAEGVSSSTAMAAMGEILAENLPAGYDYAWSGMSYQEQQTGNQAIWIVLAAVVMAWLFLVAQYESWTLPASVMLSVLFAIGGALVWLWLAGYANDVYVQIGLVLLIALAAKNAILIVEFARARRMDGMAIVDAAREGASRRFRAVMMTAVSFIIGVLPMMLATGAGAQSRRIIGTTVFSGMLVATVVGIVFIPALFVLFQRLREWGHGLTDSSPTAHSASAPEKSASRHRR

SEQ ID NO: 9841 - protein, 101 aa, Enterobacter cloacae
GRVVSSQCDVAWISQAILIALLSVSGLSVDRTCMVLMCGLGRMSQCRSLMLSILSDRQADRLMEWDIRNGVIQRYGRRHGIAVPVSDVVVPLLAAGSEGPG

SEQ ID NO: 9842 - protein, 240 aa, Enterobacter cloacae
HSSDATLFSVLITSSNKFMTTADFKRPKLELPNGADKLLLHSCCAPCSGEVMEAIQASGIDYTIFFYNPNIHPQKEYLIRKDENIRFAEQHGVPFIDADYDTDNWFERAKGMEWEPERGIRCTMCFDMRFERTALYAAENGFNVISSSLGISRWKNMQQINDCGQRAAAHYPGMVYWDYNWRKQGGSSRMIEISKREQFYQQEYCGCVYSLRDSNLHRKSQGRPLIQIGKLYYGKEDDQA

SEQ ID NO: 9843 - protein, 267 aa, Enterobacter cloacae
IKLKRTGMMMHSSACDCEASLCETLRGFSAQHPDSVIYQTSLMSALLSGVYEGETTIADLLAHGDFGLGTFNELDGEMIAFSSQVYQLRADGSARAAKPEQKTPFAVMTWFQPQYRKTFDGPVSRQQIHDVIDQQVPSDNLFCALRIDGNFRHAHTRTVPRQTPPYRAMTDVLDDQPVFRFNQREGVLVGFRTPQHMQGINVAGYHEHFITDDRQGGGHLLDYQLENGVLTFGEIHKLMIDLPADSAFLQANLHPSNLDAAIRAVEN

SEQ ID NO: 9844 - protein, 277 aa, Enterobacter cloacae
PAADGPAPSQPDFVNQYKDREMQKVALVTGSGQGIGKAIALRLVKDGFAVAIADYNEETAKAVADEITRNGGKAVAVKVDVSDREQVFAAVEKARTALGGFNVIVNNAGVAPSTPIESITPEIVDKVYNINVKGVIWGIQAAIDAFRKEGHGGKIINACSQAGHTGNPELAVYSSSKFAVRGLTQTAARDLAPLGITVNAYCPGIVKTPMWAEIDRQVSEAAGKPLGYGTETFAKRITLGRLSEPEDVAACVSYLAGPDSDYMTGQSLLIDGGMVFN

SEQ ID NO: 9845 - protein, 85 aa, Enterobacter cloacae
KPPPTRRGNAFWAPCRTAPTATRRGAPISPARRTGRTFLSKKPISTRWKNATASATAMNRTAGTRWMSGSALIKPLTNPTVSAGW

SEQ ID NO: 9846 - protein, 414 aa, Enterobacter cloacae
RMAIPARVRAANLSAGTLFPFPDGRLMISPQGAAMINVGIIGSGFIGPAHIEALRRLGFVQVVALCDGSLVKAQEKARQLNVPHAYASVEELLAHPNLHAVHNCTPNHLHAEINRQILRAGKHVFSEKPLCMTPDEARELVALAEQAGVVHGVSFVYRQFAMVRQAASMMRAGTVGRLFASHGSYLQDWMLLETDYNWRVEAALGGASRAVADIGSHWCDTVQYVTGRRITEVMADLSIVWPRRKASAGGYQTFSHDEQAEYEVKPVTTEDFGSVLFRFDDGSKGSFSVSQVSAGRKNRLTFEINGSEQSVAWDQEIPQQLWIGHRARANQTLTDDPGLMNPDVADSAHFPGGHIEGWPDAFKNMMAQFYRAVQAGAMPDTPQFATFHDGANVMYIIDAIVKSHQQQRWVRVEQ

SEQ ID NO: 9847 - protein, 339 aa, Enterobacter cloacae
IYGSLHKTLTAGCVVAMSIQKIAQLAGVSVATVSRVLNNSDTVKAKNRERVLRAIQESNYQPNLLARQLRTARSYMILVMVSNIANPFCAEVVKGIEAEAEKNGYRILLCNSGSDIERSRSGLSLLSGKIVDGIITMDAFSKLPELAALIGNAPWVQCAEYADAGAVSCVGINDVDASQHAVSQLADGGRKRIAMINHDLSYKYARLRERGYKSVIHLRDLDYQAVEYASDLSSGAGMAAMQNLLKDNPPDAVFAVSDTLAAGALRAIQQAGLRVPEDIAVVGFDGTELADMISLTTIEQPSRDIGRKAVDLLLNKIDNPDAPTERVMMDWRFISRAST

SEQ ID NO: 9848 - protein, 102 aa, Enterobacter cloacae
NDNRRCWMSKKIIDWDELRAELLSDSEVQASFDAEERKERLREMLAQWRNHAGLTRAQVAERMGVSAPTVSRMEANITRASLDTLTRYALVCGVKHPQITLY

SEQ ID NO: 9849 - protein, 543 aa, Enterobacter cloacae
YCKLLPFALALLTNFVGEQAVMKRVWSGLLLGIGALPAVAATCEQTSRQGDIQGKFDASGEVCFSLPELGENYVSATLNGVTDARLLDGQNRRIRTLIENGPADGEHTLLFALPVKQNTSLVLHGEAGKPWRFQWRMKETSPLPRVQMLAPESPTLKALASVISAGGSTEAFWQAQRRQGTPMVEPVDASHKRVTFLWRGARDNVFILGSPAGDHDPLFRLGNSDVWFRSYVVPADTVMQYKLAPDVPIVEGSTRDQRRAILVSAQADPLNPNTFGEQKTDRWNRFSLLDLSPARYCSVQATAKPLVHGTLSRQSFSSHILGNARDVMIYQPRGAQPARWTLILFDGQVYQDEYHFANVLDGLIARHHLPPINVVFIDSLDHARRGNELPPNPDFADFMAHELLPWLRGKGIGMQRQKTVLAGSSYGGIASSWVALRYPRLFGNVLSLSGSYWWAPEGDAPGWLTRQYQQSPPYPVRFWLQAGKFETAGPGGGIYRTTQDFEQVLRKKGYRVSFHPSSSGHDYAAWCEALIHGMRDLTGLRRQ

SEQ ID NO: 9850 - protein, 297 aa, Enterobacter cloacae
PMSDYPTIALTGPGAIGTTIAAVLHEAGRTPLLCGRTAHPELRLRHDEGEIVVPGPVLTDPSVITRPVDLVFLAVKTTQNADSAGWLRALCDENTVVCALQNGVEQKAQLAPLVNGATVLPSVVWFPAQREPDASVWLRAKPRLTLPDVPQAQRVVEALRDTRCAVELSEDFPTVAWRKLLQNAVAGLMVLANRRAGMFRREDISELALAYLREGLTVSRAEGAKLDDAVAEEILANFQRAPVDLGTSILADRQADRPMEWDIRNGVIQRYGRRHGIAVPVSDVVVPLLAAGSEGPG

SEQ ID NO: 9851 - protein, 592 aa, Enterobacter cloacae
LTCPPTARFYRPICTPATLMRLSAPSKTNRRTTVNSEKQSRQWAHGADMVVGQLEAQGVKQVFGIPGAKIDKVFDSLLDSSIEIIPVRHEANAAFMAAAVGRLTGKAGVALVTSGPGCSNLITGIATANSEGDPVVALGGAVKRADKAKLVHQSMDTVAMFSPVTKYAVEVNSPDAIAEVVSNAFRAAEQGRPGGAFVSLPQDIVDQPTTGAILPASTAALMGPAPESAINEVAKLIAKAKNPVILLGLMASQPANSAALHKLLERSRIPVTSTYQAAGAVNQEHFTRFAGRVGLFNNQAGDRLLHLADLIICIGYSPVEYEPSMWNSGDATLVHIDVLPAYEERKYVPDLELVGDIAATLNLLASRIEHKLELSQRASEILVDRQHQRDLLDRRGASLNQFALHPLRIVRAMQDIVNNDVTLTVDMGSFHIWIARYLYSFRARQVMISNGQQTMGVALPWAIGAWLVNPGRKVVSVSGDGGFLQSSMELETAVRLNANILHIIWVDNAYNMVAIQEEKKYQRLSGVEFGPVDFKAYADAFGAKGFAVESADALEPTLRAAMDVDGPAVVAIPVDYSDNPLLMGQLHLSQIL

SEQ ID NO: 9852 - protein, 79 aa, Enterobacter cloacae
PRPPRGISRRWGSPLTPIARASSKRRCGRKSTVKSPRRRVNRLATGRKPLPNALRLAVCPSRKTWPPASLTSPGRIPTT

SEQ ID NO: 9853 - protein, 254 aa, Enterobacter cloacae
VTSLFVRFLTCYNKLLTFQGVTAVPEINQHGQTVNDIVPDWKCARALTRTLLTGQYCRLEPLDADRHSADLFEAYALGDDSDWTWLASTQPVSVEATAHWVLGKVLDDDLVPFAIIDLRTEKAVGLVSYMAIERFQGSVEIGHVTWSRRMKGTRVGTEAVWLLLKNAFEHQYRRLEWKCDSMNIASRNAAERLGFVWEGRLRQKLVRKGRNRDSDMLSIIDGEWPQRDAELRAWLAAENFDGEGRQVRRLEEFR

SEQ ID NO: 9854 - protein, 730 aa, Enterobacter cloacae
ELIMNNTTMHKTLLAIAIGAVTHSAFAADEKKEDTIVVQSTAGSDFKPGGDQLVPAFLDGQVANGGRMGMLGQQNAMDVPFNIISYTSKLVEDQQAKTIADVVANDAGVQFVQGYGNSAETFRIRGLKFDGDDMTFGGLSGVLPRQVVDAQMVDRIEIFKGANSLMNGAASSGVGGMINLEPKHAGDTPQAKVGVDYTSDSQIGTTLDAGRRFGDNDQFGARVNLVHREGETGVPNDRRRTTLLSTGLDYKGDRFRTSLDLGYQKKTFHGSPTSVNISAVDFVPEPPKNDRNFSQKWAYSDIENEFGMWRSEYDITDSWTAYTGLGAQHAHEEGIYSAPKLLDKSGNAVVSRLDTNRISDSVSGMAGIRGNFTTGFVSHKVNVGYSAMTKNEKIAWKMSATKDNPTTNIYHNTGVDMPDSSNLNGSGGKYSDPLTSGRTRTQGWLLSDTLGVLDDKLLFTAGARHQKVVIRGYNKITGAENDADGFDGSRWMPTYGVVYKPWEEISLYANHTEALQPGETAPRSANNYGQSTGIVHSKQNEVGVKADFGRVGGSLALFEIKMPSAILDDSGHYGLDAEQRNRGVELNVFGEPMLGMRLNASATWLQAELTKTKNGVNQGNDAIGIPSFYAVLGAEYDIKPIEGLTATARVNHSGTQYADLANSKKLDSYTTLDLGMRYRFAVNHNENQMTVRAGIDNVTNENYWSSVDDSGTYITQGEPRTFKVSVGYEF

SEQ ID NO: 9855 - protein, 162 aa, Enterobacter cloacae
QAVTAMNGTITTWFKDKGFGFIKDENGDNRYFHVIKVANPDLIKKDAAVTFEPTTNSKGLSAYAVKVIPESKHLYIAGERVKLTSIKSFVVFSEEEPVDTKIDKENAVLSVGLLMNSIKPKTEKKPGEMRTVKKLAITTFQNTTLIFTEDEIDIDATVKLLK

SEQ ID NO: 9856 - protein, 309 aa, Enterobacter cloacae
CRLSKIKESARAMKRPDYRTLQALDAVIRERGFERAAQKLCITQSAVSQRIKQLENMFGQPLLVRTVPPRPTEQGQKLLALLRQVELLEDEWLGDEQTGSTPLLLSLAVNADSLATWLLPALAPVLADSPIRLNLQVEDETRTQERLRRGEVVGAVSIQPQALPSCLVDQLGALDYLFVGSKAFAERYFPNGVTRAALLKAPAVAFDHLDDMHQAFLQQNFDLPPGSVPCHIVNSSEAFVQLARQGTTCCMIPHLQIEKELKSGELIDLTPGLYQRRMLYWHRFAPESRMMRNVTDALLAFGHKVLRQD

SEQ ID NO: 9857 - protein, 78 aa, Enterobacter cloacae
RASASPITEPLPGRTLSSPAGSPACLKIRASSSAISGVASAGLRITAFPAAIAGATFCISLAIGEFHGVMAATTPRGS

SEQ ID NO: 9858 - protein, 122 aa, Enterobacter cloacae
CRARRGSPDGCCTGSRRAVARSPAGRPAPRPARRCTQSQDAARSCPAKRYWCACCAPESPCTPASAPRDRRSPSAYPPAGAARQKSDRDAARQRPTAAVNRAPAPAPDTSLPDRLPSSPYLS

SEQ ID NO: 9859 - protein, 254 aa, Enterobacter cloacae
LHTGTTFVTLRARFDTECKMSRNVSLAVAFLATALSGHALADGIHSFSQAKTAGVKINADVPGDFYCGCKINWQGKKGVVDLGSCGYKVRKNENRASRIEWEHVVPAWQFGHQRQCWQDGGRKNCAKDPVYRQMESDMHNLQPAVGEVNGDRGNFMYSQWNGGEGQYGQCAMKVDFKEKVAEPPARARGSIARTYFYMRDRYDLNLSRQQTQLFNAWDKLYPVTDWECQRDERIAKVQGNHNPYVQRACQAQKS

SEQ ID NO: 9860 - protein, 249 aa, Enterobacter cloacae
HMEFLTMRIPRIYHPELITPGGEIALSDDAANHVGRVLRMGAGQAIQLFDGSNQVFDAEITRADKKSVHVKVLRGDVDDRESPLHIHLGQVMSRGEKMEFTIQKSIELGVSLITPLFSERCGVKLDAERLNKKIQQWQKIAIAACEQSGRNRIPEIRPAMDLEDWCAEEESGLKLNLHPRASASINTLPLPVERVRLLIGPEGGLSADEIAMTARYQFTDILLGPRVLRTETTALTAITALQVRFGDLG

SEQ ID NO: 9861 - protein, 319 aa, Enterobacter cloacae
PEKKMIKLGIVMDPIANINIKKDSSFAMLLEAQRRGYELHYMEMNDLYLINGEARARTRIVNVEQNYEKWYEFGTEQDIALADLNVILMRKDPPFDTEYIYSTYILERAEEKGTLIVNKPQSLRDCNEKLYTAWFSDLTPETLVTRSKTQLKEFWQKHGDIIMKPLDGMGGASIFRVKEGDPNIGVIAETLTELGTRYCMAQNYLPAIKDGDKRVLVVDGEPVPYCLARIPQGGETRGNLAAGGRGEPRPLSESDWEIARRVGPTLKAKGLIFVGLDIIGDRLTEVNVTSPTCIREIEAEFPISITGMLMDAIEKRLQK

SEQ ID NO: 9862 - protein, 105 aa, Enterobacter cloacae
LRTGSFSCAGKVSTRRSIACAAPRVCSVANTRWPVSAAVSARRIVSLSRSSPSRITSGSSRSALRRASAKDGLCRPISRCWIRQRSLWYINSTGSSRVRICPSVW

SEQ ID NO: 9863 - protein, 108 aa, Enterobacter cloacae
YAAAGAVDGVMSAVSPCADGLVLRLYIQPKASRDSIVGLHGDELKVAITAPPVDGQANAHLTKYLVKQFRVAKSQVIIEKGELGRHKQVKILNPQSIPTEVAALTEQD

SEQ ID NO: 9864 - protein, 198 aa, Enterobacter cloacae
TMQKVVLATGNAGKVRELASLLNDFGLDVVAQTELGVDSAEETGLTFIENAILKARHAAQVTGLPAIADDSGLAVDFLGGAPGIYSARYSGPDATDQQNLEKLLVALKDVPDEQRTAQFHCVLVYMRHAEDPTPIVCHGSWPGVITREAAGNGGFGYDPIFFVPTEGKTAAELTREEKSAISHRGRALKLLLEALRNG

SEQ ID NO: 9865 - protein, 128 aa, Enterobacter cloacae
GKGWQSVGMQTIRSYAKQLRRELTQEERRLWYLLRSRRFENYKFRRQHPVGNYILDFACCAARLAVELDGGQHDENQEYDRQRTLWLNHKDWHVIRFWNNELWNNEEAVLERILETLQALQPSPRPSP

SEQ ID NO: 9866 - protein, 356 aa, Enterobacter cloacae
LSESMTMQASQFSAQVLDWYDKYGRKTLPWQIEKTPYKVWLSEVMLQQTQVATVIPYFERFMARFPTVTDLANAPLDEVLHLWTGLGYYARARNLHKAAQQVATRHNGKFPETFDEVADLPGVGRSTAGAILSLSLGKHFPILDGNVKRVLARCYAVDGWPGKKEVEKRLWEISEAVTPAKGVERFNQAMMDLGAMVCTRSKPKCELCPVNNLCVAYANHTWAQYPGKKPKQTLPERTGYMLLMQHGDEVFLAQRPPSGLWGGLYCFPQFEDEASLRAWLEQRGIAAETLTQLNAFRHTFSHFHLDIVPMWLPVSSFTSCMDEGTALWYNLAQPPSVGLAAPVERLLQQLRVGAMV

SEQ ID NO: 9867 - protein, 419 aa, Enterobacter cloacae
TSCSRVKTSTSKAIRHRKNNNAQLLPGCAALARAYGFVGRVSAAPPGNSNPKANTTRTPGMMKKLLALALVAPLLVSCSSKKGDEYNEAWVKDTNGFDILMGQFAHNIENIWGFNEVLIAGPKDYVKYTDAYQTRSHINFDDGTITVETIAGTEPAAHLRQAIIKTLLMGDDPGSIDLYSDADDITISKEPFLYGQVVDQTGQPIRWEGRATKFADYLLQTRLKSRTNGLKVIYSVTINLVPNHLDKRAHKYLGMVRQASRKYGVDESLILAIMQTESSFNPYAVSRSDALGLMQVVQHSAGKDVFRAQGKSGTPSRRYLFDPQSNIDTGTAYLAMLNNVYLGGIDNPTSRRYAVITAYNGGASSVMRVLSNDKVQAANIINSMAPGDVYDTLTTRHPCAESRRYMYKVNTAQKNYRRR

SEQ ID NO: 9868 - protein, 560 aa, Enterobacter cloacae
KMIYSADLLISRVIVMKVSFQIKLFISLVAFFSVLFALLGGYYYVDVGRQLYQEMSARAKIQAEEIALIPTLRKEVEQKDIQGIHDFMQKIAARSDASFIVIGDNKGLHLFHSVFADRVGKTLVGGDNDEVLHGKSTITIRKGGLGISLRSKAPIFNDAGQVVGIVSVGYLTSYLDTITVSKVVNILIAAVLLLIALFIFSWFFTRSIKKQIFSLEPREIGLLVRQQKAMMESIYEGVIAIDDDLRIEVINQAARKLLGLRQPARELRGQLISQVIAPVPFFNAQTMLAKDTHDEICRFNDLTVIASRVRIMLEDALQGWVITFRDRNEIDSLSAQLSQVKRYVDNLRIMRHEQLNRMTTLSGLLHMGRYDEAIRYIQAQSEHAQELLDFISSRFSSPTLCGLLLGKAARAREKGVELSFDPACRVDKPFLPLLESELISIIGNLLDNAIEATQRAPLPHAPVDVLIKLNEQELIIEVADQGVGITPEIRDRIFERGITTKTRGDHGIGLYLIESYVTQAGGAIEVADNTPRGAIFSLFIPATGTARHPVQELEDTDYAT

SEQ ID NO: 9869 - protein, 212 aa, Enterobacter cloacae
EILSAIPNRSIAARVSPPPAIENASLSAIALATISVPLRKFGNSNTPTGPFHRIVFAFLRISASFCAETSPRSRICSSSLMSLTDFRVAVAVSENSVATRTSVGTGISQVPSRRLASSTRSASYRDLPTLWPCAATKVFAIPPPTISWSAILDRESSTVSLVETLEPPTIATIGRAGSFSALPSASSSSASSGPAQATSANLPIPWVDACAR

SEQ ID NO: 9870 - protein, 281 aa, Enterobacter cloacae
IFLILSPTPASLTVHFSELIQINEYGSNIMKMRAIGLAVGTTLLLSGCQNMDSNGLMTSGAEAFQAYSLSDAQVKALSDEACKDMDGKATLAPANSTYTQRLNKIASALGDNINGQPVNYKVYMAKDVNAFAMANGCIRVYSGLMDMMTDNEVEAVIGHEMGHVALGHVKKGMQVALGTNAVRAAAASAGGIVGSLSQSQLGDVGEKLVNSQFSQRQESEADDYSYDLLRKRGINPSGLATSFEKLAKLEEGRQSSMFDDHPASVERAQHIRDRMAADGIK

SEQ ID NO: 9871 - protein, 437 aa, Enterobacter cloacae
FIFTKQRVSQVNHFSSVTITLMKNISYKKRKADMMTARWQGTIALLLLIIISYVDRVNISVMILNPEFAEHFQLNENRMLQGMLMTCFLLGYGFSALLLTPVIESKLHYRQGLLSSIAIWAAVCAVSPLLGSLTGMLIARVILGIAEGPLFSLKTRFISDNFSAQEIGKPNAVTALGVSLGLAVGFPLVTWLMSHLGWAGSFYTLAAINLLLGGSLIWRFLPAPRKLPTAKKPGFVHTFTLAWQTPLLGWIMVVEIATLSYLWGSSAWLPAWLRDEHHFSLHATGWLAAIPFLLSLGSKFLGGVLLDKMRPEQAPMLFVVGGAMTALSVVALMLSHQPAWLALFMLSANVFWGLQGAAIPAVIQHHAAREAVGSAYGIINGIGNICAAFIPLLMGMVMRSVGSVSSGFSVLVVSQVVTLLAGGMLLLRMRRAAAISA

SEQ ID NO: 9872 - protein, 231 aa, Enterobacter cloacae
CQAADHRRTGTRCECRIQAVDVEGQIDRHVADDLLNLSQNIVHAAIVHLARVEYGEAVVFVELGADADLHGVVRIDQAFLRRRVEHGAVVELTAVRVGVGVRIEVHQRHFTEVLRVGAQQRQGHEVVTAEGEHAFTGRQQLLGVRLQFFAHLTRVAEGVHQIAAVHHVQTLAHVEVPREAVVLPGQVSGNLTDRRRAMTTTRATGRCHVERYAGDHPVRIAVVRLEVHRKA

SEQ ID NO: 9873 - protein, 474 aa, Enterobacter cloacae
KLITQLEGIMPDNNKQGRTSNKAMTFFVCFLAALAGLLFGLDIGVIAGALPFITDEFQISAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKNELEEIRESLKVKQSGWALFKENSNFRRAVFLGVLLQIMQQFTGMNVIMYYAPKIFELAGYTNTTEQMWGTVIVGLTNVLATFIAIGLVDRWGRKPTLTLGFLVMAVGMGVLGTMMHMGIHSPTAQYFAVAMLLMFIIGFAMSAGPLIWVLCSEIQPLKGRDFGITCSTATNWIANMIVGATFLTMLNTLGNANTFWVYAGLNLFFIVLTIWLVPETKHVSLEHIERNLMKGRPLREIGAHD

SEQ ID NO: 9874 - protein, 150 aa, Enterobacter cloacae
YSDHAWRCGARVMSGTLLAFDFGTKSIGVAVGQRITGTARPLTALKANDGTPDWNLIERLLKEWQPDDVIVGLPLNMDGTEQPLTARARKFANKIHGRFGVSVKLHDERLSTVEARAGLFEHGGFRALNKGSVDSASAVIILESYFDQGY

SEQ ID NO: 9875 - protein, 139 aa, Enterobacter cloacae
CPAVARFCLRGSGLPPPTYSPVAHTAPRARPGHPDAASAPEPHAGFPPVDYAPDLSPAPERYRPGARSPAPHRACAAWPTPDGRFPPPSAPGVSSRCRAAHQAESHPDLHAARCAGPRQRTGCAGLSPAAGSGNVHSGT

SEQ ID NO: 9876 - protein, 238 aa, Enterobacter cloacae
TTPRKMNDIAHNLAQVRDKISAAATRCGRAPEEITLLAVSKTKPASAIAEAIAAGHRAFGENYVQEGVDKILAFRERGNADLQWHFIGPLQSNKSRLVAEHFDWCHTIDRLRIATRLSDQRPIEIPALNVLIQINISDENSKSGITLSELDALAADVAALPRLTLRGLMAIPAPESSYERQFAVAQQMAVAFEALKARYDTVDTLSLGMSDDMEAAIAAGSTMVRIGTAIFGARDYPQ

SEQ ID NO: 9877 - protein, 194 aa, Enterobacter cloacae
GNLRNAMKTLTFLLSTVIELYTMALLLRVWMQWARCDFYNPFSQFIVKITQPIVGPLRRIIPAMGPIDSSSLLMAFILSVIKAIVLFMVITFQPIIWISAVLILVKTVGSLIFWVLLVMAIMSWVSRGRSPVEYALIQLTEPLLRPIRSLLPAMGGIDFSPMLLVLLLYVLNMGIAELLQATGNMLLPGLWMAL

SEQ ID NO: 9878 - protein, 390 aa, Enterobacter cloacae
NCYWKHCVMANLPPLSLYIHIPWCVQKCPYCDFNSHALKGEVPHDDYVAHLLADLDADVPYAQGREVKTIFIGGGTPSLLSGPAMQTLLDGVRARLNLAADAEITMEANPGTVEADRFVEYQRAGVNRISIGVQSFSEPKLKRLGRIHGPEEAKRAANLATGLGLRSFNLDLMHGLPDQSLEEALDDLRQAIELNPPHLSWYQLTIEPNTLFGSRPPVLPDDDALWDIFEQGHQLLTAAGYQQYETSAYAKPGYQCQHNLNYWRFGDYLGIGCGAHGKVTFPDGRILRTAKTRHPRGYMEGRYLERQHDVEAVDKPFEFFMNRFRLLEAAPRAEFTRYTGLPESVIRPQIDEALAQGYLTECDVSWQITEHGKLFLNSLLELFLAENPEG

SEQ ID NO: 9879 - protein, 447 aa, Enterobacter cloacae
RCQLIELHQITTLNVPITTYLPLTCEESNMNLKLQLKILSFLQFCLWGSWLTTLGSYMFVTLKFDGASIGAVYSSLGIAAVFMPTLLGIVADKWLSAKWLYMLCHLVGAGTLFMAAEVTTPGAMFMVILLNSLAYMPTLGLINTISYYRLKSAGLDIVTDFPPIRIWGTIGFIMAMWGVSFAGFELSHMQLYIGAALSVLLALFTLTLPTIPVSNQQKNQSWSTMLGLDAFALFKNKRMAIFFIFSMLLGAELQITNMFGNTFLHSFDNDPLFAGSFIVEHASVMMSISQISETLFILTIPFFLSRYGIKNVMLISIAAWMLRFGLFAYGDPSAFGTVLLVLSMIVYGCAFDFFNISGSVFVEKEVKPEIRASAQGMFLMMTNGFGCILGGVVSGKVVEMYTTNGITDWQPVWLIFAGYSLVLFFAFIALFKYKHVRVPNGAQPIAH

SEQ ID NO: 9880 - protein, 275 aa, Enterobacter cloacae
LKAMSHRLAVQLKLPITPHAVPFSHCLFPPRERPGTPYRNWKIPTMQHELIDVLIVEDENELAQLHAELIGKHPRLRLVGIAASLADAQVQLESKQPKLMLLDNYLPDGKGITLISNPMLTRANCSVIFITAASDMDTCSQAIRNGAFDYILKPVSWKRLSQSLERFVQFAEQQRVWKIVDQQNVDSLYQLQAKNYRLDNGSKGIEENTLARVQMLFNNKAAHCFTVDEVVSETGLSKTTTRRYLEHCVEVGFLTVEMLYGKIGHPRRMYRRSAT

SEQ ID NO: 9881 - protein, 131 aa, Enterobacter cloacae
CRPFAAPGAVSEGSAVNQQEGGMSAQPVDLQIFGRSLRVNCPPEQRDALNQAADDLNQRLQDLKERTRVTNTEQLVFIAALNISYELTQEKAKTRDYAASMEQRIKMLQQTIEQALLDQGRSPERPGPKFE

SEQ ID NO: 9882 - protein, 230 aa, Enterobacter cloacae
NYDDTFTLNQGFKGYSLRRHLGDSLSFLLPTTMTQFPEVSASRQDIRQLIRQRRRALSAEQQAHFAQQAAARMMAYPPVVMANTVALFLSFDGELDTQPLIDQLWRAGKKVYLPVLHPFSRGNLLFLHYHPHSELVVNRLKITEPKLDVRDVLPLSELDVLITPLVAFDEQGQRLGMGGGFYDRTLQNWQQYGLQPVGYAHDCQGVEVLPVEKWDVPLPAVVTPSKTWTW

SEQ ID NO: 9883 - protein, 346 aa, Enterobacter cloacae
FQQPRHQRGVNTLVDKQPRPGDTRLPRRAENAVADPARGLFDIGILQHDGRRFAAQFQRGRDQFFRRHVRQMTARGGAAGKGNFPHARMTRQRIANHRAFARQDTQQPGGQPGLFKNPRQLQRHQRRGFGGLEDHRVPGGNRRCDLLHFAGNRRVPRRDGRHHAKGLVAAQRQQIRLARRRKFPFQQLAGGGKVARRSRRAHHQPARFRQRLAVITALHLRQRIDAGFNKIGNFMQDLRAHVRQTVTPCGIAPGALSGGYRLLQVIQTGGIQRRVERPVCRKVALHRVAAAASPLAADKNLQIVHRHSSAQGQLAAGAHRAQCRQGGGFRIRSQRQSAQFQMELAE

SEQ ID NO: 9884 - protein, 385 aa, Enterobacter cloacae
NMAKHLFTSESVSEGHPDKIADQISDAVLDAILAQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPVTYAHRLVQRQAEVRKNGTLPWLRPDAKSQVTFQYDDGKIVGIDAVVLSTQHAEEIDQKSLQEAVMEEIIKPVLPTEWLSSATKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYQETAAYGHFGREHFPWEKTDKAALLRDAAGLK

SEQ ID NO: 9885 - protein, 189 aa, Enterobacter cloacae
AHTTDPPAGGASCASPLPALCSAPMKAPRLPIAIQQAVMRSLREKLAQANLKLGRNYPEPKLVYQQRGTAAGTAWLESYEIRLNPVLMMENQQAFIEEVVPHELAHLLVWKHFGRVAPHGKEWKWMMEAVLGVPARRTHQFELESVRRNTFPYRCQCQQHQLTVRRHNRVVRGEATYRCVKCGEPLVAE

SEQ ID NO: 9886 - protein, 235 aa, Enterobacter cloacae
NRSGIPDLDHRNADGRYRKTFTEITCDSACVYPHTGRCRFLNQETVPLTMNLQHHFLIAMPALQDPIFRRAVVYICEYNEDGAMGIIINKPLENLQVEGILDKLKIPAEARLPEIRLDKPVMLGGPLAEDRGFILHTPPVFSSSIRISDNTVVTTSRDVLETLGTASQPSEVLVALGYASWEKGQLEQEILDNAWLTAPADMNILFKTPIADRWRDAAKLIGIDILTMPGVAGHA

SEQ ID NO: 9887 - protein, 126 aa, Enterobacter cloacae
LSATAISRAGGSRGAPVTAITCRCNGLASARQRGMSMARTIFCTFLQRDAEGQDFQLYPGDLGKRIYNEISKEAWGQWQKKQTMLINEKKLSMMNPEHRKLLEQEMVNFLFEGKDVHIEGYTPPEK

SEQ ID NO: 9888 - protein, 462 aa, Enterobacter cloacae
THKITKGLIMSTTDDSFSVTHDPIDIQRPSLKERWWHIMDTWKIGIIPLPLFVLAGALIAIDCLGGKLPSDIVVMVATLAFFGFACGEFGKRLPIVGKLGAAAICATFIPSALVYYGLLPDVVVESTTKFYKSTNILYLYICCIIVGSIMSMNRTVLIQGFLRIFFPMLCGEIVGMIVGMGVGLALGLEPFQIFFFIILPIMAGGVGEGAIPLSIGYATLLHMDQGVALGRVLPMVMLGGLTAIIISGCLNQLGKRYPHLTGEGQLMPNRANADATVSQPAFSGKADVTTIASGALLAVLLYMLGMLGHKLIGLPAPVGMLFMAVLVKLCNGASPRLLEGSQVVYKFFQTSVTYPILFAVGVAITPWHELVAAFTLTNLLVIISTVSALVATGFFVGKKIGMHPIDVAIVSCCQSGQGGTGDVAILTAGNRMSLMPFAQIATRIGGAINVSISLLILGNFLV

SEQ ID NO: 9889 - protein, 343 aa, Enterobacter cloacae
GGSMQSQPIDFRHTVVAKHPERLSQIRYLLADSGLGLDNDITLFVEAWSGAQLVGCAGLAANVIKCVAVNEQLRGENLSARLLAEVENAALERGHFHLFLCTRPCNKERFGRSGFWPIAQSGNNAVLMENTPQGIARYCRTLSRMRRGGEKIGAIVMNANPFTLGHRHLVEQAAAQCDALHLFVVREDASFFPFSARLEMVRAGVAHLPNVVVHEGSQYIISRATFPAYFLKETGKVQQAWSEIDVLIFRDFIAPALGITHRFIGSEPFCDITRQYNQTLHDLLASHIDVVEMPRIKATGNAISASEVRRLLKTQQFSRIREIVPDSTFAHLEAHYRASAEVA

SEQ ID NO: 9890 - protein, 300 aa, Enterobacter cloacae
TGHQLGGAEMSKLRRSMLFLPGANAAMLSTAFIYRPDSIMFDLEDAVALREKDTARMLVFHALQHPMYQDIETVVRINPLSTPFGLLDLEAAVRAGVDVIRLPKTDTPDDIYELEGHLERIEQACGREVGSTRVMAAIESAIGVINAVAIARSSPRLIGIALAAFDYVMDMQTERGDGTELFYARCAVLHAARAAGIDAFDVVWSDVNDEAGFLREVDLIRKMGFNGKSLINPRQIDLLHNAYAPTREEVEHAKRVIEAAEEGERNGLGVVSLNGKMVDAPIINHAQVVLERAAASGVRR

SEQ ID NO: 9891 - protein, 206 aa, Enterobacter cloacae
VHRQNRRGDPLPRRQRDRHCATGEGGSMTLATPVRAGVSLEELLAAKERRAARQADWLTHYQQPVISLTLVTPGEIKDSLRYRNTMGVALQMCDQLLWENRWQVLDRLVLWLPTGPEALWCVAHPAAEIKAHCAELEQTHPLGRLWDLDVICPENGLVGRQSLGSHLRRCLICDEPAHACSRSRHHPVEQVVSRVEKMIDDWFARD

SEQ ID NO: 9892 - protein, 256 aa, Enterobacter cloacae
LWIMPVSRTFSQADNSFMKNDVISPEFDENGRPLRRIRSFVRRQGRLTKGQQHALDNYWPVMGVEFSEQPLDFTDLFGRDAPVTLEIGFGMGTSLVTMAKARPEQNFLGIEVHSPGVGACLATAHEEGVENLRVMCHDAVEVLHKMIPDNSLNMVQLFFPDPWHKARHNKRRIVQAPFAELVKSKLKLGGVFHMATDWEPYAEHMLEVMSSLDGYKNQSESNDYVPRPDSRPVTKFEQRGHRLGHGVWDLMFERVK

SEQ ID NO: 9893 - protein, 665 aa, Enterobacter cloacae
YKELRFAMSDDMSSLSPSSAGEQGVLRSMQEVAMSSQEASKMLRTYNIAWWGNNYYDVNELGHISVCPDPDVPEARVDLAKLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMTEIAIVLEEAERLNVIPRLGVRARLASQGSGKWQSSGGEKSKFGLAANQVLQLVEILRERGRLDSIQLLHFHLGSQMANIRDIATGVRESARFYVELHKLGVNIQCFDVGGGLGVDYEGTRSQSDCSVNYGLNEYANNIIWAIGDACEEHGLPHPTVITESGRAVTAHHTVLVSNIIGVERSEITEATPPADDAPRSLQSMWETWQEMHEPGTRRSLREWLHDSQMDLHDIHVGYSSGTFSLQERAWAEQLYLNMCHEVQKQLDPSNRAHRPIIDELQERMADKMYVNFSLFQSMPDAWGIDQLFPVLPLEGLNHAPERRAVLLDITCDSDGAIDHYVDGDGIATTMPMPEYDPENPPMLGFFMVGAYQEILGNMHNLFGDTEAVDVFVFPDGSVEVELSDEGDTVADMLEYVQLDPKKLLTQFRDQVKNTGLDDALQQQFLEEFEAGLYGYTYLEDE

SEQ ID NO: 9894 - protein, 145 aa, Enterobacter cloacae
SINKFVTLSLDETFIAFILTVLNKKQSFIYETKAWRIVMSWIGVCDAEQVQEDFPFSGNVDGKEIGVYLIDGEYYALEDVCPHAYALLSQGFVEDGKVECPLHEAVFDVKTGQCLHGPGGRNLNRYPVRVFENQIQITFVEETVA

SEQ ID NO: 9895 - protein, 371 aa, Enterobacter cloacae
TRCACTTSRASRGATPASGHSYRLTATEGNAMTTTVQHYLDKGLRGLWYPVLASWEVQSAPVGITRLGEQIVVWRNKDGQVQALEDRCPHRGARLSMGWNLGDRIACWYHGVEVAGNGEVKDVPAVDKCPLVGQQCVRSYSVQEAHGAIFLWFGVTADQQPDELTFPDELADTDSFSNFLCTAAWKCNYQYALENVMDPMHGTYLHSSSHSMAEGDRKADMVLQPTKTGFIFEKKGQSGVNFDWVELGNSGTCWMRLSIPYKKRFGPGGHFFIVGMVVPEDNDNCRVFFWRIRRVQGWQRDMWRFMYRNRLEKLHWEVLEQDRVVLESLAPNARDHEYLYQHDVGLSRLRRMMQKAAKEQLAMREAQQGAA

SEQ ID NO: 9896 - protein, 183 aa, Enterobacter cloacae
DVTEESVMTDSIVTNKTGIKPDHLTMEEWVESRIARFEGRKYDWNALKFQADFDPKYRRAQMRYIGTGATGVANDTNTVQADHFTFSTMVLPSKCEGPLHLHDDVEEVFFMLKGQITLMIQDGDNYTETVLRERDLISVPPGIYRGLFNHGEEEALMCVMLGTNKPEIPTYPSDHPLSKVKRN

SEQ ID NO: 9897 - protein, 259 aa, Enterobacter cloacae
GGMMTGFREQGSGIPLMLLHGISSGAASWHKQMALNGFRVLAWDMPGYGESPMLAVARANAGDYADALAAMLDRAGVWQAVLVGHSLGALVASAFAAKFPDRVIHLVLADAAQGYGNAAPEQREQVWRNREQQMALGGEILAQTRAPKLLRPGARAEDIATVAAGMRVLRPEGYLAASWMLAHDDIHGWLKRYSGSFEVWCGEQDAITQPELVQGLALRYGMPFIAIPQAGHASYLDNDAFFNQQLLRINEEVRDECTN

SEQ ID NO: 9898 - protein, 394 aa, Enterobacter cloacae
ESTRGFTMSVIKMTDLDLAGKRVFIRADLNVPVKDGKVTSDARIRASLPTIELALKQGAKVMVTSHLGRPTEGEYNEEFSLLPVVNYLKDKLSSPVRLVKDYLDGVEVAEGELVVLENVRFNKGEKKDDETLSKKYAALCDVFVMDAFGTAHRAQASTHGIGKFADVACAGPLLADELEALGKALKEPARPMVAIVGGSKVSTKLTVLDSLSKIADQLIVGGGIANTFVAAQGHNVGKSLYEADLVDEAKRLLGTCDIPVPTDVRVATEFSETATATLKSVNDIKDEEQILDLGDVSAQKLAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 9899 - protein, 284 aa, Enterobacter cloacae
MEQLDVVDSINNAGNWLVRNQALLLSYAVNIVAAIAIIIVGMIVARIVSNAVNRVMVARHIDATVADFLSALVRYGIIAFTLIAALGRVGVQTASVIAVLGAAGLAIGLALQGSLSNLAAGVLLVTFRPFRSGEYVDLGGIAGTVLQVQIFSTTLRTVDGRIVVVPNGKIIAGNIINFSREPVRRNELIISVAYDSDIDQVKSLITNIIASDDRILKDREQTVRLNELGASSINFVVRIWSKSSDLQNVYWDVLERIKRDFDANGISFPYPQMDVNVKKVKEAE

SEQ ID NO: 9900 - protein, 260 aa, Enterobacter cloacae
ALLTGHSSQHGGMTVKFKVMALAALVSLGAVSVQANELPNGPHIVTSGTASVDAVPDVATLAIEVNVAAKDAASAKKQADDRVAQYLSFLEQNGVAKKDISSANLRTQPDYDYQNGKSILKGYRAVRTVEVTVRQLDKLNGLLDGALKAGLNEIRSVSLGVAQPEKYKDEARKAAIDDAIHQAQQLASGFKSKLGPVYSVRYHVSNYQPSPMVRMMKADAAPVSAQETYEQPTIQFDDQVDVVFQLEPTQTQQTEAAKAQ

SEQ ID NO: 9901 - protein, 127 aa, Enterobacter cloacae
RMRMSIQNEMPGYKDLNQLLNQQGVGLTPAEMHGLISGILCGGNSDSSWQPLIHDLTNERLAFGHELAEALRKMHAATSDSLEDDGFLFQLYLPEGDDVSVFDRADALAGWVNHYLLGLGVTQPKLE

SEQ ID NO: 9902 - protein, 199 aa, Enterobacter cloacae
SSGTLSPRRWASLTASSARSRSAISPASTTRRCTTCWPRILTWWRCRASRPPATPFRPRKCAVYSRHSSFPGSGRLSRTPPSRTSKHIIVRVRKSHNYQEFIMNIVREALAGTQESSDLMVKIAPAHGELEIVIHSEVIKQFGEQIRQVVNDTLRAMNVHQGLIIIEDKGALDCVIRARLQSALLRAANEQAINWGALK

SEQ ID NO: 9903 - protein, 555 aa, Enterobacter cloacae
LRRQKRASVTAWAWCRSTAKWWMHRLLTTRRWCWSARRPPACVGKDDIMNQTELLHMNFPHLRDLKPFDTAHSATPWLADSEAKHSRKLCASIEEAVKRCGLQDGMTISFHHAFREGDRVINTVVALLARMGFKNLTLASSSLMTCNDALIEHIESGVITRIYTSGMRGRLADAISHGLMEEPVQIHSHGGRVKLLQDGELNIDVAFLGVPCSDEFGNANGTHGKSCCGSLGYAMVDAQFARKVVLLTEALVPFPNMPASLVQDQVDYIVQVESVGDPAKISVGAARVTSNPRELMIARYAADVIEHSGYFKPGFSMQTGSGAAATACTRFMEEKMERSGVKARFALGGITGSLVDLHEKGLIEKLLDTQCFDGQAAASLARNPNHVEISTNVYANPGSKAASCDQLDVVILSALEIDVDFNVNVITGSDGVMRGASGGHCDVAAAANLTIVVAPLLRSRIPTVVKRVTTRLTPGESIDVLVTDHGIAVNPARPEIRERLMEAGMKVVDINALYERAISLTGVPKPIEFTDKIVGVIRYRDGSVIDTVRQVKEEV

SEQ ID NO: 9904 - protein, 268 aa, Enterobacter cloacae
SMTGLLATKPRPVDVPALAEAALWQELELTPKPGLVDRLNNGSHRDMDHALFVRSIMAITPWFARFAELGEAHAAKPADRQLRILRPMGMACEQAMYAATGGVNTHKGGIFALGLLCFAAGRVKNISADSLCCEVSHICRGLVARELAGRSGQATAGERQFQHYGLTGARGEAESGFATVRKALGQWNGQLLHDLLLRLMAVNQDSNLVSRGGIQGLRYVQGYARELLANCWDREALLKMDKALIERNLSPGGSADLLSVGWVLSAIK

SEQ ID NO: 9905 - protein, 327 aa, Enterobacter cloacae
SMDVEEIVALSVKHNVSDLHLCSDSPPRWRRSGRLEPAPFPPPDVEALLKAWLNDEQQGAWWANGQVDFAVTLADRQRLRGSAFKHMHGVSIALRLLPLTCPQLSALGVPRAIPELLSNDNGLILVTGATGSGKSTTLAAMVDFLNHQTDGHILTLEDPVEFMYQSERCLIQQREIGLHSPSFAEALRSALREDPDVILLGELRDSETIRLALTAAETGHLVLATLHTRGAAQAIERLVDTFPAQEKDPVRNQLAGSLRAVLAQKLRQDVQGGRVALYELLVNTSAAANLIREGKTWQLPGIIQTGQQAGMQNFEQSLAERRAQGRL

SEQ ID NO: 9906 - protein, 80 aa, Enterobacter cloacae
FYQGLQDFDTGSLSVNRYGWINIWTSILGHFFTRFPVFFDSPLIALKTLLEIFPDDAGNLRIFVLLFSDLLGIKRGARLI

SEQ ID NO: 9907 - protein, 72 aa, Enterobacter cloacae
TRALLLIQEFSRGFAEPCHTEFGYVFYNDMNKKPVARSGFQHTLLGNGAVNGLLSPYNAAIVVNCFTLNTKS

SEQ ID NO: 9908 - protein, 408 aa, Enterobacter cloacae
PRHAPSAEKAGGGMTSRIVIIGGGQSGGWAAKTLRDEGFDGEICVVAEEEWDFYERPPLSKASLLEPDAALPRLFTDEVQQALNLTWYRPLRAESVDRVEKKVLLSNGEQLSYNILLIATGGRARLPSQAWASHPQVYTLRHWQDAQRLKSRLSESHKLAIIGGGWIGLEIAASARKSGVAVTLFEQQPALCMRSVSGEVSQRLEAIHREQGVEIRTGCGALELEDDGGLPVVHCDGNRETFDAVVVGIGVDLNLELARDAGLKTGRGIVVDAQGRTSDPFIFAAGDVAQHHHYGLCIQSWAFAQNQAVATAKAMLNPDAPGYDDAPWLWSDQYQHNIQILGIPQAGCRTILREEALYFSLDDNGRLTQLVAFNDARTVKLAKRWMAAGRDLSDVPLADPTFSLMSLR

SEQ ID NO: 9909 - protein, 328 aa, Enterobacter cloacae
SVIPAVLKSGAASRMPSPSRSWFRVWRCATACRLSPFRRPGTPAISITTRFSTNSFYALTKRCAMNAQIDGRVAVVTGGSSGIGFETLRLLLGEGAKVAFCGRDEDRLASAHATLQNEFPHGEIFAFRCDVLNADEVQAFADAVQARFGAADMLINNAGQGYVAHFHDTPREAWLHEAELKLFGVINPVQAFQPLLERSDIASITCVNSLLALQPEEHMIATSAARAALLNMTLTLSKELVGKGIRVNSILLGMVESGQWQRRFESRADKSQSWPEWTAEIARKRGIPMARLGKPQEPAQALLFLASPLASFTTGAALDVSGGFCRHL

SEQ ID NO: 9910 - protein, 259 aa, Enterobacter cloacae
GHIMKKVMLIGLGAMAQAVIERLPAGVAIGWIVARASHHPAIHDQFGDAVEALTSPMACAQTPDLVLECASQEAVAQYGEEILRRGWHLAIISTGALADSALEQRLLAAGGKLTLLSGAVAGIDGLAAAKEGGLERVTYQSRKSPASWRGSYAEQLIDLNAVSEAKVFFEGSAREAARLFPANANVAATVALGGVGMEDTRVQLMVDPATKRNTHTLHVEGLFGEFHLELSGLPLASNPKTSTLAALSAVRACRELALS

SEQ ID NO: 9911 - protein, 492 aa, Enterobacter cloacae
GVTMDDLKIFIGGQWRRGGGNPMQSHFPADGSLNATLNAASLDDLEEAVAAGERAWRDPAWRNSLPHMRAKILHKVADLIESRVDALAQMQSRDNGKPLAEARGLVMSAAGTARYFAAACELLEGELPTPRQPDLLTLSCYEPLGVVAAITPWNSPIASEMQKVAPAIAAGNAVILKPAEATPLMALELARIFKQAGLPAGLLSVLPGKGSVIGDALARHPRVRKISFTGGTTTGRHLAHVAAEKLIPASLELGGKSPTIVLEDADIEQAARGICYGIFSSAGQACIAGSRLFIHESIYAPLMARLLELTRGLRVGHPFTDGVHVGPLINEKHRQSVIQYVELAKREGGRVLCGGEIPADPALVNGSFFLPTIIEGLSNSARACQEEIFGPVLVAMPFGDEATLIHEANDSVYGLAAGIWTRDTGRALRLSEQLEAGTVWINTYKVFAISTPFGGFKESGLGREKGIQGLKAWMQQKSIYLATGNSVNHWCD

SEQ ID NO: 9912 - protein, 727 aa, Enterobacter cloacae
GISTGAGEQIAQHASMIQRFLKQQKNAPCTCPAAWVTLLALFSGVAQNALSSRAWPLTVRSGVKMSSRKELANAIRALSMDAVQKAKSGHPGAPMGMADIAEVLWRDFLNHNPQNPAWADRDRFVLSNGHGSMLIYSLLHLTGYDLPIEELKNFRQLHSKTPGHPEVGYTAGVETTTGPLGQGIANAVGMAIAEKTLAAQFNRPGHDIVDHFTYAFLGDGCMMEGISHEVCSLAGTLKLGKLVAFYDDNGISIDGHVEGWFTDDTAARFEAYGWHVVRGVDGHDADSIKRAVEEARAVTDKPSLLMCKTIIGFGSPNKAGTHDSHGAPLGDAEIALTREALGWKHPAFEIPSEIYAQWDAKEVGQAKEAAWNEKFAAYAKAFPQEAAEFTRRMKGDMPSDFDAKANEFIAKLQANPAKIASRKASQNAIEAFGPLLPEFLGGSADLAPSNLTLWSGSKPINEDTAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTPEQLANIARGGYVLKDCAGQPELIFIATGSEVELAVAAWEKLTAEGVKARVVSMPSTDAFDKQDAAYRESVLPKAVSARVAVEAGIADYWFKYVGLNGAIVGMTTFGESAPAEQLFEEFGFTVENVVAKAKELL

SEQ ID NO: 9913 - protein, 235 aa, Enterobacter cloacae
YYPFPLMTFPQYSLPPGQLCENYVMLSYYFQGLVLGAAMILPLGPQNAFVMNQGIRRQYHLMIALLCAVSDLLLICAGIFGGSALLMQSPWLLALVTWGGVAFLLWYGFGALKTAMSSNLELASAEVMKQGRWKIIVTMLAVTWLNPHVYLDTFVVLGSLGGQLDVEPKRWFALGTVSASFLWFFGLAILAAWLAPRLRTAKAQRIINTLVGLVMWFIAFQLAKEDIHHVQGLFN

SEQ ID NO: 9914 - protein, 231 aa, Enterobacter cloacae
CALSFHTTGKTIMTQDELKKAVGWAALQYVQPGTIVGVGTGSTAAHFIDALGTMKGQIEGAVSSSDASTEKLKSLGITVFDLNEVDRLGIYVDGADEINGHMQMIKGGGAALTREKIIASVADKFICIADASKQVDILGNFPLPVEVIPMARSAVARQLVKLGGRPEYRQGVVTDNGNVILDVHGLEILDAIALENAINGIPGVVTVGLFANRGADVALIGTADGVKTIVK

SEQ ID NO: 9915 - protein, 410 aa, Enterobacter cloacae
MAKVSLEKDKIKFLLVEGVHQKALDSLRAAGYTNIEFHKGALDTEELKASIRDAHFIGLRSRTQLTEDVIAAAEKLVAIGCFCIGTNQVDLNAAAKRGIPVFNAPFSNTRSVAELVIGELLLLLRGIPEANAKAHRGVWNKLAAGSYEARGKKLGIIGYGHIGTQLGILAESLGMHVFFYDIESKLPLGNATQVQHLSDLLNMSDVVSLHVPENASTKNMMGAEELALMKPGSLLINAARGTVVDIPALCDALKRKHLAGAAIDVFPTEPATNSDPFTSPLCEFDNVILTPHIGGSTQEAQENIGLEVAGKLSKYSDNGSTLSAVNFPEVSLPLHGGRRLLHIHENRPGVLTAINQIFAEQGVNIAAQYLQTNSQMGYVVIDIEADEDIAEKALQSMKAIPGTIRARLLY

SEQ ID NO: 9916 - protein, 373 aa, Enterobacter cloacae
FPGREHISSCRWLITQTSRMHKKDNHIRGQSRFCPHKRLNNAFMLHASTSPFYPLFAALDVNAKIHEGESGRRLWAECVELGIEARKAIIANCHMIKPFIPPVVAGRPWQDHPTQAIASERRFFSFEPGAKWHGFEGYAREQYFVDPCKLLLTTPGIDAETGHYTDFGIPATILAHYLRENGIVPEKCDLNSILFLLTPAESAEKLMQLVAMLGQFEQHIEDDTPLADVLPTIYQKYPVRYRDYTIRQLCQEMHDLYVSFNVKDLQKAMFRQESLPAVVMNPQDANQEYIRGNVELVRIRDAEGRIAAEGALPYPPGVLCVVPGEVWGGAVQRYFLALEEGINMLPGFSPELQGVYSEKDADGIKRLYGYVLK

SEQ ID NO: 9917 - protein, 307 aa, Enterobacter cloacae
RLHLSADSGQLPRLSFQERTMKLASFLYQGKRSYGIVQADGVIDLGRRLGDRYGDLKALLQGNGLAQATRFLNDAVDVPLNAITFLPVIVQPEKILCVGMNYADKRKEFDQHNPAPTLFVRFPDSQTGHNEPVLKPRHSSEFDYEGELAVIIGKGGENISRDDALRHVAGYSCYMDGSARDWQHTWFTAGKNWRQTGAFGPWMATADEIPDPHQLAIRTWLNGRMVQEDNTSSMIHKVAELIEYISTFTRLSPGDVIITGSPGGVGKKRNPPLFMKEGDRIEVEIEHIGHLSNVIVEAPAVGLAAAH

SEQ ID NO: 9918 - protein, 128 aa, Enterobacter cloacae
TAWPSSWSRRMGLNVREGEIMAKNRSRRLRKKMHIEEFQEVGFSVAWRFPEGTSVEQIDQDVDAFINEVIEPNKLAFDGSGYLAWEGLICTQEVGKCTEEHQALVRKWLEDHKLEDVRVSELFDVWWD

SEQ ID NO: 9919 - protein, 256 aa, Enterobacter cloacae
SKNGASISWPILSEGVFKMRKTLLAVALLAIGSTAHAEYKCSVTPRDDVVLSPQTVQVKGENGNLVITPDGNVTFNGKPQNLTAAQREQAMDYQAELRTALPWINDGALTRVEKSRVALDKIITKEVGESSNMRTRLTKLDKQLKEQMNRIIETRSDGLTFHYKAIDQVRADGQQLVNQAMGGILQDSINEMGAKAVLKGGGNPLQGVLGSLGGLQTSIQNEWKNQEADFQQFGKDVCKRVVSLEDSRKALVGTLK

SEQ ID NO: 9920 - protein, 315 aa, Enterobacter cloacae
CIDFIRGQDMSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDAGQVNDRGVDDILAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 9921 - protein, 256 aa, Enterobacter cloacae
STAGSRLMNGLLSGKRIVITGAARGLGFHFAKACAEQGAAVVMCDILKGELAESAHALSERGYAIEPHVIDLADPQSIEQVFSAIGEQGQIDGLVNNAAMATGVGGKNMLDYDPDLWDRVMSVNVKGTWLVTRAAVPLLREGAGIVNVASDTALWGAPRLMAYVASKGAVIAMTRSMARELGEKRIRINAIAPGLTRVEATEYVPAERHQLYENGRALTGAQQPEDVTGSVVWLLSDLSRFITGQLIPVNGGFVFN

SEQ ID NO: 9922 - protein, 266 aa, Enterobacter cloacae
GRAMMANDQEVKYLVPGLERGLQLLLAFGEQHRDLTFAELHRLVDMPKATAYRVVQTLEYMGFLERNTRTNTFSLGMNVLRLGFEYIASLDVAQVGQPVIEQLRDVSQCSSHLAIRDGRDIIYIARVSAAGSRINQVSIGTRLPVHCTSLGRMLLTDISRADFEQLFPHERLPGNTPGQLHDREALWQMVQQDKARGYVIGESFFRHGISSIVYPVYDRSGRVAAVVSILVPSEEIPQSDRERLQNEVRLAADKISGFLGYLSQAS

SEQ ID NO: 9923 - protein, 325 aa, Enterobacter cloacae
LRRACFTPNLGQMRQRTMSVTGIEKLEFGVEDLTHCAKFMRDFGLTGDASGQRFTTLSGARVELNPIDSPDLPPAFEAGNTLRRMTWAVAAQSDLDALRPKLAQQPGFREVGDALECLDPNGMTLRVQVTQQTDVELNVEPINQWGDARRIDTPSPVYDRAQPINVGHVVFFVEELAAVEKFYREVLGFQVSDRYINRAVFLRCGVRGGHHNLFLLQLPNRKRGLNHVAFTVRDIHEVIGGGIAMNKHDWSTFIGPGRHPVSSAYFWYVNSPTGGAFEYYTNDDYLTENWQPRELEHSLVSFTEWAVEGGIDHDTRRQQKKPEAV

SEQ ID NO: 9924 - protein, 425 aa, Enterobacter cloacae
PAPVGGEMTTLETNTAPVEASGEGTRTPEKAVRWAIPLSLLACVLLAFFDKISIAALFSDTHFQQAMGIDFDTTRLGILMSAFLLSYGFSSVFLSGLGDKIAPLRLLTGMMAVWCVLMVAMGFTHNYTLMIVLRILLGVAEGPLFPLAFAIVRHNFPQHLQARATMLWLLGTPVGAAIGFPLSLWLLNTFGWQSTFFVMAMLTVPVLILVRIGLRGIRLEAKPGTSQASQDERRAARRELFVSPHFWIICIFNIAFLTYLWGINGWLPGYLIKGKGIHLEHAGWLSSMPFIAMLAGEVIGAWLSDRVDKRAAACFISMAGAAVGLAAVMHLDTPLAIIAAMSFSTFMWGTGAPNIFALLAKATHPRVSATAGGIFNGLGNFAGALSPAVMGALIAFTHSMDSGLIFLAVMAAVGCVLLLPLLRRY

SEQ ID NO: 9925 - protein, 547 aa, Enterobacter cloacae
AMSEMITVGDAIARTLEQYQVEAIYGVISIHNLPIADAVGQRGNIRFVPARGEAGSVTMADAHGRFSGLGVALTSTGAGAGNAVGALVEAMNACTPLLHLTGQVEKAWLDADTGFIHETRDQLTFLKASSKRAYRISNANQAIAILHKAIQDAQTPPCGPVSVEIPIDIQSAKIPLSLVTAPIKPVSAPAVDTGMVDALWAQLKQAKQPLLWLGGGALGSAEAVKKLADAGITVISSTHARGVLPDNHRASLRAFHNSPSVEALIAQCDFTLVAGSRLRSNETRSWTLELPSPRVQLDIDPAAASRNYLMDSTLIADCSALLGALAEKVQGREWGNAQWDTQVQQAVGQAEQGLREQCGAYAKLNDAIEKALPKDGLLVRDITVSGSLWGSRLFRANGPLMNIHSLAGAIGMGLPMAIGTAIANPQRKVVGLVGDGGLSLNLGELATLAQEKANVTLLIMNDGGYGVMRGIQDKYFGGRQYYNALHTPDFTLLAQAIGLQAWSVEQAEDFDAVMMEALAMPGPSVVEVRMGQIGALKFAGPPQKTLY

SEQ ID NO: 9926 - protein, 344 aa, Enterobacter cloacae
LCRRSMTVRVAINGFGRIGRNVVRALYESGRRAEITVVAINELADAAGMAHLLKYDTSHGRFAWDVRQEREQLFVGDDAIRVLHENSIEGLPWRELGVDVVLDCTGVYGNREHGEAHLNAGAKKVLFSHPGSNDLDATVVFGVNQHELHAEHRIVSNASCTTNCIIPVIKLLDDAYGIESGTVTTIHSAMHDQQVIDAYHPDLRRTRAASQSIIPVDTKLAAGITRIFPQFNDRFEAIAVRVPTINVTAIDLSVTVKKPVKACEVNLLLQKAAQGAFHGIVDYTELPLVSVDFNHDPHSAIVDGTQTRVSGAHLIKTLVWCDNEWGFANRMLDTTLAMAAKGFR

SEQ ID NO: 9927 - protein, 392 aa, Enterobacter cloacae
EVSHSGAGKPAQFSARLSELAPFLTAEDTGLSNMSKIFDFVKPGVITGDDVQKVFQVAKENNFALPAVNCVGTDSINAVLETAAKVKAPVIVQFSNGGAAFIAGKGVKTDIPQGAAILGAISGAHHVHQMAEHYGVPVILHTDHCAKKLLPWIDGLLDAGEKHFAATGKPLFSSHMIDLSEESLEENIEICSKYLARMSKMGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSSAQEIKDSVSYGVVKMNIDTDTQWATWDGILQYYKTNEAYLQGQLGNPKGEDQPNKKYYDPRVWLRAAQTSMITRLEQAFKELNAVDVL

SEQ ID NO: 9928 - protein, 643 aa, Enterobacter cloacae
IPHSVSSGMTRSNCWIQETDMLYKGDTLYVDWLEDGIAELVFDAPGSVNKLDTATVASLGQALDVLEKQSDLKGLLLRSNKAAFIVGADITEFLSLFLVPEEQLSQWLHFANSVFNRLEDLPVPTLSAVNGYALGGGCECVLATDYRLATPDLRIGLPETKLGIMPGFGGSVRMPRMLGADSALEIIAAGKDVGAEQAQKIGLVDGVVKPEKLVEGALAILRQAINGDLDWKAKRQPKLEPLKLSKIEATMSFTIAKGMVMQTAGKHYPAPITAVKTIEAAARLGRDDALKLENQSFVPLAHTNEARALVGIFLNDQFVKGKAKQLTKNVETPKHAAVLGAGIMGGGIAYQSAWKGVPVVMKDINEKSLTLGMTEASKLLNKQLERGKIDGLKLAGVISTIQPVLEYSGFDRVDVVVEAVVENPKVKKAVLAETEDKVRPETVLASNTSTIPISELASVLKRPENFCGMHFFNPVHRMPLVEVIRGEKTSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVDGPAGRRQSAETRLH

SEQ ID NO: 9929 - protein, 347 aa, Enterobacter cloacae
MFLLSQLHIPLQKGLIIMKIKNLTLTLCTTLLLASFAGHAKEVKIGMAIDDLRLERWQKDRDIFVKKAESLGAEVFVQSANGNEETQMSQIENMINRGVDVLVIIPYNGQVLSNVVKEAKQEGIKVLAYDRMINNADIDYYISFDNEKVGELQAKSLVAKVPQGNYFLMGGSPVDNNAKLFRQGQMKVLKPYIDEGKIKVVGDQWADGWLPENALKIMENALTANNNKIDAVVASNDATAGGAIQALSAQGLAGKVAISGQDADLAGVKRIIAGTQTMTVYKPITELANTAAEIAVELGNGQQPKADATLNNGLKDVPARLLTPIEVNKENIDATVVKDGFHKKSEL

SEQ ID NO: 9930 - protein, 537 aa, Enterobacter cloacae
SSAAPARQGRIDLPCTSVGPCGAVMSYLLEMKSITKAFGAVKAVDNVSLRLNPGEVMSLCGENGSGKSTLMKVLCGIYPHGSYEGEIVFAGEVLQATHIRDTERKGIAIIHQELALVKHLTVLENIFLGAELSRHGVLDYDTMTLRCEKLLAQVSLAISPDTRVGDLGLGQQQLVEIAKALNKQVRLLILDEPTASLTEQETAVLLNIIRDLQNHGIACIYISHKLNEVKAISDTICVIRDGQHIGTREAEGMSEDDIITMMVGRELTALYPNEPHTIGEELLRVENLTAWHPVNRHIKRVDNLSFSLHRGEILGIAGLVGAGRTEAVQCLFGVWPGRWEGKIYIDGQPVKIDNCQQAIAKGIAMVPEDRKKDGIVPVMAVGKNITLAALSQFSGALSSLDDAAEQQCILQSLARLKVKTSSPELAIGRLSGGNQQKAILARCLLLNPRILILDEPTRGIDIGAKYEIYKLINQLVQQGIAVIVISSELPEVLGLSDRVLVMHEGKLKANLNNQNLTQEQVMEAALRSERHVEKQPV

SEQ ID NO: 9931 - protein, 527 aa, Enterobacter cloacae
PSPTGRGRKPNRRPGKRSTRQLSEKKMSEKEPFWLGIDCGGTYLKAGLYNSQGKEVCIERRSVATLSPRAGYAERDMHQLWQHCHITVALLLKNSGADGGQIKGVGISAQGKGLFLLDKQDRPLGNAILSSDRRALEIVQRWQQDGIPEKLYPHTRQTLWTGHPASLLRWVKENEPQRYQQIGSVMMAHDYLRWCLTGVKGCEESNISESNLYNMNTGQYDPQLTRWLGISDIDGALPSIIGSAEICGEITAQAAALTGLTAGTPVVGGLFDVVSTAICAGLHDEHTLNAVMGTWAVTSGIAHGIRDNEPFPYVYGRYVHPQQFIVHEASPTSSGNLEWLTAQWGDMSFDEINHAVASLPKAESDVFFLPFLYGSNAGLEMTSGFYGLQALHTRAHLLQAVYEGVVFSHMTHLNRMLERFPHVQALRVTGGPTHSDVWMQMLADVSGLAIELPQVEETGCSGAALAALVGTGLYPDFYAAQRALRHDIRMIEPDMRAHAAYQRKYHRYQLLISALQGYHARVKEYDL

SEQ ID NO: 9932 - protein, 240 aa, Enterobacter cloacae
SPNAGRRHDMLEQLKAEVLAANLALPAHQLVTFTWGNVSAVDRASGMMVIKPSGVEYDVMTAEDMVVVNIATGKVVEGSKKPSSDTPTHLALYRRYPEIGGIVHTHSRHATIWSQAGQDLPAWGTTHADYFYGAIPCTRLMTTAEIAGEYEYQTGVVIIKTFEERDISPMQVPAVLVHSHGPFAWGKDAADAVHNAVVLEECAYMGLFSRQLAPQLPVMQQELLEKHYLRKHGANAYYGQ

SEQ ID NO: 9933 - protein, 650 aa, Enterobacter cloacae
TSGHKPKRKHKKGCFMSSDFKIKVQSFGRFLSNMVMPNIGAFIAWGIITALFIPTGWLPNETLAKLVGPMITYLLPLLIGYTGGRLVGGDRGGVVGAITTMGVIVGADMPMFLGAMIAGPLGGWAIKKFDVWVDGKIKSGFEMLVNNFSAGIIGMILAILAFLGIGPAVEVLSKLLAAGVNFMVAHDMLPLASIFVEPAKILFLNNAINHGIFSPLGIQQSHDLGKSIFFLIEANPGPGMGVLLAYMFFGRGSAKQSAGGAAIIHFLGGIHEIYFPYVLMNPRLILAVILGGMTGVFTLSVLGGGLVSPASPGSILAVLAMTPKGAYFANIAAICAAMAVSFVASAILLKTSKVKEDDDIEAATRRMHDMKAESKGATPLAAGDVSNDLSHVRKIIVACDAGMGSSAMGAGVLRKKVQDAGLTNISVTNSAINSLPPDVDLVITHRDLTERAMRQVPQAQHISLTNFLDSGLYTSLTERLVAAQRHEDNEVKVRTSLQDSFDESNAHLFKLGAENIFLGRTATNKEEAIRFAGEQLVKGGYVQPEYVEAMLEREKLTPTYLGESIAVPHGTVEAKDRVLKTGVVFCQYPDGVRFGEEEDDIARLVIGIAARNNEHIQVITSLTNALDDETVIERLANTTSVEEVLALLNK

SEQ ID NO: 9934 - protein, 591 aa, Enterobacter cloacae
PFIAINPTSQYWKDHFYTKCDAEMSRDSPDEHPCGPQETCMSLWQQNYDPAGNIWLSSLIASLPILFFFFALIKLKLKGYLAATYTVAIALLVALFFYKMPVDRALASVVYGFFYGLWPIAWIIIAAVFVYKISVKTGQFDIIRSSILSITPDQRLQMLIVGFSFGAFLEGAAGFGAPVAITAALLVGLGFNPLYAAGLCLIVNTAPVAFGAMGIPILVAGQVTGLDSFEIGQMVGRQLPFLTIIVLFWIMAIMDGWRGVKETWPAVMVAGGSFAIAQYLSSNFLGQELPDIISSLVSLVCLTLFLKRWQPVRIFRFADMGASHVDQTLARTGYTAGQIVRAWSPFLFLTATVTLWSIPPFKALFAPGGALYDMVINISVPFLDKMVARMPPVVHDATPYAAVFKFDWFSATGTAILFAAILSVVWLRMKPAAAVQTFAATIKELMLPIYSIGMVLAFAFISNYSGLSSTLALALAHTGHAFTFFSPFLGWLGVFLTGSDTSSNALFAALQATAAQQIGVSDVLLVAANTTGGVTGKMISPQSIAIACAAVGLVGKESDLFRFTVKHSLIFTCMVGVITTLQAYVLTWMIP

SEQ ID NO: 9935 - protein, 174 aa, Enterobacter cloacae
WRRASRSACRKTIATPLTPCSTPTALVRKTVWASGAIKKTAKANRKKKKMRRWMALLADVSQPKRDFTDDEIIARMMIPMINEVVRCLEEGIIASPAEADMALVYGLGFPPFHGGAFRWLDTLGSARYLDMAQQYQHLGPLYEVPEGLRNKARHNEPYYPAVEPARPVGALKTA

SEQ ID NO: 9936 - protein, 390 aa, Enterobacter cloacae
GVTMEKVVIVDAIRTPMGRSKGGAFRNVRAEDLSAHLMRSLLARNPALDPAALDDIYWGCVQQTLEQGFNIARNASLLAEIPHSVPAVTVNRLCGSSMQALHDATRMIMTGDAQACLVGGVEHMGHVPMSHGVDFHPGMSRNVAKAAGMMGLTAEMLSRLHGISREMQDAFAARSHARAWAATQSGAFKNEIIPTGGHDADGVLKQFSYDEVIRPETTVEALSTLRPVFDPVTGTVTAGTSSALSDGAAAMLVMSESRARELGLTPRARVRSMAVVGCDPSIMGYGPVPASKLALKKAGLSASDIDLFEMNEAFAAQILPCIKDLGLMDQIDEKINLNGGAIALGHPLGCSGARISTTLINLMERKDAQFGLATMCIGLGQGIATVFERV

SEQ ID NO: 9937 - protein, 379 aa, Enterobacter cloacae
QHVYRLKSVILRISPAPYKLAWLNSEFSKGKVLRNRSHTFFIRNTEELMQSKINWIDNLRGIACLMVVMIHTTTWYVTNAHSISPVNWDVANVLNSASRVSVPLFFMISGFLFFGERSAQPRHFIRIVSCLLFYSAISLLYIVLFTSINAERSLLNLLQKPVFYHLWFFFAIIVIYLVSPLIQVKNVNGKMLLALMVVIGIVANPNTVSQKIDGFEWLPVNLYITGDTFYYVLYGMLGRAIGMMETQKRGINWLCAAAFLVGVFIISRGTLHELQWRGNFADTWYLYCGPMVFICAISLLTLVKNTLNARPLPVLGFISRHSLGIYGFHALVIHALRTRGVELKSWPVLDIVWIFTVTLVVSLLLSMLLQRIDTRRFVS

SEQ ID NO: 9938 - protein, 397 aa, Enterobacter cloacae
GANAMSKSNPSDIKVAVPTPGAFAGLKSLNLQVFVMIAAIIVIMLFFTWMTDGSYLSARNVSNLLRQTAITGILAVGMVFVIISAEIDLSVGSMMGLLGGVAAIFDVWLGWPLPLTIAVTLVLGLLLGAWNGWWVAYRKVPSFIVTLAGMLAFRGILIGITNGTTVSPTSASMSQIGQSYLSDGVGFTIGVVGLMAFVAWQWRGRMRRQALGLASPASTSVVGRQALTAVIVLGAIWLLNDYRGVPTPVLLLALLLLGGMFMATRTAFGRRIYAIGGNLEAARLSGINVERTKLAVFAINGLMVAIAGLILSSRLGAGSPSAGNIAELDAIAACVIGGTSLAGGIGSVAGAVMGAFIMASLDNGMSMMDVPTFWQYIVKGAILLLAVWMDSATKRRA

SEQ ID NO: 9939 - protein, 393 aa, Enterobacter cloacae
AMFEKRHRITLLFNANKAYDRQVVEGVGEYLQASQSEWDIFIEEDFRTRLENIKDWLGDGVIADFDDPVIEQLLSGVDVPIVGVGGSYHTPEHYPPVHYIATDNHALVETAFLHLKEKGVHRFAFYGLPATSGKRWAMEREYAFCQLVAQEKYRGVVYQGLETAPENWQHAQNRLADWLQTLPPQTGIIAVTDARARHVLQVCEHLHIPVPEKLCVIGIDNEELTRYLSRVALSSVAQGTRQMGYQAAKLLHRLLDNESLPLQRLLVPPVRVVERRSTDYRSLNDPAVIQAMHYIRNHACKGIKVDQVLDSVGISRSNLEKRFKEEVGETIHAVIHAEKLEKARSLLISTSLSINEISQMCGYPSLQYFYSVFRKEYDTTPKEYRERYSEVLL

SEQ ID NO: 9940 - protein, 465 aa, Enterobacter cloacae
GAFTRTIHHTNTNPPHKTTNPTTSADLHQHGAGVMVTAFHIKPDRSPAMTFSLFGDKFTRHSGITRLMEDLNDGLRTPGAIMLGGGNPAQIPEMNTYFQTLLAEMLENGKATDALCNYDGPQGKTELLTLLAAMLREALGWDIEPQNIALTNGSQSAFFYLFNLFAGRRADGTTKKVLFPLAPEYIGYADAGLEEDLFVSARPNIELLPEGQFKYHVDFEHLHIGEETGMICVSRPTNPTGNVITDDELMKLDALANQHGIPLVIDNAYGVPFPGIIFSEARPLWNPNIILCMSLSKLGLPGSRCGIIIANEKIITAITNMNGIISLSPGGIGPAMMCEMIRRNDLLRLSNEVIKPFYSQRVQETIAILRRYLPEERCLIHKPEGAIFLWLWFKDLPITTELLYQRLKKRGVLMVPGDYFFPGLDKPWPHTHQCMRMNYVPDPEKIEAGVKILAEEIENAWREAG

SEQ ID NO: 9941 - protein, 338 aa, Enterobacter cloacae
KNRRTGMKVTFEELKAAFNRVLLDRGVKADTADACAEMFARTTESGVYSHGVNRFPRFIQQLDAGDIIPDAQPKRVTTLGAIEQWDAQRSIGNLTAKKMMDRATELASDHGIGLVALRNANHWMRGGSYGWQAAEKGYIGICWTNSIAVMPAWGSKECCIGTNPLIVAIPSNPITMVDMSMSMFSYGMLEVNRLAGRELPVDGGFDDEGNLTREPGVIEKNRRILPMGYWKGSGLSIVLDMIATLLSDGASVAEVTQDNSDEYGVSQIFIAVEVDRLIDGPTRDAKLQRIMDFITTAERADENVAVRLPGHEFTRLLEENRRDGITIDDSVWAKIQSL

SEQ ID NO: 9942 - protein, 452 aa, Enterobacter cloacae
RIHFPVTFTEILTMNISSNALHADIPRQRWLRIIPPILIACIISYMDRVNIAFAMPGGMDEELGISATMAGLAGGIFFIGYLFLQVPGGKIAVHGSGKKFIGWSLVAWAVISVLTGLVTNQYQLLVLRFLLGVAEGGMLSVVLTMISNWFPDAERGRANAIVIMFVPIAGIITAPLSGWIITALDWRWLFIIEGLMSVVVLVLWAFTVYDRPQEARWISEAEKNYLVQTLAAEQQAIAGKEVKNASLSAVLSDKTMWQLIALNFFYQTGIYGYTLWLPTILKELTHTSIGQVGMLAILPYIGAIAGMFLFSSLSDRTGKRKLFVSLPLIGFALCMFLSVALKEHTWLAYAALVGCGFFLQSAAGVFWTIPARLFSAEMAGGARGVINALGNLGGFCGPYAVGVLITLYSKDAGVYCLAVSLALASLLALLLPAKCDAGAEPNPTVTPHKRAA

SEQ ID NO: 9943 - protein, 306 aa, Enterobacter cloacae
SAAGGTGIPFANPRHLGRVTMRQHPLGIYEKALPKDLSWPERLVLAKSCGFDFVEMSVDETDERLSRLEWSTTQRASLVEAMLETGVAIPSMCLSAHRRFPFGSRDEIVRERAREIMTKAIRLARDLGIRTIQLAGYDVYYEEHDEGTQQRFAEGLAWAVEQAAAAQVMLAVEIMDTAFMNSISKWKKWDDMLASPWFSVYPDVGNLSAWGNDVTAELTLGIDRIAAIHLKDTRPVTEQSPGQFRDVPFGEGCVDFVGVFNTLNQLNYRGAFLIEMWTEKAKEPVLEIIQARRWIEARMQEGGMTC

SEQ ID NO: 9944 - protein, 475 aa, Enterobacter cloacae
KNRLSRSYPMTSTPITDAEVAKQAADERLSVREKIGYGLGDAGGTVITCLIMNFLTFFYTDVFGLTPALVGTLFIALRVFDAISDPVMGVIADRTQSRWGRFRPWQLWVALPIGIVGVLTFTVPDASMGVKIAWAFGTYLLLSVGYTAINVPYCALINTMTTRHNEVISCQSWRFVLCGVAGFLVSVGLPWLVSELGQGNTARGYQLGVGVLCAIAVVMFLCCFFWVRERVPLALMGKFTLREHLAGLRKNDQLLLMLVMSFLLINVFNIRGGGYMYFITYVLQGSTAYTSLFFTMVTFAAILGAVIVSPLSRRIDTVKLYYYTNLVLAALAVGMWFLPGGPAHQTLWLIVILSNGVILGFTLPLHFSLMAFADDYGEWKTGVRSSGMNFAFNLFFIKLAWASSAGIISLVFIAVAYQPGAGNQTPASLQGITAMETLLPALFHLLLAVAIRWCRLNNPVMSRIATDLRQRHVQS

SEQ ID NO: 9945 - protein, 209 aa, Enterobacter cloacae
RSCGGGQRIQRNQMMQSPAQVSLRPNNRLSDMQAIMEQTQAFENRVLERLNAGKTVRSFLIAAVELLTEAVNILVLQVFRKDDYAVKYAVEPLLDGDGPLGDLSVRLKLIYGLGVLNRQEYEDAELLMALREELNHDGNEYTFTDDEILGPFGELHCVSALPPAPQFDNSDPELYAMQKLRYQQVVRSTMVLSLTELISKISLKKAFQK

SEQ ID NO: 9946 - protein, 317 aa, Enterobacter cloacae
  UNSURE (293)
YFQGEQSMIISAASDYRAAAQRILPPFLFHYIDGGAYAEYTLRRNVEDLSEVALRQRVLKNMSDLSLETKLFNETLSMPVALAPVGLCGMYARRGEVQAAAAADAKGIPFTLSTVSVCPIEEVAPTIKRPMWFQLYVLRDRGFMRNALERAKAAGCSTLVFTVDMPTPGARYRDAHSGMSGPNAALRRYWQAVTHPQWAWDVGLNGRPHDLGNISAYLGKPTGLEDYIGWLANNFDPSISWKDLEWIREFWDGPMVIKGILDPGRCPRRGAVLAPNGIVVSNQWGPPSLDGGXLLRPAPLRAIADAGERGILGTWAE

SEQ ID NO: 9947 - protein, 717 aa, Enterobacter cloacae
LPNFARDHSSLRVLLAESRRGGVFPLSRMAHWSKMPRQENGMKRTALAVLMLPAFAHADWSSPGFNAFSAEGTGVFTSQATLAKGTRPLTLSLDNACWQPTGAIKLNEMLSLKPCEGTPPQWRLFRDGVYQMRIDTRSGTPTLMLTVQSAAPQPVANVTRQCPKWDGKPLTIDVVNTFPEGTVVRDFYSKQTATVQNGKVTLQPAANSNGLLLLERAETDKPAPFSWQNATVYFVLTDRFVNGDPTNDNSYGRHKDGMQEIGTFHGGDLKGLTSKLDYLQQLGVNALWISSPLEQIHGWVGGGTKGDFPHYAYHGYYTQDWTKLDANMGNEDDLRQLVDDAHRRGIRVLFDIVMNHAGYATLADMQEYQFGALYLQGDELKKTLGERWTDWKPGAGQSWHSFNDYINFSDKAAWEKWWGKKWIRTDIGDYDNPGFDDLTMSLAFLPDLKTESKIPSGLPNFYQHKPDTNAKVMTNFTPRDYLTHWLSQWVRDYGIDGFRVDTAKHVEPEAWLQLKNQASQALAAWKAANPDKKLDDAPFWMTGESWGHGVMQSDYYRHGFDAMINFDYQEQAAKAVDCLADMDLTWQQMAEKLQSFNVLSYLSSHDTRLFREGGQRAAELLLLAPGSVQIYYGDESERPFGPTGSDPLQGTRSDMNWQDVTGKQALTVAHWQLLGQFRARHPAVGEGKQTTLSMKEGYGFVREHKGDKVMVVWAGNQ

SEQ ID NO: 9948 - protein, 104 aa, Enterobacter cloacae
AGGVYAAQRVGGTGFDAGGTALAMRAQITFQRLNAIFHDPNLHCPERARHHTAFAADTARLLNEPGSRSAVNGPRRADIRAGRIFTLVAAHCRGEGFPLNHADP

SEQ ID NO: 9949 - protein, 220 aa, Enterobacter cloacae
STVQPAMPNYSASWTSSPPQNALMKMSPSVCLDMNLLACWKKTAGTASPSTTACGRKSSLCKEWVMIFGHIAQPNPCRLPLAIEKALNFLRTTDFTTLAPGVIEIEGRNIFAQVLDLTTKEQHENRPEVHRRYLDIQFLAWGEEKIGIAIDTGNNKISESLLEQRDIIFYHDSEHESFIEMIPGSYAIFFPQDVHRPACIKNKGSAIRKIVVKVAISELD

SEQ ID NO: 9950 - protein, 221 aa, Enterobacter cloacae
GVRPMSRPLLQLALDHTSLQAAQRDVATLSDHVDIVEAGTILCLTEGLNAVRALRAQCPDKIIVADWKVADAGETLAEQAFGAGANWMTIICAAPLATVERGHEVALRGGGEIQMELFGNWTLDDARAWHRIGVKQAIYHRGRDAQASGQQWGEADLSKMKALSDIGLQLSITGGITPADLSLFKQINVKAFIAGRALAGADNPPQVAQAFHSQIRDIWGE

SEQ ID NO: 9951 - protein, 668 aa, Enterobacter cloacae
CRALPPICASVMYSPEENDMTIMEADLHQLKINDPFLGQYQRLVRDVVIPYQWDALNDRVAEAEPSHAIANFRIAAGLEQGEFYGMVFQDSDVAKWLEAVAWSLCQKPDAELEKTADEVIELVAAAQCEDGYLNTYFTVKAPAERWTNLAECHELYCAGHMIEAGVAYFQGTGKRRLLDVVCRLADHIDSVFGPGENQLHGYPGHPEIELALMRLYDVTQEPRYLNLVKYFIEERGAQPHFYDIEYEKHGRTSYWNTYGPAWMVKDKAYSQAHLPLAAQQTAIGHAVRFVYLMAGMAHLARLSNDEGKRQDCLRLWNNMAQRQLYITGGIGSQSSGEAFSSDYDLPNDTVYAESCASIGLMMFARRMLEMEADGHYADVMERALYNTVLGGMALDGKHFFYVNPLEVHPKTLSFNHIYDHVKPVRQRWFGCACCPPNIARVLTSLGHYIYTVRPDALLINLYVGNDVAIPVGDNILQLRISGNYPWHEQVKIEITSPVPVTHTLALRLPDWCAEPAVSLNGQAITGEVSRGYLYLNRSWQEGDTLTLTLPMPVRRVYGNPQVRQQAGKVALQRGPLIYCLEEADNGANLHNLSLRQDSAFRVFEGKGIFAHKMLIQAEGIGCQAKDTDALWQYDHSPVERQPRTLTFIPWFSWANRGEGEMRIWVDES

SEQ ID NO: 9952 - protein, 163 aa, Enterobacter cloacae
MDSCTSARLGQVQTSPWLNANSANPSSALSKKASSSSITSAKKMFGDLPPSSSVTGMMFWVAYCMICWPTSVEPVNATLAIRFEVARYSPISPPAPLTTLMTPGGNRSPITSISSSTESGVKRAGFSTTQLPAASAGAIFQLAISSGKFHGIICPTTPSGSWK

SEQ ID NO: 9953 - protein, 343 aa, Enterobacter cloacae
VYNKGSSGWWFSRQSVTGLRAVSRITVLYVSFLPPEPYLIAQGLMRNDAMQLFIGFDVGGTHIKHGVINENGEELTSDEYDTPDDESTFKQKWKAVVDKYRQEHEIVGIGVSFPGHINHHTGEAAKAGALDYLDGENLCELFAQLTDLPVTTENDANCAALGERWQGAGKDYEHFVCITIGTGIGGGIVMEGDLYRGSHYRAGEFGVLPVGNNGEPMHEVASASGLMKACRRALAVSEDEMPDGEELFRRMDSDVHLREAIEEWAHFLSRGIYSVISMFDPQAVLIGGGISEQEKIYLLLDKYLQRFEEWEALRVPILPCELGNQAGRLGAVWLAKQKQARSA

SEQ ID NO: 9954 - protein, 418 aa, Enterobacter cloacae
QITVLLPLPPGERARVRGKRSSPQPSRVKTLMKVNTMKALHFGAGNIGRGFIGKLLADAGITLTFADVNQVVLDALNARHSYQVHVVGENEQVETVSGVNAVSSIGDDVIDLIASVDLVTTAVGPVVLERIAPAVAKGLAKRKAQGVETPLNIIACENMVRGTTQLKGHVLTAVADEDKAWVEAHVGFVDSAVDRIVPPSASATNDPLEVTVETFSEWIVDKTQFKGALPTIPGMELTDNLMAFVERKLFTLNTGHAITAYLGKLAGHQTIRDAILDENIRAVVKGAMEESGAVLIKRYGFDADKHAAYIQKILGRFENPYLKDDVERVGRQPLRKLSAGDRLIKPLLGTLEYGLPHANLVKGIAAAMHYRSEQDPQAIELAQLIDDKGAQAALAQISGLDANSDVVAEAVSAYNATK

SEQ ID NO: 9955 - protein, 146 aa, Enterobacter cloacae
KKRFRSKPAHIGVSFPVNSPFSELFVMKEVEKNEIKRLSDRLDMIRHQMAGLSLVDSAEKYAELEKESVKLEAEIERLREVKGQKLSKEAQKLMNMPHRRAITKKEQADMGKLKKSVRGLVVVHPMTELGREMGLKEMTGFCKTAF

SEQ ID NO: 9956 - protein, 282 aa, Enterobacter cloacae
TQPDIYLHGGRDHHIAGLCLNLDDSMIVMPRRLSEEIATRVRALIEEQQLEAGMRLPAERQLAAQLGVSRNSLREALATLVSEGVLLSRRGGGTFVRWQHDDWSEQNIVQPLKTLMENDPDYSFDILEARHAIETSTAWHAAMRATDADKEKLKACFEATQSSDPDIASQADVRFHLAIAEASHNVVLLQTMRGFFDLLQSSVKQSRQRMYLVPPVFAQLTEQHEAVLNAILAGDAEAARKAMMAHLGFVHTTIKRFDEDQARQARITRLPGESDISRENKA

SEQ ID NO: 9957 - protein, 274 aa, Enterobacter cloacae
ISMLELSIALPIRVQNGGLFISRGVGRHPARKLSSWEIIFVEKGTLTIQEENTLFEVNAGESLLLWPKRRHVGVEDFPGDLKFYWLHFEVDERLPVLPGATPLSIEQHCSVRDPQYVIALFRQFLSEQEKLQRSQALEIILLLILQQISLSPGYEDKADDAGAAMAWKAKQLIRTHFHLPLSTSQLAKELHCNADYLGRVFRRTFHLTLTEAIHRQRVRAAEKLLLNDAASLTEVAARCGFNDVGYFRQIFSKHTGLTPAVWKRRYCKEHINSG

SEQ ID NO: 9958 - protein, 88 aa, Enterobacter cloacae
NGLITSFDRRSRSLRLIISHIIAGPMPPGERLIMPFMLVMAVMIFSLAMIMPQRLPGRPSLERLMQRMIFGFHSGRASLKMIPGNGTP

SEQ ID NO: 9959 - protein, 296 aa, Enterobacter cloacae
DSALKFLKKIRCWNVYIRPGDLMISTPIRRYGAAILMLLTMAFSGEVLAKTHTDTTSKKAHVIKTTSSKVSSKQEYSRNSAKSSSLPDLRKYPSGTPRKKAFLRTVMPYIKSQNAAITADRNWLISKQYDSRWSPSERTRLKDIAKRYKVKWSGNTRRVPWNSLLERVDIIPGSMVATMAAAESGWGTSKLARNNNNLFGMKCVKGRCTNAPGKVKGYSQFESVKDSVNAYVVNLNTHPAYSSFRKSRAQLRKADQEVTATAMIHKLKGYSTQGQRYNNYLFSMYQDNQRLIAAHM

SEQ ID NO: 9960 - protein, 214 aa, Enterobacter cloacae
EHDARFEAGLMESWLIPAEPVTFVEEIKKSRFITLLAHTDGVEAAKAFVESVRAQHPDARHHCVAWVAGPPDDSQQLGFSDDGEPAGTAGKPMLSQLMGSGVGEITAVVVRYYGGILLGTGGLVKAYGGGVQQALNLLITTRKTPLTEYTLLCDYAQLSGIEALLKQFNGVIAQSDYQAMVQLRVALPQAELAAFSAKLADFSRGSLQLLPIEE

SEQ ID NO: 9961 - protein, 221 aa, Enterobacter cloacae
SPICCLGVLRSLRCWCCLPQHSGVSKETLVKTLILFSTRDGQTREIASYLASELKELGIYSDVVNLNRTEQIAWQDYDRVVIGASIRYGHFHPALDRFVKKHTAELAQLPGAFYSVNLVARKAEKRTPQTNSYTRKFLLSSPWQPDICSVFAGALRYPRYRWYDRFMIRLIMKMTGGETDTRKEVVYTDWAQVASFAREIAHLTDDARVVFTRVPVPRYVK

SEQ ID NO: 9962 - protein, 201 aa, Enterobacter cloacae
FTEGKVFQMKIKNVALAIAAAGLLLSSQSVLASSDSGVNASLDTGAGSQSTGGVINFTGKITLISCDITPASKNKTVDLGAWAKSYFDDHNETTPREFKINVENCPETVESVAVLFDGTKDTVNDTLLQVTPCEGMATGVRVKLYNSDRSTAIKPGTVSETTAPDDEGNAELTFYAALDKDGTEIYAGDVNAVSNFLMVYN

SEQ ID NO: 9963 - protein, 234 aa, Enterobacter cloacae
FHCQPPPEIIMMKRLSYIMLTALMVSSASVSAGVVMGGTRIVYPQHSKEVAFSVSNMESAVPYLIQSWVEGDGQGKNNAAPFIVTPPLFRLDPEQTNTLRIQYTGAPLPTDRESVFWLDIKAIAPKPKESSNELQVNVKSKFKIFYRPDNLKGDAATAWQKITFSRTGKGLKAANPTPYYVSFYRLTVGGHKIEQPGMIGPGETREWPVSASGGVSWSAINDFGAITATHTQPL

SEQ ID NO: 9964 - protein, 203 aa, Enterobacter cloacae
AMKLIGSYTSPFVRKISILLLEKGIEFEFVNEQPYNAENGVAQYNPLGKVPALVTDEGDYWFDSPIIAEYIELLGVAPAMLPADPKAALAMKQIEALADGIMDAALTSVREQARPAAQQSENELLRQREKISRSLDMCEQLIRDGKIQSDSLNLATIAIACAIGYLNFRRVSPGWCVDRPLLVKLAETLFQRESFARTEPPKA

SEQ ID NO: 9965 - protein, 621 aa, Enterobacter cloacae
SAVSGDDVEMIIATAGHVDHGKTTLLQAITGVNADRLPEEKKRGMTIDLGYAYWPQPDGRVLGFIDVPGHEKFLSNMLAGVGGIDHALLVVACDDGVMAQTREHLAILQLTGNPQLTVALTKADRVDEARIDEVRQEVLAALSEYGFKDVALFVTVATEGRGIDALRNHLQQIPSREQASHHRFRLAIDRAFTVKGAGLVVTGTALSGEVNVGDTLWLTGVNKPMRVRGLHAQNQPVEQAHAGQRIALNVAGDAEKDQLNRGDWLLADAPPEPSERVIVSLQTHTPLTQWQPLHIHHAASHITGRVSLLENDLAELVFDSPLWLADNDRLVLRDISARETLAGARVVMLDPPRRGKRKPEYLQWLAALAQTRDDKSALDIHLERGAVDLAAFAWARQLSGEGLRLLTQEPGFIQAGNSLLNAPVAARWQRKVLSTLATYHEQHQDEPGPGRERLRRMALPMEDDALVLLLIENMRESGVIASHHGWLHLPEHKAGFTAEQDAVWQKVAALFGDEPWWVRDLARETNTDEQLMRQVLRHAAQQGMIVAIVKDRYYRNDRIVAFANLIRELDQARGSTCAADFRDRLNVGRKLAIQILEYFNRIGFTRRRGNDHVLRDAQLFP

SEQ ID NO: 9966 - protein, 292 aa, Enterobacter cloacae
DRELKHTLRYHQGAINRSYLMSIKESEMTQEKERPAGSQSLFRGLMLIEILSNYPNGCPLAHLSELAGLNKSTVHRLLQGLQSCGYVTPAPAAGSYRLTTKFIAVGQKALSSLNIIHVAAPHLEALNIATGETVNFSSREDDHAILIYKLEPTTGMLRTRAYIGQHMPLYCSAMGKIYMAFGHQDYVASYWESHQEQIQPLTRNTITELSAMYDELAEIRDHSMAMDKEENELGVSCIAVPVFDIHGRVPYAISISLSTSRMKQVGEKNLLKPLRDTAEAISKELGFNVREA

SEQ ID NO: 9967 - protein, 152 aa, Enterobacter cloacae
LMNQFILADPEKCIGCRTCEVACMMSHQSSATPVAFTSRIRVVKGETFTTAVGCHQCEDAPCANVCPTGAIHRAAGAWLVKQSRCIGCKSCMVACPFGAMQVRVVEDRVQALKCDLCAHREGGPACVEACPTHALRCIDPASLRAERLRNMA

SEQ ID NO: 9968 - protein, 505 aa, Enterobacter cloacae
ITAFMPGKRCATGHFCQRSHHMYIGIDLGTSGVKAILLSEQGDVLATQTEKLQVSRPHPLWSEQDPEQWWQATDRAMTALGEQHSLRDVKALGIAGQMHGATLLDSQHRVLRPAILWNDGRCAEECAILEERVPASREITGNLMMPGFTAPKLLWVQRHEPDIFRQVAKVLLPKDYLRFRMTGDFASDMSDAAGTMWLDVAKRDWSEAMLDACQLTRDHMPALFEGSEITGALQPSVAERWNMPAVPVIAGGGDNAAGAVGVGMVEAGQAMLSLGTSGVYFAVSDGYRSNPGSAVHSFCHALPGKWHLMSVMLSAASCLDWAAKLTGMADVPALIAAAQQADDNAGAVWFLPYLSGERTPHNNPEAKGVFFGLTHQHGPAELARAVLEGVGYALADGMDVVHDCGLTPSSITLIGGGARSSYWRQMLSDISGLQLDYRTGGDVGPALGAARLAQIALNPDKPLHQLLPQLSLEQQHRPDAKNHARYAERRDVFRKIYRQLLPLMS

SEQ ID NO: 9969 - protein, 312 aa, Enterobacter cloacae
NHTYPARNTMQKFDTKTFQGLILTLQDYWASQGCTIVQPLDMEVGAGTSHPMTSLRALGPEPMATAYVQPSRRPTDGRYGENPNRLQHYYQFQVVIKPSPDNIQELYLGSLKELGMDPTIHDIRFVEDNWENPTLGAWGLGWEVWLNGMEVTQFTYFQQVGGLECKPITGEITYGLERLAMYIQGVDSVYDLVWSDGPLGKTTYGDVFHQNEVEQSTYNFEYADVDFLFTCFEQYEKEAQQLLALETPLPLPAYERILKAAHSFNLLDARKAISVTERQRYILRIRTLTKAVAEAYYASREALGFPMCNRNK

SEQ ID NO: 9970 - protein, 692 aa, Enterobacter cloacae
EAAMSEKTFLVEIGTEELPPKALRSLAESFAANVTAELDNAGLAHGKIEWFAAPRRLALKVANLAASQPDREVEKRGPAIAQAFDAEGKPSKAAEGWARGCGITVDQAERLTTDKGEWLLYRAHVKGESAEALLPDMIATSLAKLPIPKLMRWGASDVHFVRPVHTVTLLLGDTVIPATILGVASDRVIRGHRFMGEPEFTIDNADQYPQILLERGKVIADYEQRKAKIKADAEEAARKIGGNADLSDSLLEEVTSLVEWPVVLTAKFEEKFLAVPAEALVYTMKGDQKYFPVYANDGKLLPNFIFVANIESKDPSQIISGNEKVVRPRLADAEFFFNTDRKKRLEDNLPRLQTVLFQQQLGTLRDKTDRIAELSGWIAREIGADVNHATRAGLLSKCDLMTNMVFEFTDTQGVMGMHYARHDGEAEDVAVALNEQYQPRFAGDDLPSNPVACAVAIADKMDTLAGIFGIGQHPKGDKDPFALRRAALGVLRIIVEKNLNLDLQTLTEEAVRLYGDKLTNAKVVDDVIDFMLGRFRAWYQDEGYSVDTIQAVLARRPTRPADFDARMKAVSHFRTLEAASALAAANKRVSNILAKSDETLNDRVNAATLKEPEEISLAMQVVVLRDKLEPYFAEGRYQEALVELAELRDVIDAFFEKVMVNVEDKELRINRLSMLEKLRELFLRVADISLLQ

SEQ ID NO: 9971 - protein, 453 aa, Enterobacter cloacae
LEVKKTKGRMMDSLASLYKNHIVTLQERTRDVLARFKLDALLIHSGELMNTFLDDHAYPFKVNPQFKAWVPVTQVPNCWLLVDGVNKPKLWFYLPVDYWHNVEPLPTSFWTEEIDVIALPKADGIGSQLPAARGNIGYIGPVPERALGLDIPADKLNPKGVLDYLHYYRAYKTDYELYCMREAQKTAVNGHRAAHEAFQSGMSEFDINQAYLTATGHRDTDVPYSNIVALNEHASVLHYTKLDHQVPAEMRSFLLDAGAEYNGYAADLTRTWAANADTDFAQLIKDVNDEQLALIGTMKAGTSYVDYHIQFHQRIAKLLRKHQIIKDMSEEAMVENDLTGPFMPHGIGHPLGLQVHDVAGFMQDDTGTHLAAPSKYPYLRCTRVLAPRMVLTIEPGIYFIESLLAPWREGQFSKHFNWEKIEALKPYGGIRIEDNVVIHENSIENMTRDLKLA

SEQ ID NO: 9972 - protein, 847 aa, Enterobacter cloacae
AGRLLMILVPSPPPTPSLFKIMPFRLFRYAPLSVLLLSFSRAGMAEDYFDPAALELSSTEQKTADLHYFSEKGGQMPGTWLVTLEINGREERHQEITFVNEKGSLQPVFSVSLLEALSVNVGAIPAFSRLQEGETFTHLEDFIPAARTSYDFNQQRLFLNLPQAAMKHRSRGYVPQSQWDDGIPAAFTDYSLSGGQARHQSGVTTSSYLSLRNGINLGAWRLRNTSAWSHSDAGGNHFQSQSSWLSRDIRRLNSQLRIGDAWTAGDVFDSVAFRGVQLSSSESMLPDSQRGFAPTIRGVAHSFAKVSVSQNGYVIYETWVAAGPFIINDLFPGAQSGDLQVTVTESDGSTRVFTQPYSAVPFMRRQGSLKYSLNAGRFHSGSGDARSPEFVEGAFFYGLLSRMTVYGGFRTASNYQAGAIGIGRGFGAFGSLGIDDTLAKSHLPDGKNAIGQAWRIQYQKDFSATGTAFNLASYRYASRNYYEFSELNQSDSQQLQLNNRRSRSQVTFSQTLGQFGSLSVSAWMQDYWHTSGQDKTIHIGWYTSWRGISWGAGYDYTDSAREQHPDRTVSFNVNVPLGHWLPDSSVSYFINHNNRGMTTQQMSLNGSALANRNLNYSVQQSKASEGQADSTSLALQYNGGYGNVSLGYDHSRSGSNASLGLAGGVIATQYGVTLSEPLGDTVALLRVPGAANVEPEGYNGIHTDSRGYAVMPTLSAYRKNTVSLDTATLGENVDVEQSGLTLIPTSGAVVLANYKTHIGYRVLFSLRYHGEPLPFGAQAEVVEQNRHSANRSMVADGGQAYLSGVPERGTLRVTWYENGEQQQCQTPFRLGKAHMAPGIATLSLECH

SEQ ID NO: 9973 - protein, 367 aa, Enterobacter cloacae
RNIMRRFIHWFFYLSLLSLFGMLSFHAHAQTSTCRTTRDQWVVQVPYAIGYAPGTSDWTPISAPIQSTGADFYSCDGGNDPWRSIGFVELDNPVGTVVGEDGASRHVYKTQIDGIGYALGFREQQYCGADAVRYIDGTSPVDGNESRRICDASQNPAFASAPTYKLQFWVVFYKIPTTSPMPDDNANSQEQNVGSLILQAGENQASATNVATPVQIHLASFTVRRTSCSVGSRSILVPMGSVSQREFHGIGFRAGGGRFSIPVTCENNTAVKMGFFGDTTPGNDRALALTKQEDSASGVGIELLYGDNTGSVQGQVVPWNTPQVSALGQVGDNQTQTFWFDAHYIQTEANVTAGKADAMATFNLIYN

SEQ ID NO: 9974 - protein, 547 aa, Enterobacter cloacae
IWRRSPSPAPSATSISAASRRAGAWIVRCWSNWRRRSSSAKVSPGLNHQRLDAGYNTSWREAVQSPHMLTPSPVGRGEDIYSPGAFMTTHHSLYSQIPATDRLLRDPRITAVLEQFGHTATVDMLRQLQDDARRHIQAENALPGWCEAWAQEVERRLSKHAQSALRPVINLTGTVLHTNLGRAQQAEEAIDAVTRAMRSPVTLEYDLDGAGRGHRDRALADLLCQITGAEDACIVNNNAAAVLLMLAATASGKEVVVSRGELVEIGGAFRIPDVMRQAGCTLHEVGTTNRTHAKDYRAAVNENTALLMKVHTSNYHIEGFTKTVEEAELAAIGRELNVPVIADLGSGSLVDMRQYGLPKEPMVQEMVAAGVSLVSFSGDKLLGGPQAGIIVGRRELIAQLQQHPLKRALRADKMTLAALEATLRLYLHPEKLADRLPTLRLLSRDAASVRAQAEALLPQVAPHYPEFEVRIEPCLSQIGSGSLPVDRLPSEALTFTPRDGRGSQLEALSARWRALPTPVIGRIGDGRMWLDLRCLEDEVRFLEMMLK

SEQ ID NO: 9975 - protein, 546 aa, Enterobacter cloacae
STVIRDTARKPVTDWRENHQPELPLLYTYCKETVMTNNPPSSRIQPGEYGFPLKLKPRYDNFIGGDWVAPVDGEYYSNLTPVTGQPLCEIASSGKRDIDLALDAAHKAKDKWGQTSVQDRAAILFKIADRIEQNLELLATAETWDNGKPIRETMAADVPLAIDHFRYFASCIRAQEGGISEVDKDTVAYHFHEPLGVVGQIIPWNFPLLMASWKMAPALAAGNCVVLKPARLTPLSVLLLMEVIGDLLPPGVINVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDNVTQMGAQVSHGQLETILNYIDIGKKEGADVLTGGRRKVLGGDLQEGYYLEPTILFGKNNMRVFQEEIFGPVLAVTTFKTMDEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 9976 - protein, 88 aa, Enterobacter cloacae
VAAKDGYSFLNALRVKRLNHLIRQAQQVVTPDHLAHHRRADAARRKADNAVHVGNGGDDFLVSNDNAATAARQAQLGEAHAEDDIRVP

SEQ ID NO: 9977 - protein, 122 aa, Enterobacter cloacae
RTRFAEDDPRERYAIGVIDHQRDAVLIRQRIQLHQLVVGDHVPRRVGGTRYADHARLFTDMQMFKIDVIFELALWQQLDIRTCGNKQVFFEAGIGIANILRCQREQHFFRGAVGAASGEQIE

SEQ ID NO: 9978 - protein, 469 aa, Enterobacter cloacae
NNVIEQPPMSIHYYSRSKTTPHTLIMELNMQAYFDQLDRVRFEGTKTTNPLAFRHYNPDELVLGKRMEDHLRFAACYWHTFCWNGADMFGVGSFDRPWQQPGEAIELAKRKADVAFEFFHKLNVPYYCFHDVDVSPEGASLKEYLNNFAQMVDVLAEKQQQSGVKLLWGTANCFTNPRYGAGAATNPDPEVFSWAATQVVTAMNATHQLGGENYVLWGGREGYETLLNTDLRQEREQIGRFMQMVVDHKHKIGFRGTLLIEPKPQEPTKHQYDYDVATVYGFLKQFGLEKEIKVNIEANHATLAGHSFHHEIASAIALGIFGSVDANRGDPQLGWDTDQFPNSVEENALVMYEIIKAGGFTTGGLNFDAKVRRQSTDKYDLFYGHIGAMDTMALALKVAARMIEDGELDKRVAKRYSGWNSELGQQILKGQLSLAEIAKYAEQHQLAPQHQSGHQELLENLVNHYLFDK

SEQ ID NO: 9979 - protein, 490 aa, Enterobacter cloacae
IPKEAAEMHFRAITRIVGLLVILFSGTMIIPGLVALIYRDGAGRAFTQTFFVALTIGSLLWWPNRREKGELKSREGFLIVVLFWTVLGSVGALPFIFSEQPNLTVTDAFFESFSGLTTTGATTLVGLDSLPHAILFYRQMLQWFGGMGIIVLAVAILPILGVGGMQLYRAEMPGPLKDNKMRPRIAETAKTLWLIYVLLTVACALALWFAGMPAFDAIGHSFATIAIGGFSTHDASVGYFDSPTINTIIAIFLLISGCNYGLHFSLLSGRSLKVYWRDPEFRMFIGVQLTLVIICTLVLWFHDVYNSAVTTLNQAFFQVVSMATTAGFTTDSIARWPLFLPVLLLCSAFIGGCAGSTGGGLKVIRILLLFKQGNRELKRLVHPNAVYSIKLGNRALPERILEAVWGFFSAYALVFIVSMLAIIATGVDDFSAFASVVATLNNLGPGLGVVADNFASMNPVAKWILIANMLFGRLEVFTLLVLFTPTFWRE

SEQ ID NO: 9980 - protein, 98 aa, Enterobacter cloacae
GGEMGELLNSGLLSIASLVMSLVVLVVGLVLWFFVNRASSRTNEQIELLEALLDQQKRQNALLRRLCEANEPEEKAVPKDAVAQQQDEEDFIRLVAER

SEQ ID NO: 9981 - protein, 171 aa, Enterobacter cloacae
THSQQQSVKPMKYDTSELCDIYQEDVNVVEPLFSNFGGRSSFGGQIITVKCFEDNGLLYDLLEENGRGRVLLVDGGGSVRRALIDADLARLAVQNEWEGIVVYGSVRQVDDLEDLDIGIQAIAAIPVGAAGEGIGESDVRVNFGGVTFFSGDHLYADNTGIILSEDALDIE

SEQ ID NO: 9982 - protein, 233 aa, Enterobacter cloacae
TMNKILLVDDDRELTSLLKELLDMEGFNVLVAHDGEQALSLLDDSIDLLLLDVMMPKKNGIDTLKELRQTHQTPVIMLTARGSELDRVLGLELGADDYLPKPFNDRELVARIRAILRRSHWSEQQQNTDNSSPTLEVDSLSLNPGRQEASFDGETLELTGTEFTLLYLLAQHLGQVVSREHLSQEVLGKRLTPFDRAIDMHISNLRRKLPERKDGHPWFKTLRGRGYLMVSAS

SEQ ID NO: 9983 - protein, 339 aa, Enterobacter cloacae
EIFAKRGGDEEVSLFRKFGFPVLIVLARIVAQRAIGPAVDFLFSLLVTRKPEIGQRQLTVDLHFGDGTRAAAFVLPYLACKHIHRVMHLHSFRYKKSESSDSLLTGVNATLFFSGETRCCFVPVHHVPEGFDVVRATVLELQVVSVFPHVQTQNWEAGCARDSFTHKRGILVSGRNDRQFVTFQNQPRPARAETGCSGFFEFRFEVVNGTEVTLDSRFQVALKGGAGFQAFPEQAVVSVTARVVAQHGFLVCWQLVQFGDQLFNRQISELWQAFQRSIRVVHVGLVVFSVMDFHRLLVEMRFQCVVGIRQGWQCITHNPLHYCRAAQLLMPRKQLVHYS

SEQ ID NO: 9984 - protein, 382 aa, Enterobacter cloacae
LPFKTKVRQPSEGSQTASFLHSSSRREASGYKNDEDVKMNHAITMGIFWHLIGAASAACFYAPFKKVKGWSWETMWSVGGTVSWLILPWTISAMLLPDFWGYFSSFNASTLLPVFLFGAMWGIGNINYGLTMRYLGMSMGIGIAIGITLIVGTLMTPILNGNFDVLINTQGGRMTLLGVLVAVIGVGIVTRAGQLKERKMGIKAEEFNLKKGLLLAVMCGIFSAGMSFAMNAAKPMHDAAAALGVDPLYVALPSYVVIMGGGALVNLGFCFIRLAKVNNLSVKADFSLAKPLIVTNVLLSALGGLMWYLQFFFYAWGHASIPAQYDYMSWMLHMSFYVLCGGLVGLVLKEWNNAGRRPVGVLSLGCVVIIIAANIVGLGMAN

SEQ ID NO: 9985 - protein, 196 aa, Enterobacter cloacae
PMQVSRRQFFKICAGGMAGTTAAALGFAPGVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANFIAKNAEGTTVNRWLSTGMLCASASSNETGYLTQKFTRALGMLAVDNQARV

SEQ ID NO: 9986 - protein, 820 aa, Enterobacter cloacae
HGPTVASLAPTFGRGAMTNHWVDIKNANLIVVMGGNAAEAHPVGFRWAMEAKIHNGAKLIVIDPRFTRTASVADFYTPIRSGTDITFLSGVLLYLMTNEKYNREYTEAYTNASLIVREDYHFEDGLFSGYDAEKRKYDKTSWNYELDENGFAKRDTTLQHPRCVWNLLKEHVSRYTPEVVENICGTPKADFLKVCELIAETSAKDKTASFLYALGWTQHSIGAQNIRTMAMVQLLLGNMGMAGGGVNALRGHSNIQGLTDLGLLSQSLTGYMNLPSEKQTDLQTYLTASTPKPLLEGQVNYWGNYPKFFVSLMKAFYGDKATAENSWGFDWLPKWDKGYDVLQYFEMMHQGQVNGYICQGFNPVASFPNKNKVVESLSKLKFLVTIDPLNTETSTFWQNHGESNDVDPSKIQTEVFRLPSTCFAEENGSIVNSGRWLQWHWKGADAPGIALNDGEILAGIFLRLRKMYASEGGATPEPVLNMTWNYSTPENPAPEEVAMESNGKALADVIDPATGAVLAKKGDQLSTFAHLRDDGTTSSGCWIFAGSWTPKGNQMANRDNADPSGLGNTLGWAWAWPLNRRILYNRASADPQGNPWDPKRQLLKWDGAKWGGVDIPDYSTAAPGSDVGPFIMQPEGMGRLFAIDKMAEGPFPEHYEPFETPLGTNPLHPNVVSNPAARIFKGDFEALGKKDKFPYVGTTYRLTEHFHYWTKHALLNAIAQPEQFVEIGEKLANKLGIAHGDTVKVSSNRGYIKAKAVVTKRIRTLNVHGQQVDTIGIPIHWGYEGVAKKGFIANTLTPFVGDANTQTPEFKAFLVNVEKV

SEQ ID NO: 9987 - protein, 304 aa, Enterobacter cloacae
RRRLMAYQSQDIIRRSATNGFTPAPQARDHQQEVAKLIDVTTCIGCKACQVACSEWNDIRDEVGHNVGVYDNPADLTAKSWTVMRFSEVEQNDKLEWLIRKDGCMHCADPGCLKACPSEGAIIQYANGIVDFQSEQCIGCGYCIAGCPFDVPRMNPEDNRVYKCTLCVDRVNVGQEPACVKTCPTGAIHFGSKEDMKTLAAERVGELKTRGYDNAGLYDPAGVGGTHVMYVLHHADKPNLYHGLPENPEISATVKFWKGIWKPLAAVGFAATFAASIFHYVGVGPNRAEEEDDNLHEEKDEVRK

SEQ ID NO: 9988 - protein, 292 aa, Enterobacter cloacae
GMTMYTLKDITRPSGGFAMLAVDQREAMRLMFAAAGAPVPVTDQHLTDFKVNAAKILSPYASAILVDQQFCYRQIVGQQAVAKSCAMIVAADEFIPGNGIPVDSVAIDKNVDAQAVKRDGGKALKLLVLWRSDEDPQQRLEMVKAFNTLCHDNGLLSIIEPVVRPPRRGAAFNREQAIIDAAKELGDSGADLYKVEMPLFGKGTQQELLAASQKLNENIAMPWVILSSGVDDKLFPRAVSVAMQAGASGFLAGRAVWSSVIGLPDTELMLRDISVPKLQRLGEIVDEMMARR

SEQ ID NO: 9989 - protein, 678 aa, Enterobacter cloacae
DGVFMRTLHNIDLKNNESGFTLRWQDRLILSHTADAPCLWIGAGEADIEMFRGNFSIKDKLNEKIALTNATVTQQSAGWAIRFTRGDAVSATLLVGVDAEGRLELKLKNDAPGHNRIWLRLAAQPEDHIYGCGEQFSYFDLRGKPFPLWTSEQGVGRNKQTYVTWQADCKENAGGDYYWTFFPQPTFVSTQKYYCHVDNSCYMNFDFSAPDFHELAFWEDNATLRFECAETYVDLLEKLTGLLGRQPELPDWVYDGVTLGIQGGTEVCQQKLDTMRNGGVKVNGIWAQDWSGIRMTSFGKRVMWNWKWNSALYPQLDTRIAQWKEEGVQFLSYINPYVASDKDLCEEAAKRGYLTKNADGKDYHVEFGEFYAGVIDLTNPAAYDWYKEVIKKNLIELGCGGWMADFGEYLPTDTFLHNGVSAEIMHNAWPALWAKCNYEALEETGKLGEILFFMRAGYTGSQKHSVMMWAGDQNVDWSLDDGLASVVPAALSLAMTGHGLHHSDIGGYTTLFEMKRSKELLLRWCDFSAFTPMMRTHEGNRPGDNWQFDGDAETIAHFARMTTVFTTLKPYTKAAVAQNAKSGLPVMRPLFLHYEDDARAYTLKYQYLFGRDLLVAPVHEKGRRDWSLYLPQDTWVNAWTGETCQGGDITVDAPLGKPPVFYRQQSEWADLFSTLRHI

SEQ ID NO: 9990 - protein, 474 aa, Enterobacter cloacae
GSPAGKPAGRRRTIMSQHTSDPATLRLPFKEKLAYGMGDLGSNILLDIGTLYLLKFYTDVLGLPGTYGGIIFLIAKFFTAFTDMGTGIMLDSRRKIGPKGKFRPFVLYAAFPVTLLAIANFVGTPFEITGKTVMATVLFMLYGLFFSMMNCSYGAMVPAITKNPDERASLAAWRQGGATLGLLLCTVGFVPVMNLIEGNDQLGYIFAATLFSLFGLFFMWWCYKGVTERYVETQPANPAQKPGLLQSFRAIAGNRPLFILCIANLCTLGAFNVKLAIQVYYTQYVLNDPILLSYMGFFSMGCIFIGVFMMPGAVRRFGKKKVYISGLMIWVAGDLLNYFFGGGSVSFVAFSCLAFFGSAFVNSLNWALVSDTVEYGEWRTGVRSEGTVYTGFTFFRKVSQALAGFFPGIMLTQIGYVPNVVQSAGTVEGLRQLIFIYPSLLAVITIVAMGCFYNLNEKMYVRIVEEIELRKRTA

SEQ ID NO: 9991 - protein, 260 aa, Enterobacter cloacae
SVSSHFITINPATMSFLFIRREAFLYLIHGQIMKRIITVLIVSSVSCPVFAGAYVETREAYNTASELHEVILRAGYNFDMGAGLMFTNAYNVGKWDELKHSYNEIEGWYPLFKPTDKLTFQPGGLINDSSAGSGGAVYLDTNYKFTDWFNLTFRYRYNHNNYDTPDYNGQMDKNDTHEFANYWNFKVTDAFFYTFEPHFFQRVNDYHSKNGKDHHWEITNKFSYKIDRNWLPYLELQWLDRWNDYNREQYRIRLGLRYSF

SEQ ID NO: 9992 - protein, 484 aa, Enterobacter cloacae
RPRYHDDNDQSGELSMSAEHVLTMLNEHEVKFVDLRFTDTKGKEQHVTIPAHQVNAEFFEEGKMFDGSSIGGWKGINESDMVLMPDATTALIDPFYEEPTLIIRCDILEPGTLQGYDRDPRSIAKRAEEYLRSTGIADTVLFGPEPEFFLFDDIRFGASISGSHVAIDDIEGAWNSSTKYEGGNKGHRPGVKGGYFPVPPVDSSQDIRSTMCLIMEEMGLVVEAHHHEVATAGQNEIATRFNTMTKKADEIQIYKYVVHNVAHRFGKTATFMPKPMFGDNGSGMHCHMSLSKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPEEAKEIPQVAGSLEEALQALDADREFLTAGGVFTDEAIDAYIALRTEENDRVRMTPHPVEFELYYSV

SEQ ID NO: 9993 - protein, 308 aa, Enterobacter cloacae
ITMTDISRTQAWLESLRPKTLPLAFAAIIVGTTLAWWQGHFDPLVAGLALVTAGLLQILSNLANDYGDAVKGSDKPDRIGPLRGMQKGVITQAQMKRALIITVVLICLSGLALVTVASKTTSDFIGFLVLGLLAIIAAITYTVGTRPYGYIGLGDISVLVFFGWLSVMGSWYLQAHTVIPALFLPATACGLLATAVLNINNLRDIDSDRENGKNTLAVRLGPVNARRYHAFLLIGALVCLALFNLISLHGLWGWLFVLAAPLLIKQARYVMRELSPAAMPPMLERTVKGALLTNLLFVIGIVLSQTLS

SEQ ID NO: 9994 - protein, 290 aa, Enterobacter cloacae
TLLFCRIPIMSQTSTLKGQCIAEFLGTGLLIFFGVGCVAALKVAGASFGQWEISIIWGLGVAMAIYLTAGVSGAHLNPAVTIALWLFACFDGRKVVPFIISQFAGAFCAAALVYGLYYNLFIDFEQTHHMVRGSVESLDLAGIFSTYPNPHINFVQAFAVEMVITAILMGVIMALGDDGNGIPRGPLAPLLIGLLIAVIGASMGPLTGFAMNPARDLGPKTFAFFAGWGDVAFTGGKDIPYFLVPLFGPIVGAALGAFGYRKLIGRHLPCDTCVEEEKETTSTTQQKASL

SEQ ID NO: 9995 - protein, 509 aa, Enterobacter cloacae
SDYGTHTMTEKKYIVALDQGTTSSRAVVMDHDANIVSVSQREFEQIYPRPGWVEHDPMEIWASQSSTLVEVLAKADISSDQIAAIGITNQRETTVVWERETGKPIYNAIVWQCRRTSEICEQLKRDGMEEYVRSATGLVVDPYFSGTKVKWILDHVEGSRERARRGELLFGTVDTWLIWKMTQGRVHVTDYTNASRTMLFNINTLEWDDKMLDALDIPRAMLPDVRKSSEVYGQTNIGGKGGTRIPIAGIAGDQQAALFGQLCVKEGMAKNTYGTGCFMLMNTGEKAVKSENGLLTTIACGPRGEVNYALEGAVFMAGASIQWLRDEMKLISDAFDSEYFATKVKDTNGVYVVPAFTGLGAPYWDPYARGAIFGLTRGVNSNHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNYRYSGWKKAVKRALAWEEHDE

SEQ ID NO: 9996 - protein, 341 aa, Enterobacter cloacae
LYEYLMKRELAIEFSRVTEAAALAGYKWLGRGDKNTADGAAVHAMRIVLNQVNIDGTIVIGEGEIDEAPMLYIGEKVGTGKGDAVDIAVDPIEGTRMTAMGQANALAVLAVGDKGCFLNAPDMYMEKLIVGPGAKGAIDLSLPLDANLRNIAAALGKALSELTVTILAKPRHDATIAYLQTLGVRVFAIPDGDVAASILTCMPDSEVDVLYGIGGAPEGVVSAAVIRALDGDMQARLLPRHEVKGDSDENLRIGADELARCAAMGIEANKVLALNEMARSDNVVFSATGITKGDLLDGITRKGNMATTETLLIRGKSRTIRRIKSIHYLDRKDPDVQTHIL

SEQ ID NO: 9997 - protein, 257 aa, Enterobacter cloacae
KRETAQEKIMADWVTGKVTKVQFWTDALFSLTLHAPVHPFTAGQFAKLGLDIDGERVQRAYSYVNAPDNPDLEFYLVTVPDGKLSPRLAALKPGDEVQIVSDAAGFFVLDEIPDCDTLWMLATGTAIGPYLSILQYGKDLERFKNIVLVHAARYAADLSYLPQMQALEQRYGGKLKIQTVVSRETAAGSLTGRVPALIESGALEEAVGLPMNTETSHVMLCGNPQMVRDTQQLLKDTRQMTKHLRRRPGHMTAEHYW

SEQ ID NO: 9998 - protein, 423 aa, Enterobacter cloacae
GALRMTTQLEQAWDLAKQRFAAVGVDVEEALRQLDRLPVSMHCWQGDDVAGFENPGGSLTGGIQATGNYPGKARNATELRADLELALSLIPGPKRLNLHAIYLESDEPVARNEIKPEHFTNWVAWAKANRLGLDFNPSCFSHPLSADGFTLAHANDEIRQFWIDHVKASRRVSAYFGEQLGTPSVMNIWIPDGMKDITVDRLAPRQRLLAALDEAISEKLDPAHHIDAVESKLFGIGAESYTVGSNEFYMGYATSRQTALCLDAGHFHPTEVISDKISAAMLYVPRLLLHVSRPVRWDSDHVVLLDDETQAIASEIIRHNLFDRVHIGLDFFDASINRIAAWVIGTRNMKKALLRALLEPVAALKQLEENGDYTARLALLEEQKSLPWQAVWEMYCQRHDAPAGSQWLDNVRAYEKEVLAARQ

SEQ ID NO: 9999 - protein, 308 aa, Enterobacter cloacae
KTSPGGALLAGPTDKTRPGKRNATRHFQRNYSMQTITTSWFVQGMIKATSDAWLKGWDERNGGNLTLRLDDADIEPFASDFHQKPRYIALSQPMPLLANTPFIVTGSGKFFRNVQLDPEANLGVVKVDSDGAGYHILWGLTDDAVPTSELPAHFLSHCERIKATNGKDRVIMHCHATNLIALTYVLENNSDFFTRKLWEGSTECLVVFPDGVGILPWMVPGTDEIGQATATDMQKHSLVLWPFHGVFGSGPTLDETFGLIDTAEKSAEVLVKVYSMGGMKQTITREELIALGKRFGVTPMQSALDLYQ

SEQ ID NO: 10000 - protein, 423 aa, Enterobacter cloacae
IAGGGSLRDWRDQHHGRHRPRARLSVRGAVPWRHQQRPAGDRRLPVLADGDFRLGHCHRCAAERARQQAQRQADPARRGAGTSETGGETMSKMMTSEEFKPTSAPGIFQRLLCWEGFLLAVTLAVFVVNALASPYFLNIWNLSDATFNFTEKAIIVLPMAMLIIAREIDLSVASTIALSSTVMGFCAAAGVDTPLLVCVGLGVGLLCGLFNGILVTRFNLSSIVITIGTMSLYRGITYILLGDQALNSYPESFAWFGQGYVWGALSFEFALFIVLAALFAFVLHRTNFGRRTYAIGNNPTGAWYSGINVKRHNLILFALVGLMSGLASVLLTSRLGSTRPTIAMGWELAVVTMAVLGGVNILGGSGSMVGVIIAAFLMGLVTFGLSLLNVPGIVMSVIIGAMLIVVISLPIITRRIMQRRRIS

SEQ ID NO: 10001 - protein, 113 aa, Enterobacter cloacae
GPRAVPGGFMIRKAFVMQVNPDAHEEYARRHNPIWPELEAVLKAHGAHHYAIYLDKARNLLFATVEIESEERWNAVANTDVCQRWWKHMADVMPSNPDNSPVSAALNEVFYLD

SEQ ID NO: 10002 - protein, 309 aa, Enterobacter cloacae
MSIRIIPQDELGSSEKRTAEYIPPLLFPRLKNLYNRRAERLRELAENNPLGDFLRFAALVAHAQEVVLYDHPLQMDLTARIKEANEQGKPPLDIHVLPRDKHWHKLLHSLIAELKPEMSGTALAVIENLEKASEQELEEMASALFASDFSLVSSDKAPFIWAALSLYWAQMASLIPGKARAEYGEARQFCPVCGSMPVSSMVQIGTTQGLRYLHCNLCETEWHVVRVKCSNCEQTRDLNYWSLENEDAAVKAESCGDCGTYLKILYQEKDPKVEAVADDLASLILDAKMEQEGFARSSINPFLFPGEGE

SEQ ID NO: 10003 - protein, 317 aa, Enterobacter cloacae
SCTFIQLKGVFMALEKGIERLVQGFIAAGRPSSRRQTIEVRRAGYIASTELAGKTETRVQLETLVLEGLTIRVFSPLNAPEILPAAIYYHGGCFISGGFDTHDNQLRQLAYYGNCRVIAIQYRLAPEHTFPAAHDDAERGANLVWQYADELGVDKNRLTLCGDSAGGHLALVTSLRLKAKGLWDPAQLILIYPMLDATASLESYTLNGMDYVITRDTLLSGYEMYLAGADRQHPEVSPLWRNDFSGLPKVHIVTAEYDPLRDEGEALYQRLTAQGVKCTAQQWRGVIHGFFQLGGISQSARDIMRDIAWRINHAGRE

SEQ ID NO: 10004 - protein, 300 aa, Enterobacter cloacae
QERGMSAIAFIGLGQMGAPMAKNLLKQGHQLNVFDVNPQAIQALVESGARAAATPAQAATDAEFVITMLPNGDLVRSVLFGEHGVCEGLSRDALVIDMSTIHPLQTDALIRDMAEQGFSLMDVPVGRTSDHAIAGTLLLLAGGTAQQVERATPVLMAMGNELINAGGPGMGIRVKLINNYMSIALNALSAEAAVLCEALGLSFDVALKVMSGTPAGKGHFTTSWPNKVLKGDLSPAFMIDLAHKDLGIALDVANQLHVPMPLGAASREVYNQARAAGRGREDWTAILEQVRASAGLKKSH

SEQ ID NO: 10005 - protein, 477 aa, Enterobacter cloacae
GSTMTHNTDPLTLKLSLREKCAYGMGDFGSNLMLCIGTLYLLKFYTDELGMPAFYGGIIFLVAKFFTAFTDMLTGVLLDSRRNIGARGKFRPFILYASVPVALVATAQFMANDFSLTVKTALATVLFMMFGLCYSLMNCAYGAMVPAITKNPNERAQLAAWRQGGATVGLLLCTVGFMPIQALFVSQPSLGYLVAALVFVTGGLFCMWWCYSGVKERYVELTPDHHKPGILKSFCAIFRNPPLLVLCIANLCTLAAFNIKLAIQVYYTQYVLNDVHLLSWMGFFSMGCILIGVFLVPGAVKRFGKKPVYLGGLTLWAVGDVLNFVWGTSSLLFVLFSCMAFFGTAFVNSLNWALVPDTVDYGEWKTGIRAEGSVYTGYTFSRKISAALAGFLPGIMLTQIGYVPHAVQSAGTLLGLRQLIFLWPCGLAIVAAVTMGLFYKLNEARFAFIIEEIGKRKKQTANTPEITTNNKASAVTL

SEQ ID NO: 10006 - protein, 476 aa, Enterobacter cloacae
KIKVTFMQRGIVWVVDDDSSIRWVLERALTGAGLSCTTFESGSEVLDALTTKTPDVLLSDIRMPGMDGLALLKQIKQRHPMLPVIIMTAHSDLDAAVSAYQQGAFDYLPKPFDIDEAVALVERAISHYQEQQQPRHAPDFGPTTDIIGEAPAMQDVFRIIGRLSRSSISVLINGESGTGKELVAHALHRHSPRAKAPFIALNMAAIPKDLIESELFGHEKGAFTGANTIRQGRFEQADGGTLFLDEIGDMPLDVQTRLLRVLADGQFYRVGGYAPVKVDVRIIAATHQNLELRVQEGKFREDLFHRLNVIRVHLPPLRERREDIPRLARHFLQVAARELGVEAKQLHQETDAALTRLAWPGNVRQLENTCRWLTVMAAGQEVLIQDLPAELFEATVPESTAGHALPDSWATLLAQWADRALRSGHQNLLSEAQPEMERTLLTTALRHTQGHKQEAARLLGWGRNTLTRKLKELGME

SEQ ID NO: 10007 - protein, 100 aa, Enterobacter cloacae
CADLSSSRGGRHKALMATEGVNIEFTDDGIKRIAQAAWQVNETTENIGARRLHTVLERLMEDISYDASDLNGQSITIDADYVGKHLDALVADEDLSRFIL

SEQ ID NO: 10008 - protein, 204 aa, Enterobacter cloacae
RPGAMLMKSSAHSLYLCLAMLSASFSLYATETASPVTAPYLLAGAPSFDQSISQFREAFNKENPSLPLGEFRAIDSARDTPTLTRAASKINENLYASTALERGTLKIKSMQITWLPIQGPEQKAAKAKALEYMSAILRAFTPTFTKAQSQQKLQKLLTAGKNKRYYADTEGAVRYVVADNGEKGLTFAVEPIKLALSDALEGAN

SEQ ID NO: 10009 - protein, 260 aa, Enterobacter cloacae
AWRIEMRHPLVMGNWKLNGSRHMVNELVANLRKELAGVTGCAVAIAPPDMYLDLAKRAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 10010 - protein, 477 aa, Enterobacter cloacae
RRSSLVQNPAWSWLSDGFRFMIGSLTARIFAIFWLTLALVLMLVLMLPKLDSRQMTELLDSEQRQGVMIEQHVEAELANDPPNDLMWWRRLFRAIDKWAPPGQRLLLVTSEGRVIGADRNEMQIIRNFIGQADNADHPQKKKYGRVEMVGPFSVRDGEDNYQLYLIRPASSSQSDFINLLFDRPLLLLIVTMLVSSPLLLWLAWSLAKPARKLKNAADEVAQGNLRQHPELESGPQEFLAAGTSFNQMVSALDRMMTAQQRLLSDISHELRTPLTRLQLGTALLRRRSGESKELERIETEAHRLDSMINDLLVMSRNQQKNALVSETVKANHLWHEVLDNAAFEAEQMGKSFTVNFPPGPWPLYGNPNALESALENIVRNALRYSHTKIEVAFSVDKDGITVIVDDDGPGVSPEDREQIFRPFYRTDEARDRESGGTGLGLAIVETAMQQHRGWVKADDSPLGGLRLTLWLPLYKRS

SEQ ID NO: 10011 - protein, 568 aa, Enterobacter cloacae
IFDSKPRKSCRFFKKQAERSGNAVSVTLPANPAITGNCELPHVHLCFLASARFGLSVARRWLFLPFLTLLANDLRKDPTMTFRHCVAVDLGASSGRVMLATWDCDLHTLTLREMHRFANCLQKQDGFVTWDIDALEAEIRTGLHNVCEDGIRIDSIGIDTWGVDYVLLDRHGERVGLPVSYRDSRTDGLMAHAIAQLGKENIYGRSGIQFLPFNTLYQLRALVEQQPELVEKVAHALLIPDYLSYRLTGNMNWEYTNATTTQLVNINTDNWDEHLLAWTGASPSWFGAPTHPGNVIGHWLCPQGNKIPVVAVASHDTASAVIASPLAGKDAAYLSSGTWSLMGFESKTPYTSDAALAANITNEGGAEGRYRVLKNIMGLWLLQRVLKEQNITDLPELIAETETLKACTFLINPNDDRFINPAHMSAEIQAACFEAGQPVPSRPAELARCIFDSLALLYADILSELADLRGKPFTQLHIVGGGCQNQLLNQLCADACGITVVAGPIEASTLGNIGIQLMTLDELSNVDDFRSVVTANNSLTTFTPHPCHEIARYRAQFQQKRLTKELCA

SEQ ID NO: 10012 - protein, 360 aa, Enterobacter cloacae
ICTNNNIAPRSPRRGENHLQSLQLTQVSGVKAMKIKASLILTVAALALSGSALAEVKIALVAKSLGNGFFEAANVGAQEAAKELGDVKVIYTGPTTTTAEAQIEVLNGLIAQGVDAIAISANDPDAVVPVLKKAMQRGIKVVSWDSGVAKAGRQIHLNPSNNALIGETNVKLAADALKALNVEKGEVAVLSATPTSTNQNTWIAEMKKVLPKYPSVNLVTVAYGDDLSDKSYREAVGLLKTYPELKVIVSPSSVGIVAAAQAVKDQGKIGKVYVTGLGLPSEMAGAVKSGASKSFAIWNPIDLGYAATYLADDLVKGTATKGEASMGKLGKVKLDADGNGAMAEPFVYDASNIDKFSKIF

SEQ ID NO: 10013 - protein, 506 aa, Enterobacter cloacae
TKRRTIMTPLLQLSGITKVFPGVRALENVQLALWPGKVTALIGENGAGKSTLVKVMTGIYQPDEGEILYKAIPVHLPTPESAHKMGITAIHQETVLFDELSVTENIFVGQYLHKGFLKKLDWPEMHRRAQAILARLEVQIDPRATLKTLSIAQRHMVAIARALSFEAQVVILDEPTAALSQHEILEFYQIVERLKQEGKAILFISHKFDEIFELADHYTILRDGVFVGAGAINEITEERMVSMMVGRAITQTFPKIDCEKGETVLEVQNLCHPTEFAHISFSLRKGEILGFYGLVGAGRTELMQALSGVTRPSSGEIILNGQPRRFRQPADAIKAGIVCVPEERQKQGAIIALPIAQNISLPQLSTLNPNGVLHDDREWKLANEYAKRLQVKAFSWKQAVETLSGGNQQKVVIGKWLATHPDVIILDEPTKGIDIGSKAAVHQFMSELVSQGLAVIMVSSELPEVMGMADRIIVMHEGLMVAEYQAGDATAETIVSAASGAKQEAA

SEQ ID NO: 10014 - protein, 334 aa, Enterobacter cloacae
MLSSLLKHREALLGAVIILMIVAIGSRVPSFIAPGNLVEMFNDTAILIVLALGQMMVLLTKGIDLSMAANLALTGMIVALINFHYPDVPVWALLILASALGLLMGAINGLLVWKLGIPAIVVTLGTMSIYRGMIFLLSGGGWVNSNQMGADFLGLPRASVLGLPVLSWCAIAVLLLVGYFLRYSRTGRALYTAGGNATAAYYTGINAGKMQFISFCLSGLLAGFCGYLWISRFAVAYVDVANGFELQVVAACVIGGISTMGGTGRVLGCLFGALFLGVINNALPVIGVSPFWQMAISGSVIVIAVLLNERGNKRKGRLILRDAALARQKLAVKP

SEQ ID NO: 10015 - protein, 387 aa, Enterobacter cloacae
LRRIIMSFMLALPKISLHGAGAIGDMVNLVANKQWGKALIVTDGQLVKLGLLDSLFTALDAHQMSYHLFDEVFPNPTEALVQKGYAAYQDAECDYLIAFGGGSPIDTAKAIKILTANPGPSTDYSGVGKVKNAGVPLVAINTTAGTAAEMTSNAVIIDAARQVKEVIIDPNIIPDIAVDDASVMLDIPASVTAATGMDALTHAIEAYVSVGAHPLTDANALEAIRLINLWLPKAVDDGHNLEAREQMAFGQYLAGMAFNSAGLGLVHALAHQPGATHNLPHGVCNAILLPIIENFNRPNAVARFARVAQAMGVDTRGMSDEAASMSAIQAIRDLSARVGIPSGFSQLGVTKADIEGWLDKALADPCAPCNPRTASRDEVRELYLEAL

SEQ ID NO: 10016 - protein, 221 aa, Enterobacter cloacae
NGMKNHLSCLKGDTIKAIVLVCLAVGVVGMSYGSLAMAYGFPLWVPFVLSLTVLAGASEFMFIGIVASGGNPLAAAAAGLLVNARHVPFGVTVRDLVGKRGLSFLGCHIMNDESVVFGLSQKTAEQRKAAYWLCGLGVAIIWPLGAVLGAMVGKLLPDPETIGLDAVFPAILLALVVPAFKNRTTLIRACSGAVLSLAAVPFAPVGLPVLLSLLGLAARKK

SEQ ID NO: 10017 - protein, 218 aa, Enterobacter cloacae
RERRGAQMRKRDTIVRYTAPERINHWVTAFCFMLAAISGLGFFFPSFNWLMQIMGTPQLARILHPFVGVIMFASFIIMFFRYWHHNLINRDDIFWAKNIRKIVVNEEVGDTGRYNFGQKCVFWAAIIFLVLLLVSGVIIWRPYFAPAFSIPVIRFALMLHSFAAVALIVVIMVHIYAALWVKGTITAMVEGWVTKTWAKKHHPRWYREVRQKQEKSSE

SEQ ID NO: 10018 - protein, 428 aa, Enterobacter cloacae
DRRRNDGSPLRKDPNMKWFNTLSHNRWLEQETDRILDFGKNAAVPTGFGWLGNNGQVRSDMGTHLWITARMLHVYAVAANMGRPGAYALVEHGINALNGPLRDKQHGGWYACVNDEGVIDASKQGYQHFFVLLGAASAVTTGHPQARKLLDDAIEVIERYFWSEQEQMCLESWDEAFSKTEDYRGGNANMHAVEAFLIVYDVTHDRKWLDRALRIASVIIHDVARKGEYRVNEHFDTNWNPIRDYNIDNPAHRFRAYGGTPGHWIEWGRLMLHLRAALEARFETPPEWLLEDAKGLFHATIRDAWAPDGADGFVYSVGWDGKPIVRERVRWPIVEAMGTAYALYTVTGEAQYEAWYQKWWDYCIKYLMDYENGSWWQELDTNNEVTTKVWDGKQDIYHLLHCLVIPRLPLAPGLAPAVAAGLLDSQAK

SEQ ID NO: 10019 - protein, 349 aa, Enterobacter cloacae
MATGTLPDAGQILNSLINSILLVDDELAVHYANPAAQQLLAQSARKLFGTPLPELLSYFSLNIGLMQESLQAGQGFTDNEVTLVIDGRSHILSLTAQRLPDGMILLEMAPMDNQRRLSQEQLQHAQQIAARDLVRGLAHEIKNPLGGLRGAAQLLTKALPDPALAEYTNVIIEQADRLRNLVDRLLGPQQPGMHVSESIHKVAERVVKLVSMELPDNVTLVRDYDPSLPELAHDPDQIEQVLLNIVRNALQALGPEGGEIILRTRTAFQLTLHGVRYRLAARIDVEDNGPGIPPHLQDTLFYPMVSGREGGTGLGLSIARNLIDQHSGKIEFTSWPGHTEFSVFLPIKK

SEQ ID NO: 10020 - protein, 494 aa, Enterobacter cloacae
TTAVVAATEVAAHPNDGPQRDQNGPPYTNATPTEGVSMSVPSIDWDLALIQKYNYSGPRYTSYPTALEFSDAFGEADFQHAVARYPERPLSLYVHIPFCHKLCYFCGCNKIVTRQQHKADQYLDALEQEILHRAPLFKGRHVSQLHWGGGTPTYLNKAQISRLMALLRDNFSFNDDAEISIEVDPREIELDVLDHLRAEGFNRLSMGVQDFNKEVQRLVNREQDEAFIFALLNHAREIGFTSTNIDLIYGLPKQTPESFAYTLKRVAELNPDRLSVFNYAHLPTLFAAQRKIKDADLPSAQQKLDILQETIASLTETGYQFIGMDHFARPDDELAIAQREGVLHRNFQGYTTQGDTDLLGMGVSAISMIGDCYAQNQKELKLYYQQVDETGNALWRGIALTRDDCIRRDVIKALICNFRLEFREVESQWDLQFSDYFAEDLKLLAPLAKDGLVDVSESAVVVTPKGRLLIRNICMCFDAYLRQKARLQQFSRVI

SEQ ID NO: 10021 - protein, 322 aa, Enterobacter cloacae
RFRGKKRVRSGCWWRKKPIRRWAKVSTATTPDAYAPGKTNQLNAVVQFELNRVRRHANAVVFFSTQRDVSVDSFIGEHAASGQELAVCVQRLQGFFQRAGNLWDLFRFFWRQVVQVFVHGFARVDLVLDTVQTGHQQCCEAQVWVSRRVREAHFDTTRFRRRNHRDTDRSRTVTGRVRQHHGCFVAWNQTLVGVRGRVRQGVDRFSVFDNTADVVQRLLRQTRILVTREQVGAVLGQGHVAVHAGTVVAKHWFWHEGRGFTETVRNVVYNVFVDLNLIRFFGHGVEAGSDLVLASRCHFVVVRFNNQAHLFHDQTHGRTDVL

SEQ ID NO: 10022 - protein, 189 aa, Enterobacter cloacae
RIDRRNREVTAFHAWTVTFVTTFVLGGRVPCAFDVIDSDVGARNGSTKTDVVEQEELWLWPEQNGVCDAGRAQVLFSAFCDGAWVTVIALQRARFQNIAADDQRRFFVERVNERSGCIWHQNHVGFVNAFPAANGGAVKHFAFFKEFGVHLMSRDRDVLFFTFSIGEAQINKLHFMFVQHRQNVFSGHT

SEQ ID NO: 10023 - protein, 217 aa, Enterobacter cloacae
LKFLFPATVTSPRRKEINMLYIFDLGNVIVDIDFNRVLGAWSDFSRVPLATLKQNFAMGETFHLHERGEISDEAFAERFCQEMGLSLSYEQFSHGWQAIFVAIRPEVIDIMHKLREQEHRVVVLSNTNRLHTTFWPDEYPEIHAAADKVYLSQEMGMRKPEARIYQAVLQEEGFTAADAVFFDDNADNIEGANQLGITSILVTGKETIPNYFAKQLC

SEQ ID NO: 10024 - protein, 363 aa, Enterobacter cloacae
ALSPTGHEYTNRTIRCGYAGFAGERWPRHILAPGMSQLAVWPRVTRESTAMYHLRVPQTEEELDAYYHFRWEMLRKPLHQPKGSERDAWDAMAHHQMVVDEEGNLVAVGRLYINADNEASIRFMAVHPSVQDKGLGTLMAMTLESVARQEGVKRVTCSAREDAVEFFAKLGFVNQGEITAPQTTPIRHFLMIKPIATLDDILHRADWCGQLQQAWYQHIPLSEKMGVRIQQYTGQKFITTMPETGNQNPHHTLFAGSLFSLATLTGWGLIWLMLRERHLGGTIILADAHIRYSAPISGKPSAVADLGALGGDLDRLARGRKARVQMQVELFGDETPGAVFEGTYIVLPAKPYGAYEEGGNEEE

SEQ ID NO: 10025 - protein, 466 aa, Enterobacter cloacae
MADAGGYCAADSGSGNHHSDWCGTRVRVTGRATGPPLRIKIMNTTTCTHKDNPNFWVFGLFFFLYFFIMATCFPFLPIWLSDIIGLNKTHTGIVFSCISLSAIAFQPVLGVISDKLGLKKHLLWIISVLLFLFAPFFLYVFAPLLKTNIWLGALSGGLYIGFVFSAGSGAIEAYIERVSRNSFFEYGKARMFGCLGWGLCASTGGILFGIDPSYVFWMGSAAALLLMLLLVVAKPKPNQTAQVMNALGANQRQITAKTVFNLFRQRRMWMFILYVIGVACVYDVFDQQFATFFKTFFATPQEGTRAFGFATTAGEICNAIIMFCSPWIINRIGAKNTLLIAGVIMATRIIGSSFATTAVEVIALKMLHALEVPFLLVGAFKYITGVFDTRLSATIYLIGFQFAKQSAAIFLSAFAGNMYDRVGFQETYLILGCFVLAITVVSAFTLSGRREIAATAGAAALTHQSR

SEQ ID NO: 10026 - protein, 292 aa, Enterobacter cloacae
CPVIRRRGCGVAAQLILRKDDFFASASQAVAVADRYPQNVFAEHTHEFCELVLVWRGNGLHVLNDRPYRITRGDLFYIRAEDKHSYASVNDLVLQNVIYCPDRLKLNVDWAGNIPGFHNARGEPHWRLSSNGMAQVRQTISQLEQESQKSDPAANQMSELLFAQLVMTLKRHRYATDNPSATMQEALLDKLITRLAGSLNKSFVLDKFCEQEQCSERALRQQFRTQTGMTVNHYLRQLRICHAQYLLQHTELMVSEVAMRCGFEDSNYFSVVFNREVGMTPVQWRHRSRKAA

SEQ ID NO: 10027 - protein, 217 aa, Enterobacter cloacae
QLCRPTIMERIMSYTLPSLPYAYDALEPHFDKQTMEIHHTKHHQTYVNNANAALESLPEFANLPVEELITKLDQLPADKKTVLRNNAGGHANHSLFWKGLKTGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKAFWDVVNWDEAAARFAAKK

SEQ ID NO: 10028 - protein, 234 aa, Enterobacter cloacae
LAFFVSEGVEMHYPVNVFTGKVREYEGSRPSAIAKVQVDGELTLTDLGLAGDQQAEKKIHGGPDRALCHYPREHYQHWKTEFPEQADLFVAPAFGENLSTEGLTEKNVFIGDIYRWGDALIQVTQPRSPCFKLNYHFGIQDMSAQLQNAGKTGWLYRVVQAGQVSADAPLELASRLSEVSVYEACAIAWHMPFDDDQYHRLLSAAGLSTSWTRTMQKRRISGKIESSSRRLWGK

SEQ ID NO: 10029 - protein, 200 aa, Enterobacter cloacae
LYVVLHPLTHVCSLNRRLSLVESRHERFWEQVMRKVTAAVMASTLAFSAFSQAAVAIISDNGSSAEGATQHSSQSHMFDGISLTEHQRQQMRDLMQRARHDQPPVNVSEMETMHRLVTAENFDESAVRAQAENLAQEQVARQVKMAKVRNQMFHLLTPEQQAVLNTKHQQRMNQLREVARMQRSSDMTLFSSNSSTRSNQ

SEQ ID NO: 10030 - protein, 302 aa, Enterobacter cloacae
RHGMTGVFMNQSYGRLVSRAAIAATVMASCLLIIKIFAWWYTGSVSILAALVDSLVDIAASLTNLLVVRYSLQPADEEHTFGHGKAESLAALAQSMFISGSALFLFLTGIQHLVSPSPMNDPGVGVVVTVVALISTLVLVTFQRWVVRKTQSQAVRADMLHYQSDVMMNGAILIALGLAWYGWHRADALFALGIGIYILYSALRMGYDAVQSLLDRALPDAERDEIYAIVTNWPGVSGAHDLRTRQSGPTRFIQIHLEMEDNLPLVQAHMVAEQVEQAILQRFPGSDVIIHQDPCSVVPRAF

SEQ ID NO: 10031 - protein, 93 aa, Enterobacter cloacae
KTVTKQHKPKSEKPMLSPQAELDLLENDERLDALLERLEEGETLTAEEQSWVDAKLDRIDELMQKLGLSYDDEDDEEEDEKQEDMMRLLKGGN

SEQ ID NO: 10032 - protein, 315 aa, Enterobacter cloacae
TFGEIKMKASEIAEGITMTRIVCVGITVLDRIWYLDDLPKEGGKYVAKDYTEVGGGPAATAAVAAAKLGAEVDFIGRVGDDDTGRRLLAELESLGVNTRYTRVVKGARSSQSAVLVDGSGERVIANYSSPDLPAVADWLQEIDFSQWDIVLADVRWHDGAKQAFTLARQQGVPTLLDADVTPQDIAELIALSDHAAFSAPGLRRLTQRDDTEDALKKAQTLTNGHVYVTQGRDGCFWLENGALCHQPGFEVNVVDTTGAGDVFHGALAVSLGQKLPAADAVRFASAVAALKCTKPGGRAGIPDCDQTRSFLSLFV

SEQ ID NO: 10033 - protein, 153 aa, Enterobacter cloacae
KTTRSRPTMIALIQRVTRASVTVADEVTGEIGPGLLVLLGVEKDDDEQKANRLCERVLGYRIFSDAEGKMNLNVQQAGGSVLVVSQFTLAADTERGMRPSFSKGAAPERAEALYEYFVERCRQQDMNTQTGRFAADMQVSLVNDGPVTFWLQV

SEQ ID NO: 10034 - protein, 353 aa, Enterobacter cloacae
GAGARYARAAGGGTKLKKIRKIMSLKAIAKELGLSVTTVSRALNGYDDVSAETRARVEAEAQRRGYRPNTFARRLKMGKIDAVGLVFPVHPVPLNNSVFMDMVGEISHELARHEIDLLLIADDDLADKHSYMRMVQSRRVDALIVAHTLDHDPRLEQLQAAGFPFLALGRSQLPQPYAWFDFDNYAGTYQATRWLIEKGHQRIALLGESNNQAFITQRRQGYLDALREAGLSSEWLRAMPPSRRVGYATTQELLSLPQPPTAIITDCNTHGDGAAMALAQMGRLTGENAVSLVVYDGLPQDSIVDIDVAAVIQSTRQGVGKQIADMVRQLINGDDIDTLQVLWQPEFSPGQTA

SEQ ID NO: 10035 - protein, 742 aa, Enterobacter cloacae
SHEKFQTRSQIRNVLVCIRNVSDQNSGHPDDRRCPMQDAIFRLESNTVDVVLKTHPFAEILYWGPHLQHFSPQDVLSIARPVANGRLDVDSPVTLMAELGHGLFGSPGIEGHRQGLDGSPVFKTTQVQQALNALTITAEDEHAGLRLTSEITLDASGVLVVRHGLTNLKTLAWQVDRFAVTLPVAERAQEVMAFHGRWIREFQPHRVTLEHDSFVIENRRGKTSHEHFPALISGTPSFSEMHGHVWGVHLGWSGNHRLRAEAKTDGRRYMQAEALYLPGEMAIEEGETLWTPRLYASHSPHGLNGMSQQFHRYLRDNVIRFPEDKPRPVHLNTWEGIYFDHDPDYIMRMADEAAALGVERFIIDDGWFKGRNDDHAALGDWYLDEKKYPNGLKPVIDHVKQLGMEFGIWVEPEMINPDSDLYRAHPDWVLALPGYAQATGRHQLVLNLNIPQAFDYLVERMSWLLGEHAVDYVKWDMNRELVQPGHKGKAAADAQTRQFYRLLDVLGERFPHIEFESCSSGGGRIDYEVLTRCHRFWASDNNDALERNTIQRGMSYFFPPEVMGAHIGHHKCHATFRQHSIQFRGLTALFGHMGLELDPLTVDAQEREGYRHYAALYKRWRGVIHHGTQWRVDMPDATTLAQGIVSEDKTQGLFLVSQLAMPDYTLMMPLRMPGLDASAQYRITLLDHPNIQITGEGGHTMRKLPAWMDAPQTVSGEWLMQAGIALPILDPETTILIGVERV

SEQ ID NO: 10036 - protein, 364 aa, Enterobacter cloacae
ITTIWPDLNQFSWKGLIYYLQYSTVEQFLPAADFNFAFLSSEVVMIKKIGVLTSGGDAPGMNAAIRGVVRAALTEGLEVFGIYDGYLGLYEDRMVQLDRYSVSDMINRGGTFLGSARFPEFRDEHIREVAIENMKKRGLDALVVIGGDGSYMGAKRLTEMGFPCIGLPGTIDNDIKGTDYTIGYFTALGTVVEAIDRLRDTSSSHQRISIVEVMGRYCGDLTLAAAIAGGCEFVVVPEVEFSREDLVAEIKAGIAKGKKHAIVAITEHICDVDELAKYIETETKRETRATVLGHIQRGGSPGPYDRILASRMGAYAIELLLQGHGGRCVGIQNEKLVHHDIIDAIENMKRPFKGDWLDCAKKLY

SEQ ID NO: 10037 - protein, 349 aa, Enterobacter cloacae
SSVSFLARCIHQNTTQESWAMNKWGVGLTLLLASTSVLAKDIQLLNVSYDPTRELYDQYNKAFAAHWKQETGDNVVVRQSHGGSGKQATSVINGIEADVVTLALAYDVDAIAERGRIDKNWIKRLPDNSAPYTSTIVFLVRKGNPKQIKDWNDLIKPGVSVITPNPKSSGGARWNYLAAWGYALHHNNGDQAKAQDFVKALFKNVEVLDSGARGATNTFVERGIGDVLIAWENEALLATNELGKDKFEIVTPSESILAEPTVSVVDKVVDKKGTKAVAEAYLKYLYSPEGQEIAAKNFYRPRDEAVAKKYENAFPKLKLFTIDDVFGGWTKAQKEHFSNGGTFDQISKR

SEQ ID NO: 10038 - protein, 272 aa, Enterobacter cloacae
EIRRVFYLVIILRYSFASIENRERVVKKIILLILIVIALAAGGVYWMKAGNPNALRHIVLDQCVPNQLHNRNPAPCAQVKPDAGYVVFKDRNGPLQYLLMPTYRINGTESPLLTEPQTPNFFWLAWQSRHFMSMKRGADVPDSAVSLTINSPTGRTQNHFHIHISCLRPDVREKLNASQGQISTQWLPLPGGLEGHEYLARRVTENELVQRSPFMMLAEELPEARDHMGRFALAMAQQSDGSFVLLATERNLLTFNRASAEELQDHQCDILK

SEQ ID NO: 10039 - protein, 610 aa, Enterobacter cloacae
GKVVIEKLRNIAIIAHVDHGKTTLVDKLLQQSGTFDARAETQERVMDSNDLEKERGITILAKNTAIKWNDYRINIVDTPGHADFGGEVERVMSMVDSVLLVVDAFDGPMPQTRFVTKKAFAHGLKPIVVINKVDRPGARPDWVVDQVFDLFVNLDATDEQLDFPIVYASALNGIAGLDHEDMAEDMTPLYQTIVDRVPAPNVDLEGTLQMQISQLDYNNYVGVIGIGRIKRGKVKPNQQVTIIDSEGKTRNGKVGKVLTHLGLERIESDIAEAGDIIAITGLGELNISDTICDPQNVEALPALSVDEPTVSMFFNVNTSPFCGKEGKFVTSRQILDRLNKELVHNVALRVEETEDADAFRVSGRGELHLSVLIENMRREGFEMAVSRPKVIFREIDGRKQEPFENVTLDVEEQHQGSVMQALGERKGDLKNMNPDGKGRVRLDYVIPSRGLIGFRSEFMTMTSGTGLLYSTFSHYDDVRPGEVGQRNNGVLISNGQGKAVAFALFGLQDRGKLFLGHGAEVYEGQIIGIHSRSNDLTVNCLTGKKLTNMRASGTDEATVLVPPIKMTLEQALEFIDDDELVEVTPQSIRIRKRHLTENDRKRAMRGAKED

SEQ ID NO: 10040 - protein, 303 aa, Enterobacter cloacae
NAQSPAGARVYPTVIKPALFCHFLYKMRGVMVFRGQPMSLTELTGNPRHDQLLTLIADRGYMNIDELAQLLDVSTQTVRRDIRKLSEQGLITRHHGGAGRASSVVNTAFEQREVSLTEEKRAIAEAIADYIPDGSTIFITIGTTVEHVARALLNHNHLRIITNSLRVAHILYKNPRFEVMVPGGTLRPHNGGIIGPAATAFVSGFRADYLVTSVGAIEHDGAMMEFDVNEASVVKTMIAHSRHILLAADHTKYHASAAVEIGNVAQATALFTDELPGPALQNHLKSSKVEVVEVNSGEEQQAG

SEQ ID NO: 10041 - protein, 316 aa, Enterobacter cloacae
SVRYHLHSGDRKRDDTELLCEAVMLKTVHQKANHHTRPLRAWLKLLWHRIDEDNMTTLAGNLAYVSLLSLVPLVAVIFALFSAFPMFADVSMQLRHFVFANFIPATGDVIQNYIEQFVANSSKMTAVGACGLIVTALLLMYSIDSALNTIWRSKKVRPKVYSFAVYWMILTLGPLLAGASLAISSYLLSLRWATDLNSVIDNVLRIFPLILSWLSFWLLYSVVPTTRVPNRDAVVGALVAALLFELGKKGFALYITMFPSYQLIYGVLAVIPILFVWVYWTWCIVLLGAEITVTLGVYRELKKAAEAEKQQEADQP

SEQ ID NO: 10042 - protein, 303 aa, Enterobacter cloacae
SILCVRPAVCVAIAGSLPWLFRNTVVSKQNRVAHASPLPAGIVELSVHRPPHISHATPDFLAEEVPVALIYNGISHVVMMASPKDLELFAIGFSLSEGIIAHPQEIYGMDVVHACNGLEVQIELSSRRFMGLKERRRALAGRTGCGVCGVEQLNDIGKPIIPLPFTQTFNLAHLDRALEHLNDVQPIGQLSGCTHAAAWILPSGNIAGGHEDVGRHVALDKLLGRRARESNVWQQGAALVSSRASYEMVQKSAMCGVEILFAVSAATTLAVEVAERCNLTLVGFCKPGRATIYTHPQRLIVDQ

SEQ ID NO: 10043 - protein, 92 aa, Enterobacter cloacae
GLIFISSRHGALSKQLNERVYLMKSIKTFVAVIALATSFGSFAAQTVTASASTLDGAEAKIAAQAQEAGASSYKITQAFTGNRVHMTAELNK

SEQ ID NO: 10044 - protein, 213 aa, Enterobacter cloacae
PYRTYFHYNERIRNVLQDERFVRYREKEAVIMTQPISVIAKSLVRERLRTGLSLAEIARRAGIAKSTLSQLESGNGNPSLETLWSLCVALDIPFARLLEPQQPVTQVIRRGEGTKVVAGQANYEAILLAACPPGARRDIYLLLTQPGADRISQPHPPGSVEHIIVTQGRAMVGLIDAAEELGPGDYICYPADQPHIFKALEPDTHALLVAEQN

SEQ ID NO: 10045 - protein, 287 aa, Enterobacter cloacae
ELFSLVGAVMTVLHSVDFFPTGASPVAIEPRLPQAAFPEHHHDFHEIVIVEHGTGIHVFNGQPYTISGGTVCFVRDHDRHLYEHTDNLCLTNVLYRSPDAFQFLSGLNQLLPQEKDGHYPSHWRVNQSTLQQVRQLVSQMEQSEDGQETHAIATRELLFMQLLVLLRRSSLVEGLENNDARLNQLMAWLEDHFAEDVCWETLADDFSLSLRTLHRQLKQHTGLTPQRYLNRLRLIKARHLLRHTDESVTDIAYRCGFGDSNHFSTLFRREFSWSPRDIRQGKDALLQ

SEQ ID NO: 10046 - protein, 441 aa, Enterobacter cloacae
KILQETGMSLWLTHPLLLPSLIVGVTIVLWATSLLPEFITALLFFTAAMAARIAPPEVIFGGFASSAFWLVFSGFVLGVAIRKTGLADRAARALSAKLTDSWVLMVASVVLLSYALAFVMPSNMGRIALLMPIVAAMAKRAGIPDGSRAWFGLALAVGFGTFQLSATILPANVPNLVMSGAAEGSYGIHLNYVPYLLLHTPVLGILKGLILIGLICWLFPGNPKPAKDLAPSEPMGRDEKRLAWLLAVVLTMWVTESWHGVGPAWTGLAASVVVMLPRIGFITGEEFSAGVNMRTCIYVAGILGLAITVTQTGIGAAVGETLLHIMPLDADRPFTSFLALTGITTALNFIMTANGVPALYTTLAQSFSDATGFPLLSVIMIQVLGYSTPLLPYQASPIVVAMGLGKVPAKAGMLLCLALAIATYLVLLPLDYLWFSVLGRL

SEQ ID NO: 10047 - protein, 166 aa, Enterobacter cloacae
LKRYLVGLSKGHNSRVKCGLNNNKEPYMTIQQWLFSFKGRIGRRDFWIWIATWVVAMLLLFFVAYNAWLSTQTAAFALVCLLWPTAAVVVKRLHDRGRSGAWAFLIILAWMLVAGNWSLLPSILPWVVGRLLPTVIFVMMVVELGAFIGTQSENKYGKDTLEVKYR

SEQ ID NO: 10048 - protein, 90 aa, Enterobacter cloacae
SVALQFRRGRIMSLEVFEKLESKVQQAIDTITLLQMEIEELKEKNNSLSQEVQNAQHSREEMERENNQLREQHNGWQERLQALLGRMEKV

SEQ ID NO: 10049 - protein, 1072 aa, Enterobacter cloacae
CKNRCHDRQRRPQLIPYLRIQSMDFSRFFIDRPIFAAVLSILIFITGLIAIPLLPVSEYPDVVPPSVQVRAEYPGANPKVIAETVATPLEEAINGVENMMYMKSVAGSDGVLVTTVTFRPGTDPDQAQVQVQNRVAQAEARLPEDVRRLGITTQKQSPTLTLVVHLFSPGGKYDSLYMRNYATLKVKDELARLPGVGQIQIFGSGEYAMRVWLDPNKVAARGLTASDVVTAMQEQNVQVSAGQLGAEPLPKESDFLISINAQGRLHTEEEFGNIVLKTTQDGTVVRLRDVARIEMGSGSYALRSQLNNKDAVGIGIFQSPGANAIDLSNAVRAKMDELSTRFPADMKWAAPYDPTVFVRDSIRAVVQTLLEAVVLVVLVVILFLQTWRASIIPLIAVPVSVVGTFSILYLLGFSLNTLSLFGLVLAIGIVVDDAIVVVENVERNIEEGLAPLAAAHQAMREVSGPIIAIALVLCAVFVPMAFLSGVTGQFYKQFAVTIAISTVISAINSLTLSPALAALLLKPHGAPKDFPTRLIDRLFGWIFRPFNRFFLRSSNGYQGLVGKTLGRRGAVFVVYLLLLCAAGVMFKAVPGGFIPTQDKLYLIGGVKMPEGSSLARTDAVIRKMSEIGMNTEGVDYAVAFPGLNALQFTNTPNTGTVFFGLKPFDQRKHSAAEINAEINAKIAQIQQGFGFSILPPPILGLGQGSGYSLYIQDRAGLGYGALQNAVNTMSGAIMQTPGMHFPISTYQANVPQLDVQVDRDKAKAQGVSLTDLFGTLQTYLGSSYVNDFNQFGRTWRVMAQADGQFRDSVEDIANLRTRNSQGEMVPIGSMVNITTTYGPDPVIRYNGYPAADLIGDADPRVLSSAQAMTQLDAMSKQILPNGMNIEWTDLSFQQATQGNTALIVFPVAVLLAFLVLAALYESWTLPLAVILIVPMTMLSALFGVWLTGGDNNVFVQVGLVVLMGLACKNAILIVEFARELEIQGKGIMEAALEACRLRLRPIVMTSIAFIAGTIPLILGHGAGAEVRGVTGITVFSGMLGVTLFGLFLTPVFYVTLRKFVTRGKAEREVLPA

SEQ ID NO: 10050 - protein, 284 aa, Enterobacter cloacae
IQRASLMRNITLRHSFPRSRIGRSMKSILPGAVLALLATTALAADQRQGNVLTLGGGVDVAPRYSGSDKSRVSAAQVVDYAMANGFFVSTTRGIGYGNSFGNLDYNAALSYRAGRKDRDVSSDSIASGSDDLRGMGDIKGSAIVVPGLGYRVTDWLTVQLQAEVPVSERDNGEAVHFGIASPFYTSPKNALTLALTGSWGSSKYVQTYYGVNAAQSAASGFARHDAGSGLYAYSLNLDWTHKLTSRWSLLAAAGVTQLTGEAGDSPIVQRKTSPVGSLKVTYSF

SEQ ID NO: 10051 - protein, 300 aa, Enterobacter cloacae
EKLCMTTLNLGHLATFRLVVQRGSFSAAADVMGISQPAVSLQIRQLEQFLQTRLIERTGRGIKATAAGEALRVHGERLELAVEETIRSVSAFNQEVSGTITLGTGATACIHLLPALLQQLREEYPLLRIGVTTGNTPDIVRAIEENRLDMGLVTLPASGRTLAIMHAMEEEFVWIGAQVQPEEGEQFTPDSLYAQPLIAFESGSGTRTLIDGWFEARGLAVSPVMQLGSIEAIKRMVRAGLGYSIVPRMAVEHADDREGLRVQSLTPVLRRQLAIVMRQDKILSKGMTVIIRLLQREHGR

SEQ ID NO: 10052 - protein, 435 aa, Enterobacter cloacae
  UNSURE (224)
HSEENTMTRRAIGVSERPPLLQTIPLSLQHLFAMFGATVLVPILFHINPATVLLFNGIGTLLYLFICKGKIPAYLGSSFAFISPVLLLLPLGYEVALGGFIMCGVLFCLVSFIVKKAGTGWLDVMFPPAAMGAIVAVIGLELAGVAANMAGLLPADGQSPDSKTIIISLVTLGVTVFGSVLFRGFMAIIPILIGVLAGYALSFVMGVVDTTPIAEAHWFALPTXYTPRFEWFAIFTILPAALVVIAEHVGHLVVTANIVKRDLIRDPGLHRSMFANGFSTIISGFFGSTPNTTYGENIGVMAITRVYSTWVIGGAAIIAILLSCVGKLAAAIQIIPVPVMGGVSLLLYGVIGASGIRVLIESKVDYSKAQNLILTSVILIIGVSGAKVHIGAAELKGMALATIVGVGLSLIFKLISVIRPEEVVLDADDSEKAPH

SEQ ID NO: 10053 - protein, 247 aa, Enterobacter cloacae
TPFRFYVRSLVEVFLNGPAQLSLPLYLPDDETFASFWPGDNPSLLAALQNVLRQEHSGYIYIWSREGAGRSHLLHAACAELSARGDAVGYVPLDKRTWFVPEVLEGMEHLSLVCIDNIECVAGDEPWEMAIFNLYNRILESGKTRLLITGDRPPRQLNLGLPDLASRLDWGQIYKLQPLSDEDKLQALQLRARLRGFELPEDVGRFLLKRLDREMRTLFDTLDQLDRASITAQRKLTIPFVKDILKL

SEQ ID NO: 10054 - protein, 247 aa, Enterobacter cloacae
IQIITPGVMKMQKQAELYRGKAKTVYSTENPDLLVLEFRNDTSAGDGARIEQFDRKGMVNNKFNHFIMTKLAEAGIPTQMEALLSDTECLVKKLDMVPVECVIRNRAAGSLVKRLGIEEGIELNPPLFDLFLKNDAMHDPMVNESYCETFGWVSKENLARMQELTYKANDVLKKLFDDAGLILVDFKLEFGLYKGEVVLGDEFSPDGSRLWDKETLDKMDKDRFRQSLGGVVEAYEAVAHRLGVKLD

SEQ ID NO: 10055 - protein, 293 aa, Enterobacter cloacae
FEVFMRWQGRRESDNVEDRRSSGGGGPSMGGPGFRLPSGKGGIILLVVVLVAGYYGVDLTGLMTGETGQQQQYSQRSISPNEDEAAKFTSVILATTEDTWGQQFEKMGRTYQPPKLVMYRGATRTGCGTGQSVMGPFYCPADSTVYIDLSFYDDMKSKLGADGDFAQGYVIAHEVGHHVQKLLGIEPKVRQMQQNASQAEMNRLSVRMELQADCFAGVWGHSMQQQGVLETGDLEEALNAAQAIGDDRLQQQSQGRVVPDSFTHGTSEQRYSWFKRGFDSGNPSQCNTFGKAM

SEQ ID NO: 10056 - protein, 267 aa, Enterobacter cloacae
KPTFCNGNFFNDFFSKVAWSLPRRGVKSCLSIKEIAMKHDHFVVQSPDTPAKQLLLLFHGVGDNAVNMGQIGSWFAPVFPHALIVSIGGVEPCGPDGRQWFSVEGVTEENRQARIDAVMPAFIDTVRYWQQQSGVGADATALIGFSQGSIMSLESVKAQPGLVSRVIAFNGRFATLPQSATTQTTIHLIHGGEDRVIELSHAVAAQETLMREGGDVTLDIVDDLGHAIDDRSMQFALDHLRYTVPKHYFDEALSGAKPNDDDIVEFM

SEQ ID NO: 10057 - protein, 685 aa, Enterobacter cloacae
TLRRHAAVGKYDNNRKNKVIEPKTGVVMNRFIMANAQQCIGCRACEVACVMAHNGEQHALSERHFHPRITVLTSGLRKSPVTCHHCENAPCAQSCPNGAITQHSDSVQVNQQKCIGCKACVVACPFGTMDMLIAPLENDSVKASAHKCDLCLERPQGPACVENCPAEVLTLATPAVLDKLVKQRRQRSARLDALPWHSEAVQSVPPQTKRQQMQNTPARGEPDKLSPDARAGHFNEIYLPFRPEQAQREASRCLKCGDHSICEWTCPLHNHIPQWIERIRAGDIIGAAELSHQTNCLPEITGRVCPQDRLCEGACTLRDASGAVTIGNIERYISDRALAMGWTPDVSHVKPVGKRVAIIGAGPAGLACADVLVRSGVGVTVYDRHPEIGGLLTFGIPAFKLDKSLLARRREIFSAMGIRFELNCEVGKDVSMAQLQNDYDALFIGVGTYRSMKAGIPHEDAPGVYDALPFLVANTRNVMGLDPAADEPFIDTQGLNVVVLGGGDTAMDCVRTALRHGAAKVTCAYRRDEANMPGSKKEVKNAKEEGAAFEFNVQPVELTLDTDGKVNGIRMLRTRLGEPDAQGRRRPVPVAGSEFVMPADAVIMAFGFNPHAMPWLQAQGVDTDDWGRIKASVESRYRYQTSNPQIFAGGDAVRGADLVVTAMAEGRHAAQGIMDWLGVPPRNMH

SEQ ID NO: 10058 - protein, 767 aa, Enterobacter cloacae
PKRERNNKMDDQLKQSALDFHEFPVPGKIQVSPTKPLATQRDLALAYSPGVAAPCLEIEKDPLAAYKYTARGNLVAVISNGTAVLGLGNIGALAGKPVMEGKGVLFKKFAGIDVFDIEVDELDPDKFINVVAALEPTFGGINLEDIKAPECFYIEQKLRERMNIPVFHDDQHGTAIISTAAILNGLRVVEKNLSDVRMVVSGAGAAAIACMNLLVALGMQKHNIVVCDSKGVIYKDREPNMAETKAAYAVEDDGKRTLEDVIEGADIFLGCSGPKVLTQEMVQKMARAPMILALANPEPEILPPLAKAVREDAIICTGRSDYPNQVNNVLCFPFIFRGALDVGATAINEEMKLAAVHAIAELAHAEQSEVVASAYGDQDLSFGPDYIIPKPFDPRLIVKIAPAVAKAAMDSGVATRPIEDFDAYVDKLTEFVYKTNLFMKPIFSQARADAKRVVLAEGEEARVLHATQELITLGLAKPILIGRPSVIEMRIQKLGLQIKPGVDFEIVNNESDPRFKEYWNEYYSIMKRRGITQEQAQRAVISNTTVIGAIMVHRGEADALICGTIGEYHEHFSVVQEIFGYREGVHTAGAMNALLLPSGNTFIADTYVNDDPSPEELAEITVMAAETVRRFGIEPKVALLSHSNFGSSKSAAACKMRQTLDLVRERAPELMIDGEMHGDAALVESIRNERMPDSPLKGSANVLIMPNVEAARISYNLLRVSSSEGVTVGPVLMGVSKPVHVLTPIASVRRIVNMVALAVVEAQTQPL

SEQ ID NO: 10059 - protein, 174 aa, Enterobacter cloacae
HYAKFWRVFPRLLAKCPVHAIITVFKPEKAVNTMEIRVFRQEDFEEVITLWERCDLLRPWNDPEMDIERKVNHDVSLFLVAEVNGEVVGTVMGGYDGHRGSAYYLGVHPEYRARGIANALLNRLEKKLIARGCPKIQIMVREDNDVVLGMYERLGYEHADVLTLGKRLIEDEEY

SEQ ID NO: 10060 - protein, 315 aa, Enterobacter cloacae
PPSMPRSRGIFFSGGAMSQVQSGILPEHCRAAIWIEANVKGDVDALRAASKVFVDKLATFQAKFPEAHLGAVVAFGNTVWRQLSGGEGAKELKDFIPYGKGLAPATQYDVLIHILSLRHDVNFSIAQAAIEAFGDSIDVQEEIHGFRWVEERDLSGFVDGTENPAGEETRREVAVIKDGVDAGGSYVFVQRWEHNLRQLNRMSVHDQEMMIGRTKDANEEIDGDARPVTSHLSRVDLKEDGKGLKIVRQSLPYGTASGTHGLYFCAYCARLYNIEQQLLSMFGDTDGKRDAMLRFTRPVTGGYYFAPSVERLLAL

SEQ ID NO: 10061 - protein, 278 aa, Enterobacter cloacae
VMFAGSTRRVLPGFTLSLGTSLLFVCLILLLPLSALVMQLAEMSWSQYWEVVTNPQVVAAYKVTLLSAFVASIFNGVFGLLMAWILTRYRFPGRTLLDALMDLPFALPTAVAGLTLASLFSVNGFYGEWLAKFDIKVTYTWLGIAVAMAFTSIPFVVRTVQPVLEELGPEYEEAAETLGATRWQSFRKVVLPELSPALLAGVALSFTRSLGEFGAVIFIAGNIAWKTEVTSLMIFVRLQEFDYPAASAIASVILAASLLLLFSINTLQSRFGRRVVGH

SEQ ID NO: 10062 - protein, 376 aa, Enterobacter cloacae
RIRKNVSIRREIMSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPDAAAIKAKVTKLLEMVQLAHLADRFPAQLSGGQKQRVALARALAVEPQILLLDEPFGALDAQVRKELRRWLRQLHEELQFTSVFVTHDQEEAMEVADRVVVMSQGNIEQVDEPEQLWREPATRFVLEFMGEVNRLQGTIRGGQFHVGAHRWPLGYTSAHQGPVDLFLRPWEVDVSRRTSLDSPLPVQVLEASPKGHYTQLVVQPLGWYTEPLTVVMRDDEPPHRGERLFVGLQHARIYHGNERIETREDIALAESA

SEQ ID NO: 10063 - protein, 290 aa, Enterobacter cloacae
RELFAGGGDLSVMEMILFRDNTRAQQTDIVAVQSQVVYGSVGNSIAVPNIRTHRLNVTAVPTVLFSNTPHYDTFYGGVIPDEWFSGYLKALEEREILRELKAVTTGYMGSASQIVLLAQWLKAIKVQHPDLLVLVDPVIGDIDSGMYVKPDIPEAYREHLLPLAQGITPNVYELEVLSGKPCRTPESAIAAAQGLLSNSLKWVAITSAPVADDPQNIHVVLVSEGGVTVSAHPRVETDLKGTGDLFCSELVSGIVGGKTVADAIRMAGDRVTDVMIYTQSKGYDELILPA

SEQ ID NO: 10064 - protein, 93 aa, Enterobacter cloacae
TNSSIPLSDSIENAWLVSKILPMVPSTGATILLPVGLIAMPSPTIFSANTTSGTSSMLTISPESGATISIVPESFLSSETRDFSLSNKPMIFS

SEQ ID NO: 10065 - protein, 424 aa, Enterobacter cloacae
TTQMALSQLPDKGSGAASPAASCPAATITGIKIMSLQKTWGNFHLSAMGVVLLSVLLVGCDDSVAQNAAPQAPVVSAADVVVKSISQWDSFNGRIEAVESVQLRPRVSGYIEKVNYTDGQEVKKGEVLFTIDDRTYRAALEQAQANLARAKTQASLAQSEANRTDKLINTHLVSREEWEQRRSAAVQAQADIRAAQAAVDAAQLNLDFTKVTAPIDGRASRALITSGNLVTAGDSASVLTTLVSQKTVYVYFDVDESTYLHYQKLARSGQGASSNHTALPVEIGLTGEEGYPHQGKVDFLDNQLTPGTGTIRMRALLDNSQRQFTPGLFARVRLPGSAEFKATLVDDKAVLTDQDRKYVYIVDKDGKAQRRDITPGRLADGLRIVQQGLNPGDKVIVDGLQKVFMPGMPVNAKTVAMTASAALN

SEQ ID NO: 10066 - protein, 792 aa, Enterobacter cloacae
VNRIPSLIFKIPPPLCLPGIFRATCTSGWMPVFLYPLERKGCKRASMNIHHILKQNKDRWWALPLILPVVLLPVLSVANTLTQLGDGIVALYYLPLSFLLALMLFFGLEALPGVVVSLFLRYYPSVGLFETVAGILHFIVPLVLSWGGYRVFAPRRNMTAYGDIRLMGQRIFWQVFCPATLFLVLFQFAVYLGIYESRQSLAGLNPLNIRTLINYQGLLVSGLTGVPLSYLLIRLIRHPRYIKGLMSQLRAQIDKKVTAVEFVVWFLALGGLLVMLLLPMNANSSIFSTNYTLSLLMPVMLWGAMRFGYKLMSLIWTPVLLVSIHFFYHYIPVQEGYGIQLAITSSSYLVFSFVVTYMSMLATRQRAINIRSRSQAFLDPVVHMPNLRALSRELASHPWSALCLLRVPELEVLGRNYGVMLRIQYKQQLAQWINGTLQPNERVYHLTGYDMAVRLDAESHQQRIETLDEHIKQFVFVWDGMPVQPQVGISYCYVRSPVNHLYLVLGELGIVADLSLSTNHPENLQQRGAVHLQRSLKDKVAMMSRLQAALEQDAFTLLVQPVRGLRGDCYHEVLLRMRDDNGALIFPEQFLPIAQEFGLSSRVDLWVLERTLSFLAQHRQRLPGQRFAINLAPSTVYRAQFPLEVSRLLAKYAVEAWQLIFEVTESSAFGHADLAASTLRKLQKMGIRIAIDDFGTGYASYARLKSVDADILKIDGGFIRNIVSNSLDYQIVASICHLARMKKMLVVAEYVETEEIRSAVHALGIDYVQGYLIGLPAELDTLLDTEPSQESA

SEQ ID NO: 10067 - protein, 477 aa, Enterobacter cloacae
RMSGFKAGFLWGGAVAAHQLEGGWKEGGKGVSVADVMTAGAHGVPREITNGVMEGKNYPNHEAIDFYHRYKEDIKLFAEMGFKCFRTSIAWTRIFPKGDELEPNEAGLQFYDDLFDECLKHGIEPVITLSHFEMPFHLVTEYGGWRNRKLIDFFVRFAKVVFERYQHKVKYWMTFNEINNQANFHEDFAPFTNSGLKYAPGEDREPVMFQAAHYELVASALAVKAGREINPSLQIGCMIAMCPIYPLTCAPDDMMMAMNAMHRRYWFTDVHVRGKYPQHLLNYFERRGFALDITEEDKVALTQGCVDYIGFSYYMSFATKATADNPTLDYDESKSLVSNPYVQKSDWGWQIDPVGLRYSLNWFWDHYQLPLFIVENGFGAIDVQESDGTVNDQYRIDYLSAHIREMKKAVVEDGVDLMGYTPWGCIDLVSAGTGEMKKRYGFIFVDKDNEGNGTLNRSKKKSFDWYKQVIASNGEQL

SEQ ID NO: 10068 - protein, 296 aa, Enterobacter cloacae
NRSQSIRCSDINLIRLVAERDAMEIKLHANATTTPRIRRYLQQSDKSDRELAVELGISVTTVRRWRNRDQVSDNHTTPKVIHKALRQEQAALINALRDITGAPLDELLLLVNDGLGIAVSRATLNRYLKPASVRQKGASLQGKKALKAGIMPQKLLLHHQPLSLHMDDGGEQHLLWAREPVSGWCYARLYAGVSPQLLTRWTNEVLAACPADIQSVETFGLAVNLPEHNVTVKVHSQYYLALQVTVPLREIIPRVNSEPAGALLIQLCEFYNRGKAQKKLGERTPQAFLKALRRND

SEQ ID NO: 10069 - protein, 301 aa, Enterobacter cloacae
GSCSHRGWLMFTGSIVALVTPMDEKGNVCRSSMKKLIDYHVANGTSAIVSVGTTGESATLSHEEHGDVVMLTLELADGRIPVIAGTGANATAEAISLTQRFNDSGIVGCLTVTPYYNRPTQEGLFQHFKAIAEHTDLPQILYNVPSRTGCDMLPETVGRLSKVKNIIGIKEATGNLSRVHQIKELVSDDFILLSGDDATALDFMQLGGNGVISVTANVAARDMADMCKLAAAGHFDEARVINQRLMPLHNKLFVEPNPIPVKWACKELGLVATDTLRLPMTPITDHGREIVAGALKHAGLL

SEQ ID NO: 10070 - protein, 96 aa, Enterobacter cloacae
SWRLGLIRTPCRGFRRRASTPTTGGASRPPWRAVIATRPRIRRFLLAVMRYAVRIWWSPRWRKGAMPRRGSWTGLACRRATCINADGRQSGLHGVV

SEQ ID NO: 10071 - protein, 206 aa, Enterobacter cloacae
TDSFCRGARMSPNISVIKDKILSENYFVLRNITYDLTRKNGDVIRHKREVYDRGNGATILLYNREKQSVVLIRQFRIATWVNGNADGRLIETCAGLLDDDEPEVCIRKEAIEETGFEVGTVQKVFELFMSPGGVTELIHFFIAEYTDAQRTHRGGGVDDEDIEVLEMPFAKAVDMVKRGEIRDGKAVILLQYLQTSGLMNAAAEAR

SEQ ID NO: 10072 - protein, 151 aa, Enterobacter cloacae
SKMKSTEFHPGDYDVHGRLRLPFLFWCVLLLQARTWVLFVMAGASRGQGDTLLNLFYPDHDAFWLGLLPGVPAVLAFLCSGRRQFLPRFWRALRWLLILAQVVLLVWQPVLWLYGEPLSGIGIALVVADIVALLWLVTNPRLRACFMQESD

SEQ ID NO: 10073 - protein, 212 aa, Enterobacter cloacae
NGTFCRYCTPTSVDLLRKDVSMKSLRLLLCALPLALTGCSTLSSINWSAAYPWNWFGSSTEVTEQGVGKITASTALDQDAIQDAIGSDYRLRSGMKTENGNIVRYFEALKDDKVAMVINGDKGTVNRIAVMDEEIPTSGGVKVGTPFGELYQKAFGHCASVPSEESVAVECKADGSQHISYVFSGTWNGPEGLMPSDDTLKKWKVSKIIWKQ

SEQ ID NO: 10074 - protein, 340 aa, Enterobacter cloacae
GCAMAVTVLKKGSLALAGLLLVAQAQATELLNSSYDVSRELFAALNPAFEQQWAKENNGDKLTIKQSHAGSSKQALAILQGLKADVVTYNQVTDVQILHDKGKLIPANWQSRLPNNSSPFYSTMGFLVRKGNPKNIHDWNDLVRSDVKLIFPNPKTSGNARYTYLAAWGAADKADGNDKAKTEQFMTQFLKNVEVFDTGGRGATTTFAERGLGDVLISFESEVNNIRKQYEAQGFEVVIPKTNILAEFPVAWVDKNVKANGTEKAAKAYLNYLYSPQAQTVITDYYYRVNNPDVMSKLKDKFPQTELFRVEDHFGAWPEVMKTHFASGGELDKLLAAGRK

SEQ ID NO: 10075 - protein, 306 aa, Enterobacter cloacae
VKIVNTLEHTIGNTPLVKLQRMGCDNGSEIWVKLEGNNPAGSVKDRAALSMIVQAEKRGEIKPGDVLIEATSGNTGIALAMIAALKGYRMKLLMPDNMSQERRAAMRAYGAELILVSKEQGMEGARDLALAMAERGEGKLLDQFNNPDNPYAHYTTTGPEIWQQTAGRITHFVSSMGTTGTITGVSRFLREQDKPVTIVGLQPEEGSSIPGIRRWPAEYMPGIFNAQLVDQVLDIHQREAENTMRELAVREGIFCGVSSGGAVAGAIRVAESTPGAVVVAIICDRGDRYLSTGVFGEESYSQGAGI

SEQ ID NO: 10076 - protein, 240 aa, Enterobacter cloacae
LMYVKQDGYGAIRKKRYNPAIFLRMPPQRRKRMKIVEVKHPLVKHKLGLMREHDISTKRFRELASEVGSLLTYEATSDLETEKVTIEGWNGPVQVEQIKGKKITVVPILRAGLGMMEGVLEHVPSARISVVGIYRNEETLEPVPYFQKLVSNIDERMALVVDPMLATGGSMIATIDLLKKAGCSSIKVLVLVAAPEGIAALEKAHPDVELYTASVDQGLNEHGYIIPGLGDAGDKIFGTK

SEQ ID NO: 10077 - protein, 370 aa, Enterobacter cloacae
IQFTVSLPPFDSGKGCMLEMLMQWYRRRFSDPEAIALLVILVAGFGILFFFSGLLAPLLVAIVLAYLLEWPTARLEHIGCSRRWATSIVLVLFVGILLLMSFVVMPIAWQQGIYLIRDMPGMLNKLSDFAATLPRRYPALMDAGIIDAMAENMRARIMTMGDSVVKYSLASLVGLLTLAVYLVLVPLMVFFLVKDKEQMLNAVRRVLPRNRGLAGQVWQEMNQQITNYIRGKVLEMIVVGVATWIGFVIFGLNYSLLLAVLVGFSVLIPYIGAFVVTIPVVGVALFQFGLGTEFWSCFAVYLIIQGLDGNLLVPVLFSEAVNLHPLVIILSVVIFGGLWGFWGVFFAIPLATLIKAVVHAWPDVPAVEDK

SEQ ID NO: 10078 - protein, 347 aa, Enterobacter cloacae
GDLMAYSVQKSRLAKVAGVSLVMLLAACSSDSRYKRQVSGDESYLDAPPLAELHAPAGMILPIQNGDYNIPVTNGSGLVGKALDIRPPAQPLALVSGARTQFTGDTASLLVESARGTTLWPQVVSVIQSKNYTIDKRDDASQALTTDWIEWNRLDEDQQYRGRYQVSVKPQGYQQAVTVKLLNLDQAGKPVADPSAMQRYSTEMLNVIAAGLDKNATDAANAAQNRNGSTFDVQSGADDTGLPMLVVRAPFNQTWQRLPATLEKVGMKVTDSTRSTGSITATYKPLSDSAWQELGASDPQLPSGDYKIQVGDLDNRSSLQFIDPKGHTLTQAQNDALVAAFQAAFSK

SEQ ID NO: 10079 - protein, 655 aa, Enterobacter cloacae
YLRQSYVMLGFEQLVNQLQRTGHRRLVVLSGDEAWTLSQVTHLRDTLPGDWLWLEENPSKAISGLLGREYLHAVFDARDGFDVSAFAALSGTLRAGSLLVLLVPPFSVWADRPDRDSLRWSDSAEPIATPHFVHHFCRMLAADSDAIVWHQHRPLCLPVAPDLPAWQPASGEPQREQAEILDALLTMSAGVAAVTAPRGRGKSALAGMLLSGIQGSAVVTAPAKGATDVIARFAGERFHFMAPDALLASTTEADWLIVDEAAAIPGPLLEKLASRFPRVLLTTTVQGYEGTGRGFLLKFCARFSGLRRYTLSTPVRWATGCPLERIVANALLFDDALIDRKPAGEVRLTSLEPGIWESDPARGAGVYELLCAAHYRTSPLDLRRMMDAPGQHFAVAQAGAEIAGALWLVEEGGLPPELSRAVWAGFRRPRGNLVAQSLAAHGGSPLAATLKGRRVSRIAVHPHRQREGIGQRLIRSASGEDYLSVSFGYTDELWRFWRQCGFVLVRMGSHREASSGCYTAMALLPLSEAGHQLCEQAHQRLCRDMRVLSAWNGEKIPVTDAWEATLNSDDWLELAGFAFAHRAFSTSVAALTRLVLAVDIPLPALRGKMEGNTHDFGRKALLAKLREETAHALERLDYSRSQQLKADILQWQFFQ

SEQ ID NO: 10080 - protein, 377 aa, Enterobacter cloacae
IYPINPIEPARPGHEDTPQIDLFVSGAVPFMRYCVFLLFFICVLPAPRVWAAPAQQSFSDWQVTCNNQNFCVARNTGEHRGLVMSLSRSAGAKTDASLRIDLGGLSAPPVKEPDIAPRLLLDNVPLKLTSQHWQLTPWHLKTDDTGTITTFLKTIQEGQALTLRGGKQTISLAGLKAALLFIDAQQKRVGSETAWIKKGDSPPLSVPPAPALKKVAVVNPTPTPLTHNELNDLLDYGNWRMNHSQCSLDPNRREVRVTALTDDKALMIISCEAGAYNTVDLAWLVSRKKPFAARSVRLRLPFTPSSQSSDMELMNASFDEKKRELTTLALGRGIGDCGIQTRWRFNGQRFRLVRYAEEPSCDNWNGPDAWPTLWITR

SEQ ID NO: 10081 - protein, 305 aa, Enterobacter cloacae
HSAKSLWSTCGRSLMAEVTQLKRYDAPRINWGKWFLIGTGVLVSAFILVVPMVYIFVQAFSKGIMPALQNLADPDMLHAIWLTVMIALITVPVNLVFGVLLAWLVTRFNFPGRQLLLTLLDIPFAVSPVVAGLVYLLFYGSNGPLGGWLDEHDLQIMFAWPGMVLVTVFVTCPFVVRELVPVMLSQGSHEDEAAVLLGASGWQMFRRVTLPNIRWALLYGVVLTNARAIGEFGAVSVVSGSIRGETLSLPLQIELLEQDYNTVGSFTAAALLTLMAILTLFLKSVVQWRLENQEKRQHQEGNHEH

SEQ ID NO: 10082 - protein, 151 aa, Enterobacter cloacae
RSAWMVETPAAGTIGVHLAKEVDFFSIGTNDLTQYTLAVDGGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 10083 - protein, 128 aa, Enterobacter cloacae
LNRLAVPRQRVQPCAALSALFNQLIQHGWGGERKHLCRAVFNAGRALRPFQAEVAFVRRGLYAVVFQRGDQHVHRAKRTGHHAGFTANAFLLIDLYAVAVLRDGSVRAALRAGRIFTVVAGHGAFSQA

SEQ ID NO: 10084 - protein, 196 aa, Enterobacter cloacae
PRKGRTGLTTSSQHYLVITALGADRPGIVNTITRHVSSCGCNIEDSRLAMLGEEFTFIMLLSGTWNAITLIESTLPLKGAELDLLIVMKRTTARPRPALPATVWVQVEVPDSPHLIERFTALFDSHQMNIAELVSRTQPGDENAIPTLFIQITAHSPASQDASNIEQAFKALCTELHAQGSISVVDYSQHEQDGVE

SEQ ID NO: 10085 - protein, 153 aa, Enterobacter cloacae
SLAACNRPATMRESTSCAACNNALSRTRRCNKGEVMTDAVKIYHNPRCSKSRETLNLLKSNGIDPEVVLYLETPPDAQTIRQLLKMLNMGSARDLMRQKEDLYKSLNLNDTSLTEDRLIQAMVDNPKLIERPIVVANGKARIGRPPEDVLGIV

SEQ ID NO: 10086 - protein, 231 aa, Enterobacter cloacae
MKNIVVLISGNGSNLQAIIDACKQKKINGTIRAVFSNKADAFGLERAREANIPAHALEASQFAGREAFDRELVQEIDAYAPDVVVLAGYMRILSPAFVAHYAGRLLNIHPSLLPKYPGLHTHRQVLENGDEEHGTSVHFVTDELDGGPVILQAKVPVFDGDNEDDVTERVQAQEHAIYPLVVSWFVDGRLEMRDGAAWLDGVKLPPQGYAAEGVVCLNCPAALRLHGPTVP

SEQ ID NO: 10087 - protein, 178 aa, Enterobacter cloacae
LFTSAVPKRTRFTATQDRKMLDYRFPTALQMVLSVAMAEQSGERSTSAILAYGLEANPSFIRKLMVPLARDGIIVSTLGRNGSIHLGRPAEEITLRDIYLSVTEDKKLWASRPDVPARCVVSANACWYFKSIADEAEQASLAVLARHTVASALEEVKKADTSGCDPVPELCTQHKKAP

SEQ ID NO: 10088 - protein, 172 aa, Enterobacter cloacae
EKIMGLFDKLKSLVSDDKKDSGTIEIVAPLSGEIVNIEDVPDVVFAEKIVGDGIAIKPTGNKMVAPVDGTIGKIFETNHAFSIESDSGIELFVHFGIDTVELKGEGFKRIAEEGQRVKVGDPVIEFDLPLLEEKAKSTLTPVVISNMDEIKELIKLSGSVTVGETPVIRIKK

SEQ ID NO: 10089 - protein, 308 aa, Enterobacter cloacae
SKSALQETLMKPNAQLVKTFLMQLQDAICQKLSAADGGEFQEDAWQREAGGGGRSRVLRNGGIFEQAGVNFSHVHGDAMPASATAHRPELAGRSFEAMGVSLVAHPHNPFVPTSHANVRFFIAEKPGADPVWWFGGGFDLTPYYGFEEDAVHWHTTARDLCLPFGEDVYPKYKKWCDDYFYLKHRDEQRGIGGLFFDDLNTPDFDTAFSFMRAVGEGFTDAYLPIVERRKNTDYGVREREFQLYRRGRYVEFNLVWDRGTLFGLQTGGRTESILMSMPPLVRWEYSYAPKEGSPEAALSEFIRVRDWV

SEQ ID NO: 10090 - protein, 324 aa, Enterobacter cloacae
LFYFQGVIMNQLDGIKQFTTVVADSGDIESIRHYQPEDATTNPSLLLKAAGLAHFSHLIDDALAYGKQRGQTQEQQVAEASDKLAVNIGAEILKSIPGRVSTEVDARLSFDQEKSINKARRLVELYQEQGIDKSRILIKLASTWEGIRAAEVLEKDGIHCNLTLLFSFAQARACAEAGVFLISPFVGRIYDWYQAKQPMDPYVVEEDPGVKSVRNIYDYYKQHRYETIVMGASFRRTEQILALAGCDRLTISPELLKKLQESEETVIRKLVPTSTVLPKPKPMTEAEFRWEHNQDPMAVEKLADGIRQFAVDQRKLEDLLAAKL

SEQ ID NO: 10091 - protein, 127 aa, Enterobacter cloacae
IHKRTKGFTMVVMYGIKNCDTIKKARRWLEAHNIDYRFHDYRADGLDPAFLHSAINELGWEALLNTRGTTWRKLDESLRATINDADSAAKLMLEMPAIIKRPLLCKPGQPMLLGFSETLYSDLFVEV

SEQ ID NO: 10092 - protein, 376 aa, Enterobacter cloacae
SMSCPVIELTQQLIRRPSLSPDDAGCQALMIERLRAIGFTVEHMDFGDTQNFWAWRGQGETLAFAGHTDVVPAGDADRWINPPFEPTIRDGMLFGRGAADMKGSLAAMVVAAERFVAQHPNHKNRLAFLITSDEEASAHNGTVKVVEALMARNERLDYCLVGEPSSTEVVGDVVKNGRRGSLTCNLTIHGVQGHVAYPHLADNPVHRAAPMLNELVSIEWDKGNEFFPPTSMQIANIKAGTGSNNVIPGDLFVQFNFRFSTELTDEMIKARVIALLEKYQLRYTLDWWLSGQPFLTQRGKLVDAVVNAIAHYNEIKPQLLTTGGTSDGRFIARMGAQVVELGPVNATIHKINECVNAADLQLLARMYQRIMEQLVA

SEQ ID NO: 10093 - protein, 66 aa, Enterobacter cloacae
RMDWLSKYWWILVLVFLVGVLLNVIKDLKRVDHKKFLANKPDLPPHRDFNDKWDDEDDWPKKDQKK

SEQ ID NO: 10094 - protein, 475 aa, Enterobacter cloacae
GVMMITYQFINALSDAKPQSHLIARADSSLLPDSALIAEMRQQSTVADARFGCAPFARITLLPDALWHDALTEGLITALRPLLTAPASAELVLDVTDIDDVVLAQVLRFLFNQAHMLSDLKLKKTDEALRLTCITALCLPEQQAKLETTFRQQQAIALGMVAARRLADMPSDRCTPQFVVEEAQKLCAASPALRCEVLDEKQIVEQGLGLLHAVGKGATCPPRLLAIHYNGVSDGPVRCYVGKGITFDTGGLWLKEGAGMYTMKYDMCGAANVLGLMLTVAEQKLPVRIMGVLALAENAIGPDAMQPGTVATACNGITVEINNTDAEGRLVLADAIAWASQRHPQAHYIIDMATLTGAVVKALGYELSGLMTQDEPLRQALTLAGKRSGDEVWSLPLDARLRKQTDSAIADLCNTPTNNAAISASAAWLLHHFCPPTIPWAHLDISGTALWRENGRSVASGRPIPLLVEHLLGDL

SEQ ID NO: 10095 - protein, 346 aa, Enterobacter cloacae
AVTNKTSLSYKDAGVDIDAGNALVDRIKGVVKKTRRPEVMGGLGGFGALCALPQKYREPVLVSGTDGVGTKLRLAMDLKRHDTIGIDLVAMCVNDLVVQGAEPLFFLDYYATGKLDVDTAASVINGIAEGCLQSGCALVGGETAEMPGMYHGEDYDVAGFCVGVVEKSEIIDGSKVADGDVLVALASSGPHSNGYSLVRKILEVSGCDPLTTELDGKPLADHLLAPTRIYVKNVLELIENVDVHAIAHLTGGGFWENIPRVLPDNTQAVIDASSWQWPSVFNWLQTAGNVSEHEMYRTFNCGVGMVIALPASEADKAIKLLTEKGENAWKIGTIKASDSEQRVVIE

SEQ ID NO: 10096 - protein, 688 aa, Enterobacter cloacae
AVMGQEKLYIEKELSWLAFNERVLQEAADKTNPLIERMRFLGIYSNNLDEFYKVRFAELKRRIIISEEQGLNSHSRHLLGKIQSRVMKADQEFDGLYNELLLEMARNQIFLINERQLSANQQNWLRHYFKHYLRQHITPILINRETDLVQFLKDDYTYLAVEIIRGETINYALLEIPSDKVPRFVNLPPETPRRRKPMILLDNILRYCLDDIFKGFFDYDALNAYSMKMTRDAEYDLVHEMEASLMELMSSSLKQRLTAEPVRFVYQRDMPDAMVEMLRDKLTISRYDSIIPGGRYHNFKDFIGFPNVGKANLVNKPLPRLRHIWFDKFRNGFDAIRERDVLLYYPYHTFEHVLELLRQASFDPNVLAIKINIYRVAKDSRIIDAMIHAAHNGKKVTVVVELQARFDEEANIHWARRLTEAGVHVIFSAPGLKIHAKLFLISRKEGDEVVRYAHIGTGNFNEKTARIYTDYSLLTADARITNEVRRVFNFIENPYRPVSFDYLLVSPQNSRRLLYDMIDKEIANAQNGLSSGITLKLNNLVDKGLVDRLYAASSSGVPVNLLIRGMCSLIPELEGISDNIRVISIVDRYLEHDRVYIFDNAGDKRVYLSSADWMTRNIDYRIEVAAPLLDPRLKQRILDIIEILFSDTVKARYIDKELSNRYVPRGNRRKVRSQLAIYDYIKSLEQPD

SEQ ID NO: 10097 - protein, 513 aa, Enterobacter cloacae
PMPINDNTPRPQEFAAVDLGSNSFHMVIAREVDGAMQIIGRLKQRVHLADGLDARNMLSEEAMERGLNCLSLFAERLQGFSPSSVCIVGTHTLRQALNAPEFLKRAEKVIPYPIEIISGNEEARLIFMGVEHTQPEKGRKLVIDIGGGSTELVIGEDFEPRLVESRRMGCVSFAQMYFPGGVITRENFQRARMAAVQKLENLAWQYRIQGWNVALGASGSIKAAHEVLLAMGEKDGFITPERLVKLTEEVLKHKSFDALSLPGLSDERKAVFVPGLAILCGVFDALAIKELRLSDGALREGVLYEMEGRFRHQDIRSRTAQSLANQYNIDREQAKRVLETTVQMYEQWEEQNPKLAHPQLAALLKWAAMLHEVGLNINHSGMHRHSAYILQNSDLPGFNQEQQTMMATLVRYHRKAIKLDDLPRFTLFKKKQFLPLIQLLRLGVLLNNQRQATTTPPTLKLKTDDYHWTLSFPHDWFSQNALVLLDLEKEQQYWEAVTGWLLKIEEESSEAAA

SEQ ID NO: 10098 - protein, 74 aa, Enterobacter cloacae
PYRPKGYTQEKKVSQATRMRKRHRFNTRMTRIILLISFLFFFGRFVYSSIGAWYHHQDKIQSQQSGLVVDSPER

SEQ ID NO: 10099 - protein, 411 aa, Enterobacter cloacae
KIMETPALPRRLALTAGCNQLINWGISFYMPGTFAHAITADRSWSSPEIYLGLTLAMLVMAIVSPFVAPLLARFGGQRVVMSGTLLIAVSCLSMAFTPTLSGWYGAWLLTGIGMRLSLYDALFSALVDLYGPQARRTISRVTLAGGLASAVFWPLGDALLNVMGWQDALKIYALFGLLSALLLRRFPRQRFTVKPKACTQVSPHDRRNGWLYATFIALITFVSNGTSTHLPEFIASFGLPVAVGMLWGMGQTGARLMEVLAGARLTPLKLTLFTALAMPLCFLIGLSSDMLAWCAAGFVFGFGAINGLVTIVKATLPLELFSTERYASRTGLLLIPGQLMAAASPFAYAWLNKSLGITGGMWVSAGLTLVIAGFAVALVRSPGKQTVSHCIPSATLTNRYKTPAEANIPDT

SEQ ID NO: 10100 - protein, 468 aa, Enterobacter cloacae
YRTRSEGGRLMRNFWHHLRLPTLVRRMLVAQMLLLTLLWCLFLTFILLEDLRSPPILTGSETYETVFSLVESMDDRPQARDAVLAAFSKALREGYGGGEYPELSINLIVRKNNEIIFSSDGAPTGVKNSRLGVMQHVQSEDHTWTSRTLKSAHSDVEVTLFTPAGSWNFFIYLNSRGYYVMPLMICIPFLLFPAWLSIRIAMRPWNKVVDEISLRTPDDLSPLKAVPRHRELRQTVDAINDFLARVQESAEREKMFIADAAHELRTPLAAMRINVEALQSWVISESQQELLAGIVRSNSRAARLINQLLLMMHSEAHISPVPLTTLIQERMAALEPLASGRRIEFEFFADDEIHVAGIRERLVSLIDNLIENAVKYSPEGGRIEVQLQSRDKCAQLRVSDAGPGIPIELRERVFDRFFRDPNQTQSGSGLGLAIVKAVTQQHNGRVNLSTSAEGGLMVTVDFPNPAFA

SEQ ID NO: 10101 - protein, 107 aa, Enterobacter cloacae
KRVTFKCNKQRCFLMRGVGGSKMNTGAFIHDLLDWIDNNLDSRLDIETVSRRAGYSKWHLQRLFKEHTGSPLAEYIRAQKLQKSVERLAHSHEPILYVDLTTGKRSA

SEQ ID NO: 10102 - protein, 302 aa, Enterobacter cloacae
HQDPNFYNSGRMSTFKPLKALTSRRQVLKAGLAALTLTGIAKQAQAKDESTLKTSNGHSKPKTKKAGAKRLVMLDPGHGGIDTGAIGRNGSKEKHVVLAIAKNVRAILRSNGIDARLTRTGDTFIPLYDRVEIAHKHGADLFMSIHADGFTNPSAAGASVFALSNRGASSAMAKYLSDRENRADEVAGKKATDKDHLLQQVLFDLVQTDTIKNSLTLGSHILKRIKPVHRLHSKSTEQAAFVVLKSPSIPSVLVETSFITNPEEERLLGTTAFRQKIANAIASGVISYFNWFDNQKAHSRKR

SEQ ID NO: 10103 - protein, 663 aa, Enterobacter cloacae
TMSRKELANAIRALSMDAVQKANSGHPGAPMGMADIAEVLWNDFLKHNPTDPTWYDRDRFILSNGHASMLLYSLLHLSGYDLPLEELKNFRQLHSKTPGHPEIGYTPGVETTTGPLGQGLANAVGLAIAERTLAAQFNQPDHEIVDHYTYVFMGDGCLMEGISHEVCSLAGTLGLGKLIGFYDHNGISIDGETEGWFTDDTAKRFEAYHWHVVHEIDGHDPEAVKKAIQEAQSVKDKPSLIICRTTIGFGSPNKAGKEEAHGAALGEEEVALTRQKLGWKHPAFEIPKEIYKAWDARETGEKAQQAWNEKFAAYKKAYPDLAAEFTRRMSGGLPEDWEEKTQALIENLQSNPAKIATRKASQNTLNAIGPILPELLGGSADLAPSNLTIWSGSKSLKEDIAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQIERTPEQVKNIARGGYILKDSGGKPDVILIATGSEVEITVKAAEKLTAEGHAVRVVSLPSTDIFDAQDEAYRESVLPSNVAARVAVEAGIADYWYKYVGLKGAIVGMKGYGESAPADKLFPYFGFTVENVVEKALSVL

SEQ ID NO: 10104 - protein, 564 aa, Enterobacter cloacae
VTVKRPVSGSLARAFFSMIVLSVLISAIALVTLASSQRDAEAINIAGSLRMQSYRLGYEMQRASPSLAEHRAVWQKTLSAPALQKLNRWYVPEDVKQRYQQLHLGWQEMDTRIASGDTGWYQNHIEDFVGRIDAFVLALQHYTEHKIQLVICMSLTGGLGILLLAVVTLRRIRRQVVLPLNNLVAASERIEQGQFDTPAPDTTLPNELGQLSRAFNHMSAELHTLYRSLEHSVAEKTRHLNEAHQQLEMLFKCSQALNTGQIDSHCFRHILQIVHDYTQMNYLQLRTSDDWQLYEGLETPGEKMHNLPVLMQDTLYGELRWQSATGDVPLPLMESVATMLGRGLYFNQAQKHYQQLLLMEERATIARELHDSLAQVLSYLRIQLTLLKHAVPGDNAPAQAIITDFSRELNNAWHQLRELLTTFRLTLNHANLPAALQESLDGLQSQTSAKLVLDCRLSSLALDAQKQVHLLQIVREAVLNAIKHADASEIVVSCVTTADGTHTVTIRDNGIGIGDASEPPGHYGLNIMRERAGRLGGTLHFSQPPQGGTQVSVTFRTPAAQAEK

SEQ ID NO: 10105 - protein, 1046 aa, Enterobacter cloacae
RAAKRGHTLMANFFIDRPIFAWVLAILLCLTGVLAITSLPVEQYPDLAPPNVRITANYPGASAQTLENTVTQVIEQNMTGLDNLMYMSSQSSATGQATVTLSFTAGTDPDEAVQQVQNQLQSALRKLPQAVQNQGVTVRKTGDTNILTIAFVSTDGSMDKQDIADYVASNIQDPLSRINGVGDIDAYGSQYSMRIWLDPNKLNSVQMTAKDVTDAIESQNAQIAVGQLGGTPSVDNQALNATINSQSLLQTPDQFRNITLRVNQDGSEVRLGDVATVEMGAEKYDYLSRFNGNAASGLGVKLASGANEMATAQRVLERLDELSHYFPHGLEYKVAYETTSFVKASIEDVVKTLLEAIALVFLVMYLFLQNFRATLIPTIAVPVVLLGTFAVLYAFGYSINTLTMFAMVLAIGLLVDDAIVVVENVERIMSEEGLSPREATRKSMGQIQGALVGIAMVLSAVFIPMAFFGGTTGAIYRQFSITIVSAMVLSVLVAMILTPALCATLLKPLHKGEHHGQKGFFGWFNRMFNRNAARYEAGVGKVLHRSVRWMVVYVLLLGGMVFLFLRLPTSFLPLEDRGMFITSVQLPSGSTQQQTLKVVQKVENYFHTQEKDNVVSVFSTVGSGPGGNGQNVARMFVRLKDWDQRDSDTGSSFAIIERATKAFNKIKEARVFASSPPAISGLGSSAGFDMELQDHAGAGHDALMAARDKLLELAGKDPQLTRVRHNGLDDSPQLQVDIDQRKAQALGVSIDDINDTLQTAWGSSYVNDFMDRGRVKKVYVQSAAKYRMLPDDINRWYVRNNTGGMVPFSAFATSRWETGSPRLERYNGYSALEIVGEAAPGVSTGTAMDIMEKLVQQLPTGFGLEWTAMSYQERLSGAQAPALYALSLLVVFLCLAALYESWSVPFSVMLVVPLGVIGALLATWMRGLENDVYFQVGLLTVIGLSAKNAILIVEFANEMNAKGHELMAATLHACRQRLRPILMTSLAFVFGVLPMATSSGAGSSSQHAVGTGVMGGMISATILAIYFVPLFFVLIRRRFPLKDKPE

SEQ ID NO: 10106 - protein, 157 aa, Enterobacter cloacae
VMNPLKAGDIAPKFSLPDQDGEQVNLTDFQGQRVLVYFYPKAMTPGCTVQACGLRDNMDELKKVGVEVLGISTDKPEKLSRFAEKELLNFTLLSDEDHQVCEQFGVWGEKSFMGKTYDGIHRISFLIGADGKVEHVFDDFKTSNHHDVVLKWLKENA

SEQ ID NO: 10107 - protein, 543 aa, Enterobacter cloacae
LSQKRLSFLFHCQVSQNPDEWDFLHLLTRLHSQSSGDERYAGSSVKLAHPKYRTVVMFRQLRKTLVATLIAAVTVGQVLPAFADSSDSLPDMGTTAGSTLSIGQEMQMGDYYVRQLRGSAPLINDPLLVQYINGLGMRLVAHADSVKTPFHFYLINNDEINAFAFFGGNVVLHSALFRYSDNESQLASVMAHEISHVTQRHLARAMEDQKRNAPLTWVGALGSILLAMASPQAGMAALTGTLAGTRQGMISFTQQNEQEADRIGIQVLQRSGFDPQAMPSFLEKLLDQARYSSRPPEILLTHPLPESRLSDARNRANQMRPVVVQSSQDFYMAKVRTLGMYNSGRNQLTSDLLDALAKGNVREKNAAQYGQALQAMEASKYDEARKALQPLLASAPDNPWYLDLATDIDLGQKKATDAINRLKGAKDIRNNPVLQLNLANAYLQGGQPGEAVTILNRYTFNNKDDQNGWELLAQAQGQLGNRDQELAARAEGLALAGRLEQAISLLSSASSQVKLGSLQQARYDARIDQLRGLQQRFKPYEKM

SEQ ID NO: 10108 - protein, 468 aa, Enterobacter cloacae
PISPFARRASLIIHRHNINNTSQSCTEFTMNNVLGFLEAKLMPLAAKTAQQRHLGAIRGAYVSFMPFIIVGSILLVISSFPNQAYQQFMSQAFGESWSAIIEIPFNAVFSTMSLFISFLVAYRLAEHYGEDRISCGILALVAFLILTPFIKVAENGGITVMPVEWIGSKGLFVAMIGSLLWTELFCWLKRKKLVIKMPDGVPPAVQESFAALIPALLVMILVLLIRIIFENTHYHTIHQFIYEVVATPVRHYGTSYFGALMTVFSITILWSVGINSGSMINGIIRPLWMENQTDNIAAIQAGTTPPHIITEQFFDMIWMGGAGATLSLVIAMLIFARSKNMREVARLGAGASVFNINEPILFGLPVIMNPIMLIPFNLVPLVLVTVQYAAMKIGAVAVTTGVFIPWTLPPVISGFIVTGHLSGSVMQLINLLIGAMLYLPFMRILDKQYRAAEIASVTQTDTTLAKQE

SEQ ID NO: 10109 - protein, 319 aa, Enterobacter cloacae
SMWGIIATWRMALEGVTESASALAAGKPVAAAVVDAVAAVEDFPLYKSVGYGGLPTENGEVELDAAYMDGDTLAFGAVGNLVDIANPVRVAHALSRQRYNSLLVGQGAREWALSQGFADKTMLTDRAMQHYRKRCRETLDKGLSPYDGHDTVGIIGLDKQGSMSVATSTSGLFMKKRGRLGDSPIIGSGFYCDSETGAATATGVGEDLMKGCTSYEIVRRMAQGMTPQQAADSVVFELEDKLMSRFGRAGDLSVVCMNSKGEFGAATNIKTFSFVVATARQPLTVFRTERLREKTHYHAVDDEWMQAYAARIRAPIEEL

SEQ ID NO: 10110 - protein, 242 aa, Enterobacter cloacae
YRFFFSCSSCTVDTVTNVKILLIEDDLDLGNGVRIALADQGFDVIWVRRKEDALHQLGICVPELILLDLGLPDGDGMSLMTRLRQQLKGVPVIILTARGTLQDRLCGLDAGADDYLVKPFVLAELLARVRALARRSYGFENEAIEIRGLSLHIPTRRVTVSARHVELTASEYALLETLMLRADRVLTRRYLEERLFGTKENLSNALDVHMGNLRRKIGDGFVRTVRGVGYVIDTVPVQKAAG

SEQ ID NO: 10111 - protein, 332 aa, Enterobacter cloacae
ISPRFSAFISLTSLIMGISFLDSREQGRLSSFIRHKDLQKMNNHFRCIGIVGHPRHPTALTTHEMLYRWLCGKGYEVMVEQQIAQELQLKSVRTGTLAEIGQQADLAVVVGGDGNMLGAARTLARYDIKVIGVNRGNLGFLTDLDPDNAQQQLADVLEGHYISEKRFLLEAQVCQQDCQKRISTAINEVVLHPGKVAHMIEFEVYIDEIFAFSQRSDGLIISTPTGSTAYSLSAGGPILTPSLDAITLVPMFPHTLSARPLVINGDSTIRLRFSHRRSDLEISCDSQIALPIQEGEDVLIRRCDYHLNLIHPKDYSYFNTLSSKLGWSKKLF

SEQ ID NO: 10112 - protein, 429 aa, Enterobacter cloacae
TSSLTGYNPLILKRFKTMFQALLRRREARLFFIISILFFICIHSIDAFLAPMMINQGIEPQIMGIIMGASGLATLLIRFPLGIISDVVKSRRIFIQIGLLLPIIAWPIAWLEPNAITLYLAKAADGVTAATWVLYNILFMRYFGRNEAPAAVALLALAGPIGVFLGNCIGAVLIHYFANNIAFFVSCISALVALILTTRIQDVHDPVQAPTLKACITGARQQLADRSVWLIGILATVVILVPFATRDTLTPVYAEQLGARAGILALLGNIHLLFYGLAIALCSSVFYQRLGLVKTAVLGIVLQVISTFGIPFTSNMYVIYLWQALAGFSFGMAFAAFMSLSVVNTSSDEQSTRMGLFQTIYSCGMFVGPVMMGVMMQHINLSSGYILIAALSVVAAIATPLSARWVYARKTQTSAQLLKNGAYAAAPDQ

SEQ ID NO: 10113 - protein, 460 aa, Enterobacter cloacae
IPFPGSPGGQLTSEKSKEKRVSWKLKTGKSTEERQQANQQIRETVEQILADIEKRGNKAIRELSIKFDRYDRQDYRLTSAEIDRCIKQLSRQDIQDIEFAQQQVANFARAQKECLRDLEIETRPGVILGHKNIPINAVGCYVPGGKYPLLASAHMSIITASVAGCSRIISCAPPFNGQPAPAIVAAQKMAGATEIYALGGIQAIGAMALGTDSLAPVDMLVGPGNAFVAEAKRQLFGRVGIDLFAGPTETLVIADDTVDAEMCATDLLGQAEHGVTTPAILLTNSLQLAKETLSEVERLLEKLPTADIARQSWQDYGEIIVCDSHEEMLLEADRIASEHVQVMTDRDDWFLANLTNYGALFLGPRTNVAYGDKVIGTNHTLPTQKAARYTGGLWVGKFMKTCTFQKVLSDEATAEIGSYCSRLSLLEGFAGHAEQANIRVRRYGQTEVPYATPAPVREKV

SEQ ID NO: 10114 - protein, 255 aa, Enterobacter cloacae
AMTLLQTPSFTLHGKRALVTGGSRGIGFAAAVALAQAGAEVWIAARGREALAHAAGLAAEHSLAFHPLELDITDAQEVERVLATLPTPDILVNSAGLARHQPFLEVNEENFDAVMALNLRATFFISQHVARRMRAGGKGGSIIHISSQMGHVGGPERSVYCASKFALEGLTRTMALELGDAGIRVNTLCPTFIETDLTRSSLADPAFRRYVLDNIKLRRPGRLEDIMGPVVFLASDAAGLITGSALMVDGGWTAT

SEQ ID NO: 10115 - protein, 306 aa, Enterobacter cloacae
TMKIDLNLLPLFLAVAEERSFSAAAGRLGITRSAVSQGIRRLEDGFQTLLVMRTTRSVRLTEAGERLHKSLLGPIANIEAAFDDVTSDSMPRGQLRIAVTSIAEAFLSGPLLASFTAAHPAVSLDVFVSDEEFDIVAAGYDAGVRLGEVIEKDMIAIPLTGQQRERVVASPSYLATHSAPAHPRELVAHRCIGWRPSPDVAPYRWEFEEAGVPFDVAIEPQITTNDLRLMLSLALAGGGITFATEDTFTPYIESGQLVSLLDAFLPSFPGFYLYFPQRHNMAPKLRALIEHIRQWRQLPATQPTQR

SEQ ID NO: 10116 - protein, 102 aa, Enterobacter cloacae
TGSIRSPSSRAMRPVTPAHHQPALPLPSIPPRHQRPPLTPSPITWGPCSFRLTAGTPPTTRCRSCREPHRTAPPSRSMTEPPCSARRCSTAAAAGALRQPRR

SEQ ID NO: 10117 - protein, 78 aa, Enterobacter cloacae
PVAPKRAAPSPSVWRTIQRSPPRQTATDPGATPSSINRRKARRCKSPPPMRQGTSRCPAQPLRRWCRSLPAPTLKSWR

SEQ ID NO: 10118 - protein, 470 aa, Enterobacter cloacae
GQDMGKKMPYWWLSCCLISVPAIAANPAAMINTGQLSETQELPSLNGRVAPVASKAAPGTLQLNEAVNRAVTWHPAISEAVGKLYQQSENVDVAKSKYYPQINAGMDNGYSHDGDDNGFTPSLVLSLSQMLYDFGKVASQVRAENAGVAQQQANVLVSIDTIAHDTAIAMVQVQTWQQMVETAKEQLDALSSIGTLTKQRNDEGATSLSDVVQTDARIEGARAQLMQYQASLDSSRATLMSLLGWDSLNAVSNDFPQSLARSCDIAEPDDRLVPSVLAAWAQANVAQANLDYANAQMTPTVSLEPEVRHYLNDRYAGNETRDRTQYSAWVKVQMPLYQGGGLTARRNAAGHAVESAQSTIQRTRLEVRQKLLEARSQVMSLMSTLQIQGRQEALSARTRELYQQQYLDLGSRPLLDVLNAEQEVYQARFTQQQTAGQLHQLQLNCLYNTGRLRHAFDLENRTIQTVEIQP

SEQ ID NO: 10119 - protein, 113 aa, Enterobacter cloacae
RRPKRGWTALCSCRPRTSAKRHRSARTCCAATIFSSRRSSAITRKIPAWRCALTAWRSKRAKKWRSSGATARANQPCCRRWRAGWIWRAVNCGSTTSACRIWTWLTCGETSAL

SEQ ID NO: 10120 - protein, 416 aa, Enterobacter cloacae
TTAVCSNSSRQPDGSGKMKISQRDVAAVEDLDNALDSESGYTGARRIVFFSLVMFVVLGVWAWFGVLDEVSTGTGKVIPSSREQVLQSLDGGILTELNVHEGDQVQAGQVLARLDPTRSESNVGESAARYRASLASSARLYAEVNDLPLKFPPSLEKWTDLTAAETRLYNSRRAQLEDTQRELRSALALANKELAITQRLVKTGAASHVEVLRLQRQKSDLELKLTDVRSQYYVQAREALSKANAEVDMVSAILKGREDSVTRLTVKSPVRGIVKNIKVTTIGGVIPPNGELMEIVPVDDHLLIETRLSPRDIAFIHPNQEALVKITAYDYAIYGGLHGVVETISPDTIQDEAKPEVFYYRVFIRTSQDYLVNKAGRHFSIVPGMIATVDIKTGEKTVLDYMIKPFNRAKEALRER

SEQ ID NO: 10121 - protein, 593 aa, Enterobacter cloacae
APSSAGQKNCSDFASSTLLYIKPVYTVYKHSYGFSYRKTIMLAQLTISNFAIVRELEIDFHSGMTAITGETGAGKSIAIDALGLCLGGRAEGDMVRTGAARADLCARFSLKDTPAALRWLEANQLEDGRECLLRRVISSDGRSRGFINGTAVPLSQLRELGQLLIQIHGQHAHQQLIKPEQQKALLDGYAGEYALTQLMAEHYRQWHQSCRELAQHQQQSQERTARAELLEYQLKELNEFNPQAGEFEQIDEEYKRLANSGQLLSTSQNALNMLADGEDVNLQSQLYNVRQLVTELTGMDNKLSGVLEMLEEAAIQISEAGDELRHYCERLDLDPNRLFELEQRISRQISLARKHHVTPEELPNYYQSLLEEQQQLDDQADSLETLSLAVNLHHQQALETAKRLHDVRQHYAQELSQHITDSMHTLAMPHGVFTIDVRFEENHLTAEGADRVEFRVTTNPGQPLQAISKVASGGELSRIALAIQVITARKMETPALIFDEVDVGISGPTAAVVGKLLRQLGESTQVMCVTHLPQVAGCGHHHFIVSKETDGEMTETHMKPLDKRSRLQELARLLGGSEVTRNTLANAKELLAA

SEQ ID NO: 10122 - protein, 125 aa, Enterobacter cloacae
AAYCSGPKRNQITMRCKTLTAAAAVLLMLTAGCSTLEKVVYRPDINQGNYLTPNDVSKIRVGMTQQQVAYALGTPMMSDPFGTNTWFYVFRQQPGHEDVTQQTLTLTFSSAGVLTNIDNKPALTK

SEQ ID NO: 10123 - protein, 277 aa, Enterobacter cloacae
DRAAAASVDNGVHTVRKNSLKTAFLENTPIVNGWLAIPSGYSAEIMGHQGYDAVTVDLQHGMIDFASALSMLQALSATPAVPLVRVADNDPAQIMRVLDAGAYGVICPMISSAEQARRFVAACRYPPLGVRSFGPARGLLYGGSDYPQHANDEILTLAMIETRQGLADLDAILDTEGLDGVFIGPNDLSLTLTGSASAESQHPEMLAAIERVIHCCRQQQKIAGIFCTSGAAAAARIAQGFQFVTPANDVMQLGRASREAIALARGNAIPTTGASGY

SEQ ID NO: 10124 - protein, 649 aa, Enterobacter cloacae
PLWNYFLRHLHLLYFLFTDVIFRFALPVSNGSVINNYRGNRISFSMDFYFTRFEHRQPPEPLKTPRWVMLTWQVLAVASLILGANYIYWRWTASLNTDALWYAIPLVLAETLAWIGTVLFTINLWKEDDPPQNPPPIEINDCLRSEDAEASRPIKVDLFIATYSEDVELVRLSIRDAMKMDYPGPLDYKVHVLDDGRRPEMKAVCDQEGANYISRQTNIGFKAGNLRNGLEQTDGDFLIICDADTRVFPTLLSHTLGYFRDPDVAWVQTPQWFFDLPEGENLARWLGRKAGKTGYGLGWLAQKFIGPVTIGRDPFFNDPRMFYDVILRRRNWANAAFCCGAASIHRREAVMQAALRSYVWTTEEEIDRHTRDIRDPVMRETLQDAMRPHVAFDTELTPYKFHVSEDIYTSILLHGDAARRWRSVMHPRIESKMLSPQDMLTWMIQRFKYAAGSLDILFHDNIFSRRRFKLSLPQTLMYATTFWSYLACVWNTVFLISPIVYLFTGIPPVSAWSEPFYLHFLPFFIVSELAFMFGTWGISAWDGRASYLSFFSMNLRALNTVLRGEQIKFHVTPKERQTGRFLYLVKPQIAIVVLTLAGLIWGGIQVARGQVDDPSGYVINIFWGAVNIAAMLPLIFAAMWTPAEEEVSE

SEQ ID NO: 10125 - protein, 908 aa, Enterobacter cloacae
VTMRATSRFDLNALPVGVMIYDPAEHLLAWNDQISRFYPVIAPWLIAGASLESLAEKFIDAGYNIDSTRRRTLREAIVRNCRQSSHREVRQSGNRRLYVQHQRLADGGILSLHTDITELDDAQRSRQQLHDDFLLTAESIQIGIWNWQVSHDSLEVNDTLLAMVGQSRTQLHYPLRFLLNLVHEEDRAVLRNAMIASRQEHMPVFESEIRVQHATQGWRWMLVSGQVVTLSMQQQAERVIGTLQDITRRKEAELLAIEAAKVAREANEAKSAFLANMSHEIRTPMNGILGMTQLCLDTQLTPEQREYLSLVMSSAQSLLHIINDILDFSRIESGKMTVDTEPLEIRPFVQSLIRPHMPSASEKGIELLVDIAPGVPEVLIVDGPRLRQILTNLLGNALKFTHHGEVMLAIEPTESEGHWRFRIRDSGIGIPMEKQKAIFEAFSQADSSTTRRYGGTGLGLTISARLVSLMGGELTVQSEPGEGSEFAFTLPLEGQLAVSATDAPVARFNGESVLVVDDNSTNLRLLDTMLRQMGLTPTCVNNAGEALSLTAKRGYWPLILLDAQMPDMDGVSLAIELSVMPQAEQSHIIMLSSMSRHFDANMLKRIGVAHYLHKPVAQRELYQTIASVLAPAPLASPTAVPASALVTAPVTAPVTAQASLRILLAEDNLVNQKVARRLLEQLGHRCEVVSNGREALERWREQSWDLMLVDLQMPEMDGETAIRLLREETLTRGRSHQPAIAMTAHAMQGDKARCLAMGFDGYIAKPVSQEALREEIAHVLAGEDKGLPDEAQLLKQCADDPELVNELLALFGNGLDEAVAAMALNIAHNDRDALRRAAHKLRGEAVTLGFIRLSEVLQQLESQAVSLNQTGLSVLHGELIEEARRSAAWLRRRAQEVKDDQASSAAGN

SEQ ID NO: 10126 - protein, 155 aa, Enterobacter cloacae
AMNAGYPTMLLIPGMSAFQRVNEPAPGLAGRMFFQVHCPHGKTGPNVGLHLHVQRNPFSRCEIFLDHWQRHITPPSVELAPQFNIRVTSLQPGAVESELFEHISDKNYRAQMEQLKEKMTFLKADDVADSIPYVLQAPEHVNVAELFIMPPEQPW

SEQ ID NO: 10127 - protein, 128 aa, Enterobacter cloacae
YYSQTKRTCAQCRSALLSTQLQGLELTSIMINHFRDQWLEDFFLYGRSSNVIPLNLETALARKLDIINAAMSHLDLRSPPGNMYEALSPPLKGYSSIRVNRQYRLVFRWSEGKADDLYLSPHKYTQHK

SEQ ID NO: 10128 - protein, 91 aa, Enterobacter cloacae
RPMPRSACASAPAPCQRQCLSPAPANRRRSPCPACRLPCRTSAGGCRPRRRSPAPLQERSPLQSGRRNRQWRSGRERAKNGHAPPTPARPA

SEQ ID NO: 10129 - protein, 307 aa, Enterobacter cloacae
AMSAQDRQTLSLPSLRNLQAFIAVANALSIHQAAEQLNVTPSAVSHQIASLESWLGKKLFIRSGKGVQLTPTGEQYLREVSAAMSAIGRATDQIVKEKDNAVLRVHSSPTFGLSWLLRRLGRFRAEYPDITINLTCSYENLQFARDNIDIDIRHGIPDWDAYRVMTIKNDTLVVLASPDYAEEHPISTPADLLQQSLISSTSTLVNWEKWFAWHNIDRPWLNFSLSFDRSYMSFEAARMGLGFILESKMMATDHLKDGSLVQVLPDEMGIAINAHHLVMPHMNERAWKIQQFVEWIDRELRLSGYHL

SEQ ID NO: 10130 - protein, 296 aa, Enterobacter cloacae
KVRSGALTPALSHRERGINRGIQHMLHHKHPAHHQVGRDKHQGTALGKAHHRGVDHAKQRQQRASCGGDGPAQRFVEDGEDGDTAPEHAGERRAVAEMHQAFVVDTLAVQHVGADFRRAGPRGAHHAVHHGQRPVGDPREQADEDNGHLHFRGFPHHLVGGDDADKHQNRHDGGHRYDGEHKGPQPEQRHDEHGHAGRQGVADAGAHRFPARMADVDRDRERIAHQAAEHRGQTVRQHYLAGRVFIPCRVGAFDVLQVKDVVRQPQRYGGRQIRQRVRQPLHKAVHVHFRRVKAEG

SEQ ID NO: 10131 - protein, 327 aa, Enterobacter cloacae
CNASVKICSKLMVTRSHNMNSIFTEENLLAFTTAARFGSFSKAAAELGVTTSAISYTIKRMETGLDVVLFVRNTRSIELTESGFYFYRKATDLLNDFHAIKRGIDTISQGIETRVRICINQLLYTPRHTARLLQVLKKQFPTCQITVTTEVYNGVWDSIINNQANIAIGAPDTLLDGGGIDYTEIGAIRWVFAIAPTHPLAFAPEPISESQLRLYPNIMVEDTAHTINKKVGWLLHGQEAILVPDFNTKCQCQILGEGIGFLPEYMTREAVEDGLLVTRRINNPRQDSRMLLATQHAATGQVTRWIKQQFGPEGVLTRIYSDLLWRT

SEQ ID NO: 10132 - protein, 170 aa, Enterobacter cloacae
NQITDGFTTLMTKKKAHKPGSATIALNKRARHEYFIEEEFEAGLALQGWEVKSLRAGKANIGDSYVILKDGEAFLFGANFTPLTVASSHYVCDPTRTRKLLLNKRELESLYGRINREGFTVVALSLYWKNAWCKVKIGVAKGKKQHDKRTDLKAREWQLDKARIMKNAGR

SEQ ID NO: 10133 - protein, 195 aa, Enterobacter cloacae
MGPTTKGPKIEGPKMAKIAKKLTDTEIKSTKPADKEINLFDGDGLILRIAPLTKGGKKNWYFRYAVPVSKKRTKMSLGTYPHLTLARARTLRDEYLSLLANGIDPQVHNSNKANALKNATEHTLQAVARKWLDEKVKTSGISQDHAEDIWRSLERNIFPGLGNVPVNEIRPKLLKQHLDPIEQRGVLETESPRII

SEQ ID NO: 10134 - protein, 257 aa, Enterobacter cloacae
RRLDGYVRDAMEYPLLDNTDLPLVLLGGTLCNVRLWQPVIERLNISAVLCITLTGAESAPQASRRLLKVLPPRFLLAGFSLGAIVALQMAADAPERVNGLTLISVNPLPVAPDTLASRREAVHTAQAHGLADWLVSSLWQSYVAPSRLSDRILQETICRMAQECGIETFAGQTEMAIHRQDNRTAFNALACPTLLLNGAQDVICTPHHHQLLAAGNANVTRHTVEAGGHFIPLETPDEIAPLLRQWITECIQCAKTV

SEQ ID NO: 10135 - protein, 101 aa, Enterobacter cloacae
RHVVGFSTSLFISTGAIWLMGRRVLHAKKFLVFYLDSVNKSIWQFLITLQILLSVVNSYFSACKQSSFNLSGIISSAIYTYFTFCLRTLFSVLRSLSVTGL

SEQ ID NO: 10136 - protein, 758 aa, Enterobacter cloacae
AFYMASLSRRPDALRPGCAAEHRRLKMIRLLLLLAISPLLAQASQPVTWSLAGMWRVHDANLSTFDGASAPDRDWRSIAVPANWYSAGYDHQGALWYRHEFTLPRRAPDTMATLVFDGVDYFADVTLNGRHLAHHEGYFQRFSVDISDALQRHNKLAVRVDSPWEDPKTIWPLHKTMVKGVLNQHDTRPGGAWSEDGQDANSGGIWSPVKLHLSRGVTIDEVILRPDWREGLSKPALHAEIRYRALSAGDVTLRLSATPDNFTGPPVKQEFPVNLARTDGKPQSLRVTLPMQGARLWWPVGYGRPNLYRVRATLTDKQGVMDTAVARTGLRKIVKQPDNKGWLFNDKRLFIKGSNYIGSPWLSTMTRKKYRRDFRLVQAMNANAIRVHSHVAGRALYDVADEMGLMIWQDVPLQWGYNNSDAFADNAVRQTREMVEQFGNSPAIIVWGGHNEPPWNSPWMEKRFPDWNKNLNQTLTKRVGDALSQDTSRIVHRFSAVEEHYWAGWYFGTMRDLLGPAKTAIITEFGAQALPRLSTLKTIIPARLMWPKSTAADDPGWTHWKYHNFQPFQTFKFANIPRGNTIQEMIANTQRYQAELVAMAAESYRRQRYQPVTALFHFMFVETWPSINWGVVDYLRKPKAGYYALQKAYQPILPSIEPVTAVWRQGSEATVRLWAINDTWSACEACRLKWQVKQNGRVLAKGNTSLTLPPDSGSRIKDITVTPTTRHNVTIEYEISDRAGNTVGSNQRNERVESPPEQ

SEQ ID NO: 10137 - protein, 3838 aa, Enterobacter cloacae
TVFSPGARSSLQKRWLCFTRRNQSLSWSNNCMSQISVISKLTGVETTTEGTQITLDHSSIVKLNVDRADISGYSRSGNDLVITLNSGEVITLKNFYVTDAQGVSQLVLEESDGALWWIEDPTGAATYESIASTDALLAASGSDAGGAAAWPWVLGGLAAAGGIAIAAGTGGGGGGDDDNNSPNPGNPGNPSEPDTTPPDAPTNLQVSPDGKTVTGTAEPGSTITLKDADGNTIGTGKAGSDGKFTIDLGTPLTNGEQITATATDPSGNTSQGGQVTAPDLTAPDAPANLEVSPDGKTVTGTAEPGSTVTLKDADGNTIGTGKAGSDGKFTIDLGTPLTNGEQITATATDPSGNTSPGVQVTAPDLTAPDAPEIVTVNDNVGAETGPLSNGQRTDDARPTFSGISEAGTVITFYDNGKPIGTATADATGKWSFTPSTNLSEGNHAITTTATDAAGNTSPASTAVSFVVDTVAPGAPAIVSITDDVAPGTGTLGSGSSTNDPRPQLTGTAEAGSTITIYDNGIAIGTAIVGSNGSWSFTPSVNLSEGSHQLTVRATDVAGNTGPASPVFTVTVDVTAPQTPSGFIINDDTGVLKGAIGAGQFTDASEPRLTGRGEPGSTITVYDNGVVIGTTTVLPNGTWSITPTSPLAEGAHSITLRETDAAGNQSGLSQPINFTVDLTPPDMPVATLNSAGTQITGTAEPGSKIVITNNAGLQIGTATADSNGNYVVNLNPAQTNGEIISVVASDAAGNQSSPALVNAADITPPAAPGNLVVAEDGASVSGTAEPNSTIIIKAPDGTIIGQATAGPDGTFTIPISPAQTNGEALEVTATDGSGNTSPSGFADAPDSTPPLAPENVVISADGTTVTGTAEPGSTVTIRENGVKVGETVADDQGNFSVELIPPKANGEALTADATDTAGNTGPTAPFDAPDITAAQTPVITGVVDDAPGVTGPVSQNGLTNDNTPTINGTGEPGTTITLYSGTTVLGTALVSANGQWSITLQTALPDGGHVLTATAVDANNNLSGTSNTWSITVDTAAPGAPAITQVIDDVPGRTGALDTNETTNDTLPTLNGTGEPGSTVTIRLDGQDIGTAVVNSGGAWTFTPATPLVNGQHTFTVVASDAAGNASAPSAGFTLTVDTTPPPAATIDTVSDNVGPVQLPLNSGDTTDDTLPQLQGTAPDGTTITIYDGTTLLGTAVLDGSGGWSFTPTTPLTDGPHSLTVHATDEAGNTTISPPFELAINTTAPATPDIPEITVNPDGGTPGTALNPGETTRDTTPTLSGSGTPGDIVNIYDGATKIGEAEIDGDGNWSWTPDDPLPDGTYDLSLTVTNQDSAGNESAPSTPVTITIDTDAPAQPGTPTVTDSVSQITGPVLDGESTNDPRPVLSGTGTPNDVITIYDQVGTGEPQAVGSVTVDGNGNWSWRPESNIGEGTHEYTATATDEAGNESVPSAGITITVDTLAPDTPVISAIGGVQNGESTNDTTPGIGGTGTTGETVIIYNNGVEVARVEVVNNEWSYTLPTQTDGPLNITVAAVDDAGNVSPVSPVFTVEVDTQAPTVPQIDAVSDSQLTNSVLYTRDGTPTLTGIGEPGSSVTVSVDGVASPVVVEVQPNGTWSWTADPALTEGPHTFSVVASDAAGNTSASSGDLSVTVDTLPPATPTNMTIAAEGTPLTGTADDGTTVTVRDANGNIIGTGVATGGSFYIALSPAQLDAATLTLIATDPAGNASSSTTFDVPDSPLELPAVPVITAINDDVDPVTGDVKDKTTNDTTPTLTGTADPGSVIAIYQDGSLLPVTTVVADTNGNWSYTPLLPLTEGPHTFAVTATNTTTGATSGQSPVATVTVDLTAPTAPAIGAVTDDVGPITGPIADGQSTNDNRPTLTGTGTAGDTITVYDNGDPLGTVIVGPTGTWSYTPPVLDDGSHTLTVTATDPAGNESTPSAGITIVVDTVSTTPVITSVTDNAGNAATPVPSGDPTNDTTPTLTGTAEPNSVVAIFDGTTQIGTVAADGTGAWTFTPETALGEGTHDFTVRATDPQGNVSQPSNAWSVEIDLTAPQVPTIVTVSDNAPGGVTGPLTAGQVTNDTTPTLSGTGQAGTTIHVLNNGVEIGTTTVDGNGNWTFTPDPVLTDGTYNLRVNASDDVGNVSANSPVFAFTVDTTGPAAPVVTTVIDDVSPGTGIIASNGSTNDTRPTFNGTGEVGATVHVIVDDVEIGTAVVNAQGNWTFTPTTALGEGPHTITFNATDAAGNTGVTSPPFNLTVDTSVPDAPVFTPATDNAGPVLGPVASGQSTDDTTPTLNGTAAANATITIYENGQPVGTAVADANGVWSFTTGTLANGSHTWTATATDAAGNISPASPGFTLVVDTTVPAAPVITQAIDDVGTITGAIGSGQTTNDPLPRLVGTSEPLATVNIYEGTTLVGTGTADANGNWTVDITVPLGTGSHTFTAEATDQAGNTGAPSADFSLIIDTTPPALPVLTSVTDDVGNAATPVANGGLTNDARPTLTGTAEAGATVTIYDNGVQIGTAVATGGAWSFTPSTPLADGPHNLTFSATDAVGNASAQTGGYTINVDATAPVAPAITSIVDDVGTVTGPVTGTNPTNDTRPTLNGTAEANATVRIYDGTTLVGTVTADANGNWTLPQTSTTLIEGEHNFTATATDAAGNTSAPSPIITINVDLTPPAAPTGLAVITNGTQVTGTAEAGSTVTITSSTGTVLGTAVADGSGNFSATLTPPQTGGESLIVFATDKAGNAGITTSVIAPITTIPNAPVIANIDDNVGTVTGNLTNGKTTDDTTPTLSGTAQPNATITLYNNGVLMGTVTANASGNWSFTTPVLSEGPHAFTATASNGSGTSPISTSTTVIVDLTAPTAPTGTFNADGSVLTGSAEAGSTVTIRLADNSTVTATADSNGSWSYTFLNKQTEGQTLQITATDAAGNVSLPGSALAPVVPLSASTNVEELALTTTATVTNSQYSDYGFLLVGAVGNVLTLLGNDTAQVGFTVGNGGSADIAVNANATGAVLSLLNTLELVVQRFDAANNTWTTVVDTGQPQFADLLTLGATGVSLNLTGLADGQYRVLSYNTNLLATGSYTSLDVAVKETSAGTVSGETNIVGNVITDVDPTAGSDNAPAGTTVTAVTNAQGSTTSVTADGTVIQGQYGTLTINLDGSYTYNLTNTSAAVIGRTENFTYTITHNGTSASANLVLSLGEGTSSSGIVAVDDTASLTFDTTVEAINNGTSSQGGFTLVGINLGNTLGLNLLDDLANPIIYNVEEGTTRTMTVQASVGGVALASVFDLYIYKFNNATQTFEQMRVEPGWLRAPLLGGTSPQLTLNLPAGEYLFLLNTAAGITALTAYTLNVLQDHVYSVASVSESTTGDVLADDIAPAGTVVSDVNGVAVNSSGLTEITGEYGTLRINAAGEYTYTLNSGVGADHISTPDTFVYTITAPDGSKDTASLNITPTARPMDAVNDVSTAMDVTTVHHTAAYSDTTVGSASWNAALLASTQGSGSGTFVVDPNTALHNVVLSFNVASLLTLTGLTVDWTLSNGATTVRTGSFNGGLLLGGTATINLTGLDLEAGTYTLSYTGKMGPLGVGNITITPSVTGTSYSLSQFDATGTHTVDGNIFDGTDSAGAMDQLHSVDTRVSITGYDGVTTTLDPYTGSTMSNITGHYGTLAIAADGSYTYTLNPGISLSTITSKEVFNYTLTDANGVKDTASLTIDMAPKFVSSEHNDVISGTAYGDTLIYQVLNNTAGNATAGNSTGDHWTNFSLTQGDKIDIGDLLVGWNGSASTLGNYVSVSQSGNNTVISIDRDGTGAAYTKSTLVTLDNVQTTYDELVNQQHIIT

SEQ ID NO: 10138 - protein, 741 aa, Enterobacter cloacae
KPHHPDRGDPAMKQRDIPQGENMTDQALEQWAQAFGYVATRYRVACSPGSLVAGAPWLKGKPMVPALTQLAREAGLTFQLLTADQQSINSWRLPVVVELNDGKIGVIDNFDGEDTLEVSFFDDSTHTNRLSMSAMLPAIRHVIALRPLAALKDSRVDAYISKYRPDWLYRLVMRDLRPYSWVMLAALFINVLSLSGIVFSMQVYDRVIPAQSYPTLYVLTIGVLIATLFGFVLRVARGHIMDLLGKRSDLRVSDRVFGHALRLRHSAIPRSTGSFISQLRELEQIREMVTSSTISTIVDLPFFILFVIVLAIIAPQLAWIAPVAAVIMVLPGLLLQKKLAELAKQSAHESTLRNAVLVESVQGLEDIKLMQAENRFLQQWNSYIQITAESGLRTRELTQNLISWGMTIQSLVYAGVIVVGAPMVIDGTLTTGSVVAASMLASRMIAPMATLCGVLARWQQVKAAKEGLDSIMQLPTENQREETPIRQDVLRGHYLFEQAQFRYHPEDPRMALRINRLEIKAGEKVAILGRNGAGKSTLLQAMAGGMDLAGGELRLDNLSLPHLDVADVRRNVGFMTQNARLFYGTLRENITLGMPRATDKEIFEVLEMCGAASFVQKLPKGLDYPIMENGVGLSGGQRQSILLARMLLRDPNIVLMDEPTASLDEHTEREFIQRLGAWLGNRTLVVATHRVPVLELVERVVVLKDGMLVMDAPKAQALNNSRMQQQQQATGREWKNENQSA

SEQ ID NO: 10139 - protein, 148 aa, Enterobacter cloacae
TDNTGLYFAGQREKQTISISLHTSTRNTSEASPMTLQQALRKPTTPGEVLQYEYLEPLNLKINDLAEMLNVHRNTVSALVNNNRKLTADMAIKLAKALNTTIEFWLNLQLNVDIWEAQSNSRTQEELSRIKTVAEVMAKRKSGKPDVA

SEQ ID NO: 10140 - protein, 226 aa, Enterobacter cloacae
QSSNINPVYLNFYLLKNEGSQHKESAMKIVIIGASGTVGRAVTEELSRRHEVISVGRTQGDHQVDITSQASVQALFEKIGPVDAIVSASGGVHFGPLATMTDGEFNRGLQDKLLGQIRLALTGQHYLNEGGSITLISGIVAHEPIAQGVNATTVNAALEGFVRAAACELPRGIRINLISPTVLTESVEAYDGFFPGFESVPAATVAQAYRRSVEGVQSGRVYKVGY

SEQ ID NO: 10141 - protein, 175 aa, Enterobacter cloacae
GNIMSLPLISPQQANALIAEGAKLIDIRDPDEYAREHIPAAHSIPLDSLPGGLNAAPGETVIFHCQSGARTSNNAARLAQAASPANACVVEGGIQGWKQAGLLTVEDRSQPLPLMRQVQIAAGLLILCGVVLGYSVSSGFFLLSGFVGAGLLFAGVTGFCGMARLLKVMPWNRRT

SEQ ID NO: 10142 - protein, 79 aa, Enterobacter cloacae
MAVTLKLATLREVSFIIFNWLACTELFMGFWRVLFTIILPPLGVLLGKGLGWAFILNILLTILGYFPGLIHAFWVQTKS

SEQ ID NO: 10143 - protein, 590 aa, Enterobacter cloacae
FHQRQATPNDRPDQPHQPPATGGARSAGGRHRDGLRAGLWRARRSGGGDDRGDQRGTGDRERRQPSAGNSRLRARHRSGSAVAGAAVPAADRRRRHLGQQQHQHRITGTRICLQRGESIMTTLFNQPLNVINVGIAMFSDDLKKQHVPVTQLDWTPPGQGNMQVVKALDQLAEKPLAEKIAAANKIALERIIQSHPVLVGYDQAINVVPGMTRTTILHAGPPVTWENMCGAMKGAVTGALVFEGLATDLEDAARLAASGDITFSPCHEHDCVGSMAGVTSASMFMHIVENKTYGNRAFTNLSEQMAKILRMGANDQSVIDRLNWMRDVLGPMLRDAMNIIGEIDLRLMLAQALHMGDECHNRNNAGTTLLIQALTPGLIQAGYSVTQQREVFEFVASSDYFSGPTWMAMCKAALDAAHGIEYSTVVTTMARNGYEFGLRVSGLPGQWFTGPAQQVIGPMFAGYKPEDSGLDIGDSAITETYGIGGFAMATAPAIAALVGGTVEEAIDFSRQMREITLGENPNVTIPLLSFMGIPTAIDITKVAGSGILPVINTAIAHKDAGIGMIGAGIVHPPFSCFEKALLTFRDRYFL

SEQ ID NO: 10144 - protein, 336 aa, Enterobacter cloacae
RSAVMSQTTEKKPRLTTSAMIASIAEEGQETRAAPFGHALVKLAEQRPEVVGMTADLSKYTDLHIFAQAYPERFFQMGMAEQLLMGAAGGMAKEGFIPFATTYAVFATRRAYDFIHQVIAEEHLNVKICAALPGLTTGYGPSHQATEDIAIMRGIPGMTIIDPCDAIDTEQAVPAMAAHDGPVYMRLLRGKVPVVLDQYNYQFKIGKAALLEEGNDVLIVASGLMTMRALEAAKQLRKDNVSVAVLHSPTIKPLDEETILAQAAKPGRLVIVAENHSSVGGLCEAVASLLMRNRVNVDFDTVALPDAFLDAGALPTLHDRYGISTTAMVEKIRRRL

SEQ ID NO: 10145 - protein, 83 aa, Enterobacter cloacae
FNVRCEGVLGGKGYATAGQREAEHKTQIVSGYLWFNCHIERDACFLKLPAIGGNVRGRAPADTPMSDQLTGMRRCAVCRQIGR

SEQ ID NO: 10146 - protein, 113 aa, Enterobacter cloacae
TMNIDTDRLDDVNIMTPSVRRLDASVAAVFKEAIAREIGVDRKALIVDFSKIDFIDSSGLGALVSLLKMMNGKGEMMLCALNPGIRNMFTLTRMDRIFRICPDRATALSHLNQ

SEQ ID NO: 10147 - protein, 96 aa, Enterobacter cloacae; identical to SEQ ID NO: 6230

SEQ ID NO: 10148 - protein, 136 aa, Enterobacter cloacae
KPFFTDIVTFQHVRQLLLRIVRVEVGKETEIATVNTNNLNIIASQRSRRAQHIAVATDHHGEIRLLANFRQRAGSDAFKLQLLGNLLLDHHFIAFTTQPAIQHFMCRQCGRVTRMADDPNTPEMIIHFLEVLVPDE

SEQ ID NO: 10149 - protein, 207 aa, Enterobacter cloacae
NIGSLNMSATALVTEFLLAAEEGNIDALKACLEKGVDINVTNRQKRTAIIIASLKKHYACVEFLIAAGADIDKQDQTCFNPFLISCLTNDLTLLRIVLPADPDLDRLTRFGGVGITPASEKGHVEIVRELLEKTDINVNHTNFVGWTPLLEAIVLNDGGAKQQEIVKLLLDHGANPHMTDKYGKTPLELAREKGFNAIADLLLAAGA

SEQ ID NO: 10150 - protein, 549 aa, Enterobacter cloacae
RIRSAFPWLAVTEKTHCYRRAFSTTAAPFYLKQVKIMPTKIVIKKNTYFDSVSLMSVSTKANKLPGVEQAFVAMATEMNKGVLKNLGLLTPELADAKNGDLMIVIKGDAANDETLAAIEALFTRKERTGSHEARYASIASAKTHRPDSNLAVISVNGTFAAREARQALENDLNVMLFSDNVSLDDELALKQLAHEKGLLMMGPDCGTAIINGAGLCFANAVRRGPIGIVGASGTGSQELSVRIHEFGGGVSQLIGTGGRDLSEKIGGLMMLDAIDMLEADDATRVIALISKPPAPAVAEKVLARARACRKPVVVCFLGRNEPPADEDGLQFARGTKEAALKAVLLTGIKKDDLDLHPLNWPLIEEVRTRLTSQQKYIRGLFCGGTLCDEAMFAALEKFDDVYSNIQPDPARRLKDISVSQAHTFLDFGDDDFTNGKPHPMIDPTNRISRLLQEARDPQVGVIVMDFVLGFGAHDDPVGVMIEAIKEAQAIANADNRPLEILGYVLGTDQDPQSLAQQCQLLTDAGVIWASSSTNTGLLAREFVCKGEKA

SEQ ID NO: 10151 - protein, 329 aa, Enterobacter cloacae
GHQNAPSKGNKMKELMVVAIGGNSIIKDNASQSIEHQAQAVKAVAESVLEMLASDYDIVLTHGNGPQVGLDLRRAEIAHEREGLPLTPLANCVADTQGGIGYLIQQALNNRLAARGEQKAVTVVTQVEVDKNDPGFTHPTKPIGAFFSEAQRDELQLAHPDWHFVEDSGRGYRRVVASPQPLRIVEADAIKALTQKGFVVIGAGGGGIPVVRSEQGDYQSVDAVIDKDLSTALLAREIRADVLVITTGVEKVCVNFGKPNQQALDIVNVAQMTRYMDEGHFPAGSMLPKIVASLEFLRHGGRRVIITSPDCLPAALRGETGTHIINEGR

SEQ ID NO: 10152 - protein, 444 aa, Enterobacter cloacae
VMSRIEQAVPYIKAKKTNYRFVVLALIFIVYAINYADRTNIGAVLPFIIDEFHINNFEAGAIASMFFLGYALSQIPAGFFIAKKGIRGMVALSIFGFSAFTWLMGTATSVLGLKCIRLGLGLTEGPCPVGLASTINNWFPPKEKATATGVYIAATMFAPILVPPLAVWIAMTWGWRWVFFSFAIPGLVIAVLWYLLVRTRPSESAFVSKAELETITAGQETPDARRENIVISPGFARLDRLIRVRELAPVSTVKGLFTSKNILGDCLAYFMMVSVLYGLLTWIPLYLVKEKGFTFMSMGLVASMPCIGGFIGAIFGGYVSDKLLGRRRKPTMMFTAISTVLMMVIMLNIPQSTVAVCVGLFFVGLCLNIGWPAFTAYGMAVADSKTYPIAASIINSGGNLGGFVSPMLAGYLLDKTGSFNSVFIYFGICAAIGLIMIMLLEEPK

SEQ ID NO: 10153 - protein, 253 aa, Enterobacter cloacae
WSKCMLLKNKVAVITGAASVRGLGFATAKLYAEQGAKVVIIDLNAEASRAAAASLGDEHLGLAANVSNELQVNAAIEQVLGKYGRIDILVNNAGITQPIKLMDIKRENYDAVLDVSLRGTLLMSQAVIPTMRAQKSGSIVCISSVSAQRGGGIFGGPHYSAAKAGVLGLAKAMARELGPDNVRVNCITPGLIQTDITAGKLSDEMKTSILAGIPLNRLGDAQDIARAALFLGSDLSSYSTGITLDVNGGMLIH

SEQ ID NO: 10154 - protein, 285 aa, Enterobacter cloacae
GDTTMTDTTVQQVAAAAWRIRRYALRMGEVQGQGYIGQALGYADVLATAFTHGMNLKPGEPEWEGRDRFLLSHGHYAIACYAALIEAGIVPEEELETYGADDSRLPMSGMATYTPGMEISGGSLGQGLSIGVGMALGLKRKQSAAWVVNSMSDGELDEGSTWEAAMSAAHHGLSNLIVLVDINRQQADGNSHAILGFEPLEDKWTSFGWYVQRVNGNDVPSLVTAFDNAKRYPENQPRVILCDTLMGKGVPFLEKRDKNHFIRVDADEWQKALAVLDANKPEGVL

SEQ ID NO: 10155 - protein, 394 aa, Enterobacter cloacae
RMSANKLASSAQGLQSSAIRELLKHSKMAGVISLGGGIPNPDLFDHEGLKIAADAVLSQHFGEAFQYGLTEGVPGLREEIQRICEGRGIACKADDVVITSGSQQSLDVLARALINPGDTVVVERPTYLAALQVFGLAQAKFESVGTDGDGMKVDELEALVATKTIKAVYIVPTFGNPGGVTLSEARRKQLVELSKRYDFVIIEDDPYSEINYTDEAFRPLIAHAKDIGNEDNVVYTSTFSKILAPGTRVGWVLVPEWLKRAVVNLKQTTDLHTSTLSQLMTYEYLKTGRLANQIKMIREAYRQKYQTFATELEAELGDVMSFHKPKGGMFLWAKMNNGINTTKWLEKTLSNGVVFVPGEFFYCNEPDHTTLRMSFVTPTDEQLKEAVRRLRISL

SEQ ID NO: 10156 - protein, 144 aa, Enterobacter cloacae
ISELTVANDVTFPATLTSVSPLAAWLERQMASLSVSDDWRFALDLAACETATNIIRHALHEDPERCFTVEFIVTVSDAALRFTDDGDKFPAERLAAVRDDATFDASLLAESGRGLKLIFLYVDNFTVENVAGKNITVLEKRMVG

SEQ ID NO: 10157 - protein, 399 aa, Enterobacter cloacae
FPLTYGCGFLLSENRAGVYMSSTEATNKAPAVPEKSSVKSLKEEPVLQVERRDFVDLVPEKRPRVQSLRGFDDCYTDIVDYIVRCTHKIWDERDVGLIYSHYTHNCVLYNALGTLYNREQVVQDTLQRLIAFPERRGMATQVIWNGNDVDGFYTSHLVTGSGRHTQHSHLGKPTNRTFVTRTVADCMIHENKIYREWVVSDNMSLMKQLGLNTDQIAFNMAKEQFDKGFRVMDIGENGRMLGQYPPEMECDVSIAHTDTEEQCLRWLHEIYNRRMFGKIKEVYAPNVQWHGPLMKELYGTAAVTHQTLALVGMIPDGAWLPQHICSNPCDEGGVKVAVRWIIEGHHLGYGELGKPTGERLFVMGMSHYHIVNGKIVDEWVVYDHLALLAQIKLGQMEDA

SEQ ID NO: 10158 - protein, 431 aa, Enterobacter cloacae
MLNQVSWIKRPQGQDAQADRSLTEKVSAIIERVKTEGDTALRAFSQQFDKVVPAQFEVSEQEIAEALEGMDAQTRRDSEFAINQVCRFAQAQLATMQPLEVETLPGVHLGHRIIPVQTVGCYVPGGRYPILSAPVMSIVPATVAGCEQIIACLPPGAHPAMIAVCHLAGAHRIFKVGGAQAIAAMAWGTESIPSVDKIVGPGNAFVNEAKRQVFGRVGIDALAGPSEIFTIADDSADPRILAADMLAQAEHDIHTRVGLATTSRDIAERTLAEVERQLASLPTAATAGEAWRRQGEIVLCEDEAQLIAFADHMATEHLQVHTRDPHATAAKIRNYGSLFIGQNASVVFSDKCCGTNHTLPTMAAARYTGGLWVGAYVKICTHQWIDEQGIPAIAEPAIRQSRTEGMQGHRRAAEIRLRPQDIDAITTGMRD

SEQ ID NO: 10159 - protein, 454 aa, Enterobacter cloacae
NVSRAAFCPVFITREPETMKRLIPPDDCPEEIAHRLDVIQQHRALNAILGVNPDAMSQAEQHQQQRRRGEPIGPLHGVPLIVKDNIACAPMPITLGCRALASLNATADARVVQRLRSAGAIILARANMSEFAFDVRSRSSLGGDVANPLCPTLTAGGSSGGCAAAVAAGMADGALGTDTGGSIRIPCSYTGLMGLRPAFRRSQLDGVAPLSPSKDTVGPMVHSVEDAALLHAVIHGLPPVALPVRSLKGVRFGVVTALQGEDEVQLEVWQSALHTLRRAGATLVEVSLPFLEEVRQATCLSLYEFRVAIDDWLSKQPGAPSGLTSIVDSGAFLPEFAPFLRQMLASNTLKTPLWLAGRRFQRLLRQNLCQVAEAQRIDGFVYPTVQRLPESMAKMPPGCAPELAAISGLPAITLPCGVSRIGLPVGMEMLSVQEDEAALMVLALACEGALGEKG

SEQ ID NO: 10160 - protein, 158 aa, Enterobacter cloacae
MLLFVCCVTMENAMPQISRTALVPYSAEQMYQLVNDVQSYPEFIPGCTGSRVLESGPTQMTAAVDVSKAGISKTFTTRNTLTSNQSILMHLVDGPFKKLMGGWKFTPLSADACRIEFHLDFEFTNKLIELAFGRIFKELASNMVQAFTTRAKEVYSVA

SEQ ID NO: 10161 - protein, 126 aa, Enterobacter cloacae
DPSGRLAKGIIPWDVLGRSGWEKFRGCSVKKNAASQAELERQRAEQQDKINALLELMKADGISPSDLLGSDLAQAGQPTKKRKARAAKYRFIDANGEEKTWTGQGRTPKPIATALANGKSLDDFLI

SEQ ID NO: 10162 - protein, 543 aa, Enterobacter cloacae
KGAVDLPRSLLFIRHASMKNMKLEWKRGDWAAYFGLMTNNLTNLLTMMGLLIFVVGIPKEIVYGRIAPAFGLAVLVASLCYTWFGLQMARATGRTDVTALPSGPSAPSIFTVTFLVLMPVYQQTGDADFAIQIGLVWCFVEAMILAGGSFLGETIRKMIPRTVLLSCLSGLGLLLLAMNPMLQAFEAPTVSFIVLLLIFINWFGKKPIFARIPTGLLLLIAGTLLAWISGLQSPDAIKASMSSFGFNPPEVHVDSFMQGLPHALPYLASAVPLGLANYIFDLENIESAHAAGDEYPTRKVMLANGLASMLGCLMGNPFPVTVYVGHPGWKAMGASIGYTLASGVTMFIVPLFGLGAFMLAIIPMTAIVPILVFIGVVTANQVVRETPKVEVPVIFICLFPWIANWALTMMNSVMSAAGTSAAKIGTDVLHSKGIYYEGLMHLGNGAPLASMLWGCIAIFAILNKPLRGAVAAAGGALLALFGVIHAPVVGFAEGSSLMFVTAYLMMGGMFVVKHVLDTSVNPPLPVGEGRGEGTRTHLLKETK

SEQ ID NO: 10163 - protein, 485 aa, Enterobacter cloacae
SSPRRTACPQRCAVKRVPILLMKEDKMSENKSRREFISQSGKMVTACALFGATGSVAYAADSVKATCETGKPMNITAKHYYLDNVLLEAGFNYDGSVATSTRTELKTLEIKDGKIVALRDNGSHADATLPHYDAGKKLMLPAMRDMHIHLDKTFYGGPWRSLNRPAGTTIQDMIRLEQKLLPELQPYTQERAEKLIDLIQSKGSTIARSHCNIEPVSGLKNLENLQAVLARRGAGFDCEIVAFPQHGLLLSNSEKLMREAMQAGAHYVGGLDPTSVDGAMEKSLDTMFQIALDYDKGVDIHLHETSPAGVAAVNYMVETVEKTPALKGKLTISHAFALATLNEQQVDEIATRMAAQQVTIASTVPIGTLHMPLKQLRDKGVFVMTGTDSVIDHWSPYGLGDMLEKANLYAQLYIRPNEQTLSRALGIATGDVLPLNDKGERVWPKAQDDASFVLVDASCSAEAVARISPRTATFHKGNLVWGTVA

SEQ ID NO: 10164 - protein, 286 aa, Enterobacter cloacae
PLRDLNHSHGGENPAQAVIYKTDTLSTGEGCFTLATVAIKESVMAQNIYDNPAFFEGYAQLPRSVQGLNGAPEWPALKAMLPDLTGKAVVDLGCGYGWFCRAARELGASDVTGVDISEKMLARAAELTDDNRIHYQRSDLESLALKANSLDLVYSSLALHYLPELDTLFANVQRALKPGGSLVFSMEHPIYTCATRQGWLTDDSGERFWGVNHYQDESQRVSNWLADGVIKYHRTLGTTLNALIKAGLTISEVNEWGPTQMQVDAWPALAEEAERPMLVLIAARKA

SEQ ID NO: 10165 - protein, 300 aa, Enterobacter cloacae
PEVRNMDKLRGMETFIAVVESGSFTGAAARLEMSAVMVGKYITQLESQLGTRLLERNTRRQSLTDAGRVYFVEARRVLEQVSIAENAVERLRATPAGTLRVTAPTSFGGCVIAPLTATFLQRYPEVRIELDLTNRMVDLVEEGVDLAIRIGEIRNEDLVAKYLCPYNMTICAAPDYLARHGTPQTPADLVDHLCLSHTVWTARNEWRLPGVEGEVRWKRDAVLRCNDGYGLRMAARAGAGLLLQPEVLVAEELASGRLVRVLEAFTPAPRPVHLLWRQDLRPLPKLTEFIAHILLRLGTI

SEQ ID NO: 10166 - protein, 247 aa, Enterobacter cloacae
TQLKEQNMNKVILITGASSGIGEGIARELGKAGAKVFLGARRLERIHALADEIRSAGGEAEAQVLDVTSRQSMAAFVEAAREKWGRIDVLINNAGIMPLSPLSAGKQDEWERTIDVNIKGVLWGIGAVLPIMEAQNSGQIINIGSIGALSVVPTAAVYCATKFAVRAISDGLRQESSNIRVTCVNPGVVESELASTITHEETMAVMDAYRAIALKPADIARAVRHIIEAPESVDTTEITIRPTASAN

SEQ ID NO: 10167 - protein, 422 aa, Enterobacter cloacae
IPGRHRQRHLVLTALGGRMLSQHVLIVEDSLVYRRLLSRMLTQWGYTVYEAENGVAALEILENQPVSLVISDWDMPEMDGLTLCREVRSRQFGHYVYLILLTAREEPGDLTVGFDAGADDFLNKPVEQSELRARLHAGARVLSLEATLATRNARLSEALRQIEQDLEVAARIQQSVLPAHQLRYRDYFADWIFLPSAWVSGDIFNVFPLDNHLGFYCVDVSGHGVGAAMMSLAVARQFLHGRAVERFLFADDSDVASPAEVVRILNGRFCSEEVEIMSYFTMIYGVIDLTTGEGKLCQAGHPTPFIVNPGGEVRTVGEGGAPVGLMPDLSWSDVSFSLAPGERLCLFSDGITECENPDNEQFGQARLQRRLQDDATLALERLLPQFAQHLIRWRSGKYREQQAMADDVSLLVIERTGVNDEH

SEQ ID NO: 10168 - protein, 402 aa, Enterobacter cloacae
SRSCCENFNFLCCIRMQRWCKYKKHPLAEAFEARANGQDVDKESGVMKRKTFAAVTSQQVAQLAGVSQSAVSRTFTPGASISPATREKVLKAARELGYRPNAIARSLNTARSRIIGVVISYFDNPFYSQVLEALAQKLDTLNYHLLLFVGDREGNVDRIFDQIMQYRVDGIVLASVTLSLELSEECLAAGIPVVLFNRSEESGMASSVNSNNEAAARQIAEFLLAGEHKRFAYVGGVADSPVNIARQRGFISTLEEHGITDVRVVHGNYDAQQTTRAAYTLFSTSPAPDAVFVANDHMAVTVMDVARYEFGLRIPEEVSVVGYDDIGPSGWPSYALTSASQPVGAMVDATVELLMKQIDSGTIEPEQITVPGTLVIRHSARRPRSGVIETNGLTLFQSKERT

SEQ ID NO: 10169 - protein, 327 aa, Enterobacter cloacae
TVRCSGRDPPSSERVEAGYGRTGHIKKSRGVLRKAVRLRYAFIRDNSRCWPVRLLCRVLDVHPSGFYFWLQQPHSQRHQTDQMLTGQIKQFWLESGCVYGYRKIHLDLRDTGQQCGVNRVWRLMKRAGIKAQVGYRSPRARKGEASIVTPNRLQRQFNPDSPDERWVTDITYIRTHEGWLYLAVVVDLFSRKVIGWSMQPRMTKEIVLNALLMAVWRRNPQKQVLVHSDQGSQYTSHEWQSFLKSHGLEGSMSRRGNCHDNAVAESFFQLLKRERIKKRIYGTRDEARSDIFDYIEMFYNSKRRHGSSEQMPPAEYENLYYQRLRSV

SEQ ID NO: 10170 - protein, 123 aa, Enterobacter cloacae
SNWRLAESLKSWPRIWFRRSPRAPKRFTVSHKIAVEVVYALPEKQYLQRVTLEEGATVEAAIRASGILELRRDIDLAKNKVGIYSRPVKLGDVLKEGDRVEIYRPLIADPKELRRQRAEKSGK

SEQ ID NO: 10171 - protein, 808 aa, Enterobacter cloacae
RHNNPRSSGWLGPWCLLVGVILLVTGLFFAIGGFKLVSVGGSWYFLIAGVITLLSAIQFFRRKSSAVGLFALVFLGTLIWAFFDAGLDFWPLVSRLMVPAGLMVLAAATWPALRKREGKPSCAKGALGVCAVLIIAMGVTFVQMFQPHPTVPFSGEKRPLVPVKDDAKQQNWDHYGNTAGGSRFVALDQITRDNVKNLKPVWTYHTGDVPESPDGNGAEDQQTPLQVGDRVFLCTPHNNVIAVDADSGKEIWKAEINAKSAIWMRCRGLAYFDATKPLAQPTVAGSTPVLPAQVAPGAACQRRILMNTIDGKLIALDADNGKFCPDFGTNGSVNLHEGMGDASDPTYVLTSAPTLAGTTVVVGGRVADNVSTDMPGGVIRGYDVITGQLRWAFDPRNPDPNYVLKPGEHYKRSSANSWAPMSWDASMNTVFIPMGSSSVDLWGADRIPEDHKYATSILALDATTGKEKWVYQTVHNDLWDFDIPMQPSLVDFPTKEGNKPAVVVGTKAGQIYVLDRLTGKPLTEVKEVPVKPADIPREQYPATQPRSVGMPQIGAETLKESDMWGATPFDQLACRISFKSMRYDGLYTMPGTDISLSFPGSLGGMNWGSLSTDPNNQYIFVNDMRLGLWVQLIKQDPQSAVANTGGEAVNAGMGAVPMKGTPYSVNKNRFMSPLGIPCQKPPFGSLSAIDLKTQKIVWQVPVGTVQDTGPFGVKMRMQMPVGMPTLGGTLATQGGLVFIAGTQDYYLRAFDSSTGEEVWKARLPVGSQGGPISYVSPKTGKQYILISAGGARQSPDRGDYVIAYALDK

SEQ ID NO: 10172 - protein, 125 aa, Enterobacter cloacae
LNRVHANRQNSRRSRPMQQFEWIHAAWLAFAIVLEIIANVFLKFSDGFRRKAYGLLSIAAVLGAFSALSQAVKGIDLSVAYALWGGFGIAATLAAGWIMFGQRLNNKGWIGLVLLLAGMIMIKLA

SEQ ID NO: 10173 - protein, 305 aa, Enterobacter cloacae
YFKNMNIELRHLRYFVAVAEELHFGRAAARLNISQPPLSQQIQILEQQVGARLLARTNRSVSLTAAGKQFLADSRQILSMVEDAAARAERLYLGETGELRIGFTSSAPFISAVSQTLSSFRRNFPDVHIQTREINTREQISPLNEGSLDLGLMRNTQLPDTLAWQVILREPLMAMIPRDHPLAAQHSVTLAELAKEPFVFFDPQVGTGLYDDILGLMRRYGLVPTIAQEVGEAMTIIGLVAAGLGVSILPASFKRVQLAEMRWVKIAEQDAVSEMWLVWSKHHEQSHAAQRFKEQLITASRGHYL

SEQ ID NO: 10174 - protein, 228 aa, Enterobacter cloacae
GSEMTKITPEYTVVDLSRWARKEHFEVFQGFAQSTFNQTVQLDITVLLKHIKEVGWKFYPAIISLISHVVNRHPEFRMAMKDDELVIWNEVHPSYTLFHKETETFSSLWSHYDGNIHHFQRVYAEDVARYGNILAYWPKEESRENIFFISDIPWVSFSSFNVNVANMRNFFAPMFTFGKYYNQDEKVLLPFAVQVHHSVCDGFHVARMINELQELCDNLPHHSEAPNV

SEQ ID NO: 10175 - protein, 240 aa, Enterobacter cloacae
TVNDVNKYAAITLLATVLVGCDNNTAPLSFTPEMASFSNEFDFDPLRGPVKDFTQTLFNDKGEVSKRVTGTMSTEGCFDTLELHDLEANTGVALVLDANYYVDAETQQQKVKLQGKCQLAELPSAGLTWDTDDNGFVVAAHSKEMEVKYQYDADGYPLGKTTVSGDQRLSVKSVPSKDLRKRMDYTAVSLLNDKPMGNVKQSCDYDRHNNPVNCELLITDDSVKPAVERKYTIKNSIEYY

SEQ ID NO: 10176 - protein, 371 aa, Enterobacter cloacae
EAGSEIPVRSGLSAGGPSGRRHSLELVNEERMMKSVVIQQPNALEIEERPLPLPGAGDVRVKIKLAGICGSDSHIYRGHNPFAKYPRVIGHEFFGEIDAVGEGVEGTRLGQRVSVDPVISCGHCYPCSVGKPNVCTSLVVLGVHRDGGFSEYAVVPAKNAWHIPDAIPDKHAVMVEPFTIAANVTGQAKPTEQDVALIYGAGPMGLVTVQALKGVYKVKQVIVVDRIDERLEMAQRSGADWVFNNGEQSLQTALDEKGIKPTLIIDAACHPSILQEAITLASPAARIVLMGFSSDPSQIVQQGITGKELSIFSSRLNANKFPVVIDWLEKGLIDPEKLVTHTFDYHHVTDAIELFEKDQRQCCKVLLTFDQ

SEQ ID NO: 10177 - protein, 678 aa, Enterobacter cloacae
TMSVNNPFFEISLLPYQAPRFDAINDSHYRPAFDEAMRLKRADIDAIIAQRAAPDFDNTVLALEKSGAMLSRVSSVFFAMTSAHTNDDLQALDEQFSTELAGLANDIWLNDTLFARVEAVWQDREALDAESRRLTEETYQHFVLAGARLNADEKAELKSLNTEAATLTSQFNQRLLAANKAGGLVVDDVRQLDGLSAEEMAAAAHAAAEKGLKERWLIPLLNTTQQPALAALALRETRKKLFSAGWERTQKGDENDTRELIRRLTALRARQAQLLGFDNYASWSIADQMAKTPEAALEFMRGIVPAARGRAALEQADIQKVIDDEQGGFTVQAWDWAFYAERVRSAKYALDESQIKPYFALNTVLEDGVFWTATQLFGIRFVERFDIPVYHPDVRVWEIFDHTGEGMALFYGDFFARDSKAGGAWMGNFVEQSYEFAARPVIYNVCNYQKPANGQTALISWDDVITLFHEFGHTLHGLFASQRYATLSGTNTPRDFVEFPSQINEHWASHPQVFAHFARHYQTGEPMPDALREKMLNATQFNKGYDMTELLSAALLDMNWHGIQEPVEDVEAFEAAALKKEGLDLPAVPPRYRSSYFAHIFGGGYAAGYYAYLWTQMLADDGYQWFVEQGGLTRENGQTFREAILSRGNSTDLAELYRNWRGHDPKIEPMLENRGLSA

SEQ ID NO: 10178 - protein, 274 aa, Enterobacter cloacae
IGHKETGVRNVKIEEVEQLDREVVAIGNDYVQGFMLPQHKHRRAQLLYGATGLMHVITQDGEWIVPPQHAVWIPPETMHAVKFVGVTTRSLYIEPDFVNAFLKYPRCEVISVSPLLRQLLLESVDLPPLYESTRDRALINLMILELAAMPVREFDIPLPRHPALLALCQAFLLNPSIHDPAERWANALFMSDSTFRRHFLKQMGMSFSVWRQRACVVSALALLITGKPVNEVALTLGYDNASSFATMFRRVTGQPPSYYHPALFKKFHGTGHRS

SEQ ID NO: 10179 - protein, 164 aa, Enterobacter cloacae
IMINKILVSACLMGLKVRYNGKEKAQMTHQLARWQQEQRLVIHCPELAAGLPVPRPPAEIMSAEGKDVMRGQARIIENTGTDVTGHYQLAAWLALRAAQEAGCTAALLTDGSPTCGTQFIYNGSFSNQRKSGMGVAASLLSEHGIAVFSETQFAELVNWIEERE

SEQ ID NO: 10180 - protein, 102 aa, Enterobacter cloacae
IYRFINRRNDMKKALLGSVLALTVASFGASAADMISKDEAHHFKLEYLGNVSVGASGGQISSPSDLHQKLSKLADEKGGKYYVIIAAREHGPNFQAVAEVFK

SEQ ID NO: 10181 - protein, 529 aa, Enterobacter cloacae
QSECHTDKSRNAIPLLDCIHTLRSITKEYPMSESHVAILPGVQQFLDRQHGLWIEGRQAASDSEKRLNVYNPATGEVIASTADASVDDVDRAVMSGWRAFVARSWAGRLPAERERILLRFADLVEQHGEELAQLETLEQGKSINISRAFEVGCTLNWMRYTAGLTTKIAGKTLDLSIPLPQGARYQAWTRKEPVGVVAGIVPWNFPLMIGMWKVMPALAAGCSIVIKPSETTPLTLLRVAELASEAGIPDGVFNVVTGSGAVCGAALTSHPRIAKVSFTGSTATGKQIARVAADTLTGVTLELGGKNPAIVLKDADPAWVIEGLMTGSFLNQGQVCAASSRIYIEAPLFDTLVSGFEQAVKSLSVGPGMSPDAFINPLVSRAHCDKVQAFLDEAKAHNAELIAGNRGPDGKGYYVSPTLVVNPDNHLRLTREEVFGPVVNLVRVDDGEEALQLANDTEYGLTASVWTQNISKALAYTDRLQAGTVWVNSHTLIDANLPFGGMKQSGTGRDFGPDWLDGWCETKSVCVRY

SEQ ID NO: 10182 - protein, 332 aa, Enterobacter cloacae
LLRNQMIHHFAICGDLTNHKGGYVTQEQRFEQRIAQETAIEPQDWMPDAYRKTLIRQIGQHAHSEIVGMLPEGNWITRAPTLRRKAILLAKVQDEAGHGLYLYSAAETLGCAREDIYQKMLDGKMKYSSIFNYPTLSWADIGVIGWLVDGAAIVNQVALCRTSYGPYARAMVKICKEESFHQRQGFEACMALAQGSEAQRQMLQDAINRFWWPALMMFGPNDDNSPNSARSLAWKIKRFGNDELRQRFVDNTVPQVEMLGMTVPDPDLRFDEESGHYRFGEIDWQEFDEVINGRGICNHERLAAKRKAWDDGAWVREAALAHAEKQRARQAA

SEQ ID NO: 10183 - protein, 99 aa, Enterobacter cloacae
EESTMSNVYWPLYEVFVRSKQGLSHRHVGSLHAADDRMALENARDAYTRRSEGCSIWVVKASEIVASQPEESGEFFDPAESKVYRHPTFYTIPDGIEHM

SEQ ID NO: 10184 - protein, 265 aa, Enterobacter cloacae
RTLIVESILSHVEQGVMTITLNRPERLNSFNDVMHQQLSECLKQAERDDAIRCLLIIGAGRGFCAGQDLNDRNVDPNGPAPDLGMSVETFYNPLVRRLAKLPKPVICAVNGVAAGAGATLALGCDMVIAARSASFVMAFSKLGLVPDCGGTWLLPRVAGRARAMGLALLGDKLSAEQAQAWGMIWQVVDDEQLSATVQQMALHFASQPTFGLGLIKQAINAAETNTLDAQLDLERDYQRLAGRSDDYREGVSAFLAKRAPNFTGK

SEQ ID NO: 10185 - protein, 443 aa, Enterobacter cloacae
CEYPAMINTTKLDPIETASIDELQALQTARLKWTLNHAYNNVPMYKRKFDAAGVHPDDFNELADLQKFPCTTKQDLRDNYPFDTFAVPMEQVVRIHASSGTTGKPTVVGYTQNDIDNWANIVARSLRAAGGSAKDKIHVAYGYGLFTGGLGAHYGAERLGATVIPMSGGQTEKQAQLIRDFQPDMIMVTPSYCLNLIEELERQMGGDASACSLRVGVFGAEPWTQAMRREIEKRLGITALDIYGLSEVMGPGVAMECLETADGPTIWEDHFYPEIVNPNDGTPLADGEQGELLFTTLTKEALPVIRYRTRDLTRLLPGTARTMRRMDRISGRSDDMLIIRGVNVFPSQLEEEIVKFEHLSPHYQLEVNRRGHLDSLSVKVELKQSSLTLTHEQRCQVCHQLRHRIKSMVGISTDVMIVNCGSIPRSEGKACRVFDLRKVAANG

SEQ ID NO: 10186 - protein, 320 aa, Enterobacter cloacae
FIQEKNNNRMNHMNKLDAFIQHAVSSVPVSGTSLISSLYGDALAHRGGEIWLGSLAALLEGMGFGERFVRTALFRLNKEGWLDVSRIGRRSFYRLSDKGLRLTRRAENKIYRAELPAWDGKWLLLLSEGLDKTTLADVKKQLIWQGFGTLAPSLMASPSQNLADVQSLLHDAGVAENVIFFEAHSPLALSRAALRSRVEECWQLTEQNAMYETFINSFRPLLPLLKETPPEDLTPERCFQIQLLLIHFYRRVVLKDPLLPEELLPAHWAGQSARQLCINIYQRVAAGALAFVSEKGETSVGELPAPGTLYHQRFGGLNIT

SEQ ID NO: 10187 - protein, 204 aa, Enterobacter cloacae
GEGMPVYQIDGLTPVVPEESYVHPTAVLIGDVILGKGVYVGPNASLRGDFGRIVVKDGANIQDNCVMHGFPEQDTVVEEDGHIGHSAILHGCIIRRNALVGMNAVVMDGATIGENSIVGAAAFVKAKAEMPANHLILGSPAKAIRELSAQEIEWKKQGTREYQVLVDRCKQTLHQVEPLREEEPGRKRLVFDENLRPKSAGRDK

SEQ ID NO: 10188 - protein, 515 aa, Enterobacter cloacae
SGVNLVCRHAAPRLGTERDCRHGRFTRFCRHAADPQKRFPDAGPGQRGGRRPRHSSRSGKREGSHRVSRRVQPGAAPAFRPARCTSARTAAQDGATMKIAIIGSGIAGLTCAWRLAGHHQITVFEAQATPGGHTATVDVDTPQSTFAIDTGFIVYNDRTYPRFMGLLSELGISGQKTQMSFSVHNPQSGLEYNGHTLTSLFAQRRNLLNPAFWTLLKEIVRFNRLAKQTLRGEVDGSATLETFLRQHRFTPFFARHYILPMGAAIWSSSLQEMKRFPLPLFLRFFENHGLLDITHRPQWYVVPGGSREYIRAMMDKLGDRLTLHLNAPVQKVVRHDRGVDIEREGVTHTFDQVIFACHSAQALAMLASPTQAEREVLGDIGWQRNEVVLHSDPRWLPVRKRAWASWNYRLSEQDRASACVTYNMNILQGLPPGSPLFCVTLNPETPVEERYVLRRFVYEHPLFNPQSWQAQARRGEINGRQRSWFCGAYWYNGFHEDGVRSALDVVNAIAAGEGN

SEQ ID NO: 10189 - protein, 408 aa, Enterobacter cloacae
TLMTDPVFALEPDIPRNVRVARWLLFRLLNGLRGGSLTLREGAQTFQFGDASAALHAEVQVLAPGVYWRILTGGSLAAAQAWMDGDWETPHLTPLLELIARNSQILGQLEKGFRLLGKPVERLRHWMRRNSRAQARENIAAHYDLGNAFYAHFLDEDLLYSSALFNGDEQDLNAAQQAKMARLCDQLALTANDHLLEIGTGWGAMAEYAARHYGCRVTTTTLSQEQYHWATARIVRAGLQDRVEVLLCDYRDLTGVYDKLVSVEMIEAVGQRYLPTFFRTCQARLRPGGRMAIQAITIQDQRYRDYSKSVDFIQRYIFPGGFLPSITAMNELMTRHTDFVVRNLFDMGPDYARTLAHWRQRFVHAWQEIEKLGFDDRFRRMWLYYLGYCEAGFNARTISVVQLTAERV

SEQ ID NO: 10190 - protein, 1313 aa, Enterobacter cloacae
KEILSGSALPVNAMTEHQKLTFPMLMQKLDSLMLRDKQRFARRLHGVKKVKNPDAQQAIYQEMAKEIEQAAGKVVLREAARPEITYPENLPVSQKKQDILEAVRDHQVVIVAGETGSGKTTQLPKICMELGRGLKGLIGHTQPRRLAARTVANRIAEELQTEPGGCIGYKVRFSDHVSDNTMVKLMTDGILLAEIQQDRLLMQYDTIIIDEAHERSLNIDFLLGYLKELLPRRPDLKIIITSATIDPERFSKHFNNAPIIEVSGRTYPVEVRYRPIVEEADDTERDQLQAIFDAVDELGNESSGDILIFMSGEREIRDTADALSKRDLRYTEILPLYARLSNSEQNRVFQPHSGRRIVLATNVAETSLTVPGIKYVIDPGTARISRYSYRTKVQRLPIEPVSQASANQRKGRCGRVSEGICIRLYSEDDFLSRPEFTDPEILRTNLASVILQMTALGLGDIAAFPFVEAPDKRNIQDGVRLLEELGAITTDEQATAYKLTPLGRQLSQLPVDPRLARMVLEAQKHGCVREAMIITSALSIQDPRERPMDKQQASDEKHRRFHDKESDFLAFVNLWNYLGEQQKTLSSNQFRRQCRVDFLNYLRVREWQDIYTQLRQVVKELGIPVNSEPAEYREIHIALLTGLLSHIGMKDADKQEFTGARNARFSIFPGSGLFKKPPKWTMVAELVETSRLWGRIAARIDPEWVEPVAQHLLKRSYSEPHWERGQGAVMATEKVTVYGLPVVAARKVNYSQIDPALSRELFIRHALVEGDWQTRHAFFRENLKLRAEVEELEHKSRRRDILVDDETLFEFYDQRISHDVISARHFDSWWKKASKETPDLLNFEKSMLIKEGAESVSKLDYPNFWHQGNLKLRLTYQFEPGADADGVTVHIPLPLLNQVDESGFEWQIPGLRRELVIALIKSLPKPVRRNFVPAPNYAEAFLGRVTSLELPLLDALEREFRRMTGTTIDRDDWNWDQVPDHLKITFRVVDDKNKKLMEGRSLSELKDALKGKVQETLSAVADDGIEQSGLHIWSFGQLPESYEQKRGNYKVKAWPALVDERDSVAIKLFDNPQEQQQMMWRGLRRLLLLNIPSPIKYLHEKLPNKAKLGLYFNPYGKVLDLIDDCISCGVDKLIHEAGGPVWTEEGFAQLHEKVRAELNDTVVEIAKQVEQILTAVFNINKRLKGRVDMTMALGLSDVKAQMAGLVYRGFVTGNGFKRLGDTLRYLQAIEKRLEKMAVDPHRDRAQMLKVENVQQAWQQWLNKLPPARRDDDDVREIRWMIEELRVSFFAQQLGTPYPISDKRILQSMEQISG

SEQ ID NO: 10191 - protein, 353 aa, Enterobacter cloacae
RNALSGYSTMKKIGFLSFGHWTPSPQSGTRTAADTLLQSIDLVVAAEELGADGAYFRVHHFARQLSSPFPLLAAIGAKTKRIEIGTGVIDMRYENPLYMAEDAGAADLISGGRLQLGISRGSPEQVIDGWRYFGYVPQEGETESDMARRHTEVLLDVLRGEGFAKPNPQPMFPNPPGLLRLEPHSEGLRDRIWWGAGSNATAVWAAKLGMNLQSSTLKDDETGEPFHIQQAKQIRAYRQAWAEAGHTRQPRVSVSRSIFALMDERDRMYFGSSRNESDSVGYLDEKTRAIFGRSYAAEPDKLIEQLKKDEAIAEADTLLLTVPNQLGVEYNAHVIESILKHVAPEMGWRDRNA

SEQ ID NO: 10192 - protein, 429 aa, Enterobacter cloacae
RQPLKCFTIALSLFRSSKIREYEVVADSQPGHIDQIKQTNAGAVYRLIDQLGPVSRIDLSRLAQLAPASITKIVREMLEAHLVQETEIQEPGSRGRPAVGLVVETEAWHYLSLRISRGEIFLALRDLSSKLVVEDRLELPLNAEQPLLDAILTHIDQFFIRHQQRLERLTAIAITLPGIIDTENGIVHRMPFYENVKEMPLGDVLENHTGVPVYIQHDISAWTMAEALFGASRGARDVIQVVIDHNVGAGVITDGRLLHAGSSSLVEIGHTQVDPYGKRCYCGNHGCLETIASVESVLELAQVRLTQSMSSTLHGQPLSVEALCAAARQGDLLAKDIITGVGNNVGRILAIMVNLFNPQKILIGSPLSQAADILFPAISACINQQALPAYSKNIVVESTQFSNQGTMAGAALVKDAMYNGSLLIRLLQG

SEQ ID NO: 10193 - protein, 232 aa, Enterobacter cloacae
VMLKRFFITGTDTSVGKTVVSRALLQALAASGKRVAGYKPVAKGSKETPEGLRNKDALVLQSVSSLELPYDAVNPIALSEEESSVAHSGLINYSLLSDGLANLSEKVDHVVVEGTGGWRSLMNDLRPLSEWVVQEQLPVIMVVGIQEGCINHALLTAQAIANDGLPLIGWVANRVNPGLAHYAEIIDVLSKKLPGPLVGELPYLPRAEQRELAHYIDLSAFGGMLAVGRVVA

SEQ ID NO: 10194 - protein, 116 aa, Enterobacter cloacae
INPHETRKMFKTTLLFFATALCEIIGCFLPWLWLKRGASALLLIPAGVSLALFVWLLTLHPAASGRVYAAYGGVYVCTALLWLRVVDGVRLSLYDWAGALIALCGMLIIVAGWGRA

SEQ ID NO: 10195 - protein, 417 aa, Enterobacter cloacae
ISCITTSDVRKWIMKIVGAEVFVTCPGRNFVTLKITTDEGIVGLGDATLNGRELSVASYLKDHLCPQLIGRDAHRIEDIWQFFYKGAYWRRGPVTMSAISAVDMALWDIKAKAANMPLYQLLGGASREGVMVYCHTTGHTIDDVLEDYARHKEMGFKAIRVQCGVPGMKTTYGMAKGKGLAYEPATKGAWPEEQLWSTEKYLDFTPKLFDAVRSQFGFSEHLLHDMHHRLTPIEAARFGKSIEDYRLFWMEDPTPAENQECFRLIRQHTVTPIAVGEVFNSIWDCKQLIEEQLIDYIRATITHAGGITGMRRIADFASLYQVRTGSHGPSDLSPICHAAALHFDLWVPNFGVHEYMGYSEHMLEVFPHSWRFDNGYMHPGDKPGLGIEFDEKLAAKYPYDPAYLPVARLEDGTLWNW

SEQ ID NO: 10196 - protein, 478 aa, Enterobacter cloacae
EPAKTGSKWYASYLSEIAIMTQAQPQRSTSDLVKAAVSGWLGTALEFMDFQLYSLGAALVFHEIFFPEQSAAMALILAMGTYGAGYIARIVGAFIFGRMGDRIGRKKVLFITITMMGICTTLIGVLPTYAQIGIFAPVLLVTLRIIQGLGAGAEISGAGTMLAEYAPKGKRGIISSLVAMGTNCGTLSATAIWAVMFFALDREELIAWGWRVPFLASVVVMIFAIWLRMNLKESPVFEKVNDAETVAPAAAQDTSLGAMFKSKSFWLATGLRFGQAGNSGLIQTFLAGYLVQTLLFDKAIPTDALMISSILGFLTIPLLGWLSDKVGRRLPYILLNISAIILAYPMLSIIVDKSYAPGVIMLSIIVIHNFAVLGLFALENITMAEMFGSRNRFTRMAISKEAGGLVAVGFGPVLAGIFCNMTGSWWPIVAMLVAYSLIGLVSALLMPEVRDRDLSEAEDAAEAPHKEAVAYGALSSRR

SEQ ID NO: 10197 - protein, 491 aa, Enterobacter cloacae
RVSIMENQLLQAKATRPQYDRDSLKARIVHLGFGAFHRAHQAVYTDILAAEQGSDWGYCEVNLIGGEQQIADLKAQDNLYTVAEMSADAWTARVVGVVKNALHAQVDGLETVLAALCEPQVAIVSLTITEKGYCHSPATGQLMFDHPLIVADLQNPHQPKSAPGVVVEALARRKAAGLPAFSVMSCDNMPENGHVMRNVTCAYARAVDGELADWIEANVTFPSTMVDRIVPAVTADTLDKIEQLTGVRDPAGVACEPFRQWVVEDNFVAGRPKWEKAGAELVSDVIPFEEMKLRMLNGSHSFLAYLGYLAGYQHINDCMEDEHYRAAAHALMLKEQAPTLKVKGVDLAHYADLLIARYSNPTLRHRTWQIAMDGSQKLPQRMLDSVRWHLVHQKPFPLLALGVAGWMRYVGGVDEQGNPIEVSDPQLAVIQAAVNGSAEGESRVNALLGIEAIFGNELPKDAVFVASVMQAYQTLLQKGAKATVAEYATRL

SEQ ID NO: 10198 - protein, 715 aa, Enterobacter cloacae
AAIPPVTTIASEAEEPPVHNDKHYPFIKVSMTALALLVAPLALQAQDKATEASQGTQESLNIDAADQQAPGTTKTTDDASTGSGDGKNVASASQPATPLVPGTPTWDSFHGQLNAQKYSPLTQITADNVGKLTKVWEFHTGDVSDGKGDTPATVWSATPIFANDTLYIGTPFDRLIALDPGTGKEKWHYDTKSSRKALTQPVLKNRGVSYWQAKNPVSGEACQKMVYMGTVDGKLFALDADSGKPCSGFANNGVLDLNQWNTVNAKYPLSVLQPPTVVGNHLLVGWAGKDWAYAEAPPGTVFSVNAQTGKLEWTFEAIPAEIRKRTGTANVWTHMSADEANGLVYLPVSSPSPNYWGGNRVDAIPLGTSTTALDINTGKVVWSRQWVHHDVWDYDINSAPTLMDITVDGKQIPALIQATKQGFLFVVNRLTGEDVWPIEERPVPQGDGSVQGEVLSPTQPFPTKPAPLLDQSKKPEIWKLADIVGGGQCSRLWDNLTYEGMYTPPTTKGEGTLTYPDSAGGVQWGGVAFDPQKQIAIVNTSHIVQYVKLYSREDYDNADKDSGNESGFAPQEGAPYGMRLLVASNWLGMPCWQPPFGEIVALDMHTGDVKWRRPVGASQQYGFFMPESWGSPTIGGPAVTAGGVIFIGASMDAKVRAYSVESGEELWSDQAEAPAVANPSVYEYKGRQYVAFVAGGNTILKDQVGDQVVVYALPE

SEQ ID NO: 10199 - protein, 66 aa, Enterobacter cloacae
GTTMKKRAGVLTVAVVALLSGCTPRIEVAAPKEPITINMNVKIEHEIHIKVDKDVEALLKSRSDLF

SEQ ID NO: 10200 - protein, 197 aa, Enterobacter cloacae
EGATYRTPRADAGRDAVSPARLPRPAVVKEDAMQRLVDIAPAQIPQIWALLSQIPDPEVPVLTITDLGMVRSVKAQGEGWVIGFTPTYSGCPATEHLLGAIRETLTGNGFSPVHIVLQLEPAWTTDWMTDDARRRLREYGISPPVGHSCHAHVPAEVSCPRCASTDTSLISEFGSTACKALYRCNTCREPFDYFKCI

SEQ ID NO: 10201 - protein, 260 aa, Enterobacter cloacae
CEGDGMSELIVTRHGRVLQLTLNRPAARNALNNALLLQIAEQLEAAAADAEIAVCVMYGNERCFAAGADLNEMAEKDLPATLNDIRPQLWARINAFTKPLIAAVNGFALGAGCELALLCDVVIAGDNARFGLPEITIGIMPGAGGTQRLIRSVGKSLASKMVLTGESITAVQAHSAGLVSDVYPASLTLEYALKQAALMARHSPLALQAAKQALRQSQEVPLQAGLAQERQLFALLAATDDRREGINAFLQKRTPDFKGR

SEQ ID NO: 10202 - protein, 526 aa, Enterobacter cloacae
SSRRSTPPKPTPSTPSLIWSATINAWPDAATTTGKASARSWQNARRTLRGNNMVNIHTVAVIGSGTMGAGIAEVAASHGHPVLVYDIDAAAISRAVDGIRQRLSSRVARGKLSADAGEQILARLTPVTNISALAKADLVIEAASERLEVKKALFTQLAEVCPPQTLLASNTSSISVTAIAAEINHPERVAGLHFFNPAPVMKLVEVVSGLATSPEVADALCELALSWGKQPVRCQSTPGFIVNRVARPFYSEAWRALEEQVATPEVIDAALRDGGGFPMGPLELTDMIGQDVNFAVTCSVFNAFWQERRFLPSLVQQELVLAGRLGKKSGQGVYRWLEDKPAVRWLAPVSDSFNPMRVQRRSDGVTEIDDLLLIETQGETAQSLALRHGCPVVVVDRIERDVAVIAAAPGNPHAATQKAIYCLQHQQKRVVQIADYPGLLVWRTVAMIANEALDALQKGVASEQDIDTAMRLGVNYPCGPIAWGERLGWQRLLTLLENLQRHYGEERYRPCSLLRQRALLESSYES

SEQ ID NO: 10203 - protein, 429 aa, Enterobacter cloacae
NSEPTTENRRSFSREIAPHRRQYDRRSLMRDAFICEGVRTPVGRYGGGLSSVRADDLGAVPLRALLARYPQLDLERIDDVIFGCANQAGEDNRNVARMSSLLAGLPQTVSGTTINRLCGSGLDALGFAARAIKAGDGDLLIAGGVESMSRAPFVMGKATAAFQRQAEIFDTTIGWRFVNPLMHQQYGTDSMPETAENVAELLNISRADQDAFALRSQQRTARAQQNGVLAQEIIPVQVAGKKGAVTEVSVDEHPRAETTLEQLAALKAPFRKNGVVTAGNASGVNDGAAALIIASEPMALAQGLTPRTRIVAMATAGVEPRLMGLGPVPATRKVLERAGLSITDMDVIELNEAFAAQALGVLRQLGLPDDAEHVNPNGGAIALGHPLGMSGARLALAASNELHRRGGRYALCTMCIGVGQGIAMILERV

SEQ ID NO: 10204 - protein, 661 aa, Enterobacter cloacae
GHSMKLTLIAKHLALAGVLTSLSLSSFAEVQPQDATATTRQVNNALYNKLPFADKTDFENAHKGFIAPLPQNMIKGEQGNVIWNPAKYDFVKEGEKAPDTVNPSLWRQSQLINIGGLFKLTDGVYQIRNLDLSNMTIIEGEKGITVIDPLLSAEPAKEALDLYYANRGKKPVVAVVITHSHVDHYGGLRGVVDEADVKSGKVKIYAPDGFMKEAVSENIMAGNAMSRRARYMYGNLLKPDAKGQVGAGLGTTTSAGTVTLIPPTDYITHTGQEEVIDGLTYDFMMAPGSEAPSEMLWYVKEKKMIEAAEDVTHTLHNTYSLRGAKIRDPLAWSKYINAAIERWGADAEVIIAQHHWPTWGNENIVKLMKGQRDMYRYINDQTLRMANKGLTRDEIAAEFKLPESLEKQWASRGYYGSVSHDVKATYVFYLGWFDGNPATLDELPPELAEKKFVQYMGGADAIMQKAKADYQQGNYRWVAQVVSKVVFADPNNQAARNLEADALEQLGYQAEAGTWRNFYLTGAQELRNGVKKLPTPNTASPDTVRAMTPEMFFDYLGVHINGVRAGNAKAVFNVDLGKDGGKYKLELENGVLNHTANAQAKDADATITLDRTTLNNIILKKETLKQAMDKGDVKVSGNGAKLEEMLSYMDTFDFWFNIVTP

SEQ ID NO: 10205 - protein, 315 aa, Enterobacter cloacae
CAVAAGRSLCGHLDDALVAPAYCPGCSATAAGLLRGRHARRSHCSPAGLLRCRRDDLRTSPDTRLGRTRREAESEIMKTVLITGASSGIGAGLAKSFADDGYRVIACGRDAQRLAAVHQHSPNITVRLFDMTDRDACRQALADCAADTVILCAGTCEYLDRGEVDAELVARVMTTNFMGPVNCLAALQPQLVSGNRVVLVSSMAHWLHFPRAEAYGASKAALTWFADTLRLDWEPKGIAVTVVSPGFVDTPLTRKNDFPMPGRVSVGDAVHAIRRGLAKGKDHIAFPAGFSLALRLLSGLPDVLQRALLRRMVRP

SEQ ID NO: 10206 - protein, 250 aa, Enterobacter cloacae
TLSRPGRATEMNSCLYHGTLRHRRLAPKAHHFTYSVFMAWLDLDELDALPSVGVRRNRVAPAAFYDADYPLGTPLKEHVLERLENLTGERPAGRVMLLTQLRYFGFHFNPVNFYYCYDGEDTLRWVLAEVRNTPWNERHYYAVAGRDAPPTQKAFHVSPFNPMDMVYHWRFNSPDSTLRMHIENHQETKVFDATLTLRRAPLTRAALRSLLARIPLMTLKTVFAIYWQALRLWLKRVPLHNHPLSRSERS

SEQ ID NO: 10207 - protein, 320 aa, Enterobacter cloacae
SLLDAGGAVSRAGAGHLDRAGGACLAVITAITPGIRPCAGGVGCAAGRPLGADGADCVHRRVPDAAMDGGAVANVCHRLDAPDPHDHLARMVADGAGDSGRTGSLPDRRASWGHYVSGADLYRRQLDVPRLAGADAVFPPVDGETTMRNLVLMLALSVFTCTVQAADWLSWRKVGDATLTWGPFIVYTSQLLTPDGSYTGLDGDNALIITYARDIDGDDLVEATRDQWQAQGILQQEPQSEAWLRMLSTLWPDVTPGTQLAFVVNNGQGQFWYRPTASQKKFTPLGPRQTAAFSSRFLAIWLDPRTEYPELRQQLTGGAQ

SEQ ID NO: 10208 - protein, 181 aa, Enterobacter cloacae
TNMTKLTLQEQMLKAGLVSSKKMAKVQRTAKKSRVQAREAREAVEENKKAQLERDKQLSEQQKQAVLAKEFRAQVKQLIEMNRITVAKGNITFNFTDGNLIKKIEVDKQTQTQLINGRLAIARLVINAKGDCDYAIIPAVVADKIAQRDADSIVLNSALSQEEQDEDDPYADFKIPDDLMW

SEQ ID NO: 10209 - protein, 281 aa, Enterobacter cloacae
RAERGIIDGSVCCKEVTMTMALFPCLPGPTLDAVNTVGAWLAQDDYQDNQPVDLVILAGNAVVPAIDAACKNAAEQGVPLIISGGIGHSTTFLYAAIAKHPRYNRIPTTGRAEAAILADIAREFWNIPAEHLHVEDQSTNCGENARFSRALMKQSGLNAARVLVVQDPTMQRRTMATFARVCRDEAAAPAWVSHPGLTPVLQNSDDGLVFSGPAEGLWPVERYLSLVLGEFPRLRDDINGYGPAGRDFIAHVDIPADVDAAWQILRNDVILTDALVSRSLL

SEQ ID NO: 10210 - protein, 327 aa, Enterobacter cloacae
NMSHRKWDGAIAMRNLALWYRRFGEPESVLQAETTPLSPRQPGEIRVRMLFSPVNASDLIPITGAYRHRTPLPAIAGYEGVGIVTETPAAYPALLGKRVLPLRGQGTWQRYVDCPAAYAVPVPDDVDSLLAARAYINPLAAQMMLDRYPPVGKTVLLTAAGSDCAVLLGQWARQAGAEAVYGIHRSPVHAQRLAEKGIVPIAQHDMAAVNAAAARADVVYDATGGSLAETILSVMPETGTFVCYGLLSGQTFRQQRPLPRVAWFHIRNYLDALSAEAWQAEFRRIWPKLRASQCSDVTLYPLSEWQRAVGNYREAGRTGKPMLSMDN

SEQ ID NO: 10211 - protein, 143 aa, Enterobacter cloacae
FPIFWFAVRSEPRWIIFSSRRKNMFYWILLALAIVAEITGTLSMKWASVSDGSTGFILMLVMITLSYIFLSFAVKKIALGVAYALWEGVGILLITLFSVMLFDETLTTMKIAGLTTLVAGIVLIKSGTRKPAKQQKEQTHAAV

SEQ ID NO: 10212 - protein, 151 aa, Enterobacter cloacae
MFSFDAGVRLGPDDCRAHHARYGDGCVDALAHFRRYGFTQTPADLDAHPCIAYQFADGNHYQWELVQDGKRVTHRPEGQWAFSDSYMEAEAARLGLGLAYVPVELMGDDPERGTLIRVLQRYSLRMDGLYLYYPHRNVSPALRAVIDTLKI

SEQ ID NO: 10213 - protein, 152 aa, Enterobacter cloacae
PFIGKGVRLMYKKILMPVDVFEMDLSDKAVRHAVNLAKAEGATITLVNILPNSSRSLLRGFNADIKKFEEYMTAESDKKMKALKRLFDMSPENIDCEVRFGNVRDEIIKLSKEGKYDVIVIGSRNPSMTTHLLGSNAETILRYATIPVLVVR

SEQ ID NO: 10214 - protein, 60 aa, Enterobacter cloacae
EVKMKVDALTQKAEEEISALIAKKIAELRKKTGQEVSEIEFIAREAMTGLEGYEVKIKLL

SEQ ID NO: 10215 - protein, 881 aa, Enterobacter cloacae
LPMKGKYKAAIALLLLLLLVPLTLLMTLAQWVPTLAGIWLPVGTRIAFEESPRLTRHALIIPDLRYLVEECEIARVENVTLSHPSRWDLDIGALELNSVCLSKLPQSASSTVAPKTLAQWQAILPNTWLTIHRFTLSPWQQWEGELHASLTPARQDITYNGEQVSIKGQLRGQTLSISQFDVQLPDQPQPVKLIGEFTLPLVPDGVPVKGHTVATFNVPQLSSLVDADLDWEDNQGQLVVMARDNPDPLLDLPWQITAQQLTISDGRWNWSASGMPMSGRVGLKVDNWQQGLEKATFTGRLNVLTQGDAGKGNAVLNIGPGSLSMENSAMPLHLSGEAKQNDLILYARLPAKLTGSLYDPQLTFEPGALLRSRGRIIDSLDIDEIRWPLAGVKLTQKGVDGRLQAILRAHENEMGNFELHLDGQANDFLPDNGLWQWRYWGKGNFTPMNARWDVRGTGEWRDNVIELTDLSTGFDKLQYGTMLVSKPRLVLDHPVRWSRDPDNPTFSGALALNAGQTSFSGGSVLPPSVLTFSVDGTDPTVFQFKGNLHADDIGPVQVNGRWDGERLRGKAWWPKQSLTVFQPLIPPDWKMTLRGGEMYAQVAFSAASDQGFEAGGHGVLKAGSAWMPDNEINGADFVLPFRLSQDTWSLGTRGPVTLRIDEVKNLVTARNITADLQGDYPWTEANPLLLTNVKVEALGGKITMQQLRMPQHDPALLRVDNISSSELISAVNPKQFAMSGPVSGALPFWLDNEKWIIKDGWLTNPGPMTLRIDQDTADAIVKDNVVAGAAINWLRYMEISQSWTKLNVDNLGVLTMQAAIKGTSRVEGKSSFVNLNYTHEENIFTLWRSLRFGDNLQTWFEQHAAIPLLRGSTGKESEEQQ

SEQ ID NO: 10216 - protein, 115 aa, Enterobacter cloacae
NPAAICSEDAMKRLALMLLALGMNVHAATLTLNDARAQGRVGETLSGYLAPVQHDAETLALVSRINAARTESYQQLADSNNLPVDEVAKMAGQKLVARAQPGEYVKGINGKWLKK

SEQ ID NO: 10217 - protein, 257 aa, Enterobacter cloacae
WYRAYVRLGMNNVSAYALCLGDNGLVLSQRLGAWCGHAPELEIDLALANIGLDLLGQARNFLTYAAEREGKGDEDTLAYGRDERQFRNLLLVEQPNGSFADTIARQYLMDAWNVALYERLIHSSDSQLAAIAAKAIKEARYHLRFSRGWLVRLGDGTETSAQKMQQAVDSLWRFTAELFDADEVELALIDDGVAVDPRDLRDPWEREVFAGLAEATLRVPEEVAYRTGGKKGLHTEHLGPMLAEMQYLQRVYPGQQW

SEQ ID NO: 10218 - protein, 399 aa, Enterobacter cloacae
AARAVRAPIPRLSVNLDPRPAKRSTAAIPAVSPSTISNVFEAAMTTFHSLTVAKVEPETRDAVTITFAVPQALQEAYRFRPGQHLTLKASPGGDELRRCYSICRSTACGEISVAVKAIEGGRFSRYARDEIKPGMALEVMVPQGHFGYQPQAEREGHYLAIAAGSGITPMLAIMSATLATEAHSHFTLIYGNRSSQSMMFRRALADLKDKYPQRLQLIAIFSQETLDSDLLHGRIDGEKLQALAKTLVNFRQYDEAFICGPSAMMDEAEAALQALGMPEKAIHLERFNTPGTAVKRTASVQADGQKVTVRQDGRDREITLTADDESILDAALRQGADLPYACKGGVCATCKCKVLRGKVDMATNYSLEPDELAAGYVLSCQALPLTADVIVDFDAKGMA

SEQ ID NO: 10219 - protein, 170 aa, Enterobacter cloacae
RCWRTCNVTTARNAIAPVHCCASVRFWRVAMSHNAWHNARAMYERDACAQAMGMDILDMGEGYSVVTMTITPQMLNGHKTCHGGQLFSLADTAFAYACNSQGLAAVASGCAIDFLRPGFAGDKLTATARVKHQGKLTGVYDIEIQNQQQKTVALFRGKSHRTGGSMTGEA

SEQ ID NO: 10220 - protein, 325 aa, Enterobacter cloacae
EKCHNAGNTCAGNALMIDAGHISIRALLIFIDVYETQNFSVVARREGISASQVSRVIHQLEDALGQQLFYRNTRAIMPTESGHLFVRYARAMAGNMEDARRELDERAREPSGTLRINGPVFFGQRHIAPGLPGLLARYPRLSIELTLTDDFIDPHRDAADVIFRIGALTDSSFHARVFGQQFYHLAASPDYLQKHGAPEGPDDLSRHHCLVYRGSSGPNRWLIRQPGEAWVHYPIVPLMTSNNAETLLIAALGGMGVVLFPDWMVSERLKSGELVALLPEMECSINTEPLTIAAIYPNARHPPLNVRAVIDYYIERFGTPLYWQT

SEQ ID NO: 10221 - protein, 161 aa, Enterobacter cloacae
LQEQVMTVPVQHPMYIDGQFVAWQGDAWIDVINPATEEVISRIPDGTAEDARKAIDAAERAQAGWEALPAIERASWLRKISAGIRERVSEISALIVAEGGKIQQLAEVEVNFTADYIDYMAEWARRYEGDSFRATVDMPGAKVVRTIQSDSRHARGEGSAY

SEQ ID NO: 10222 - protein, 555 aa, Enterobacter cloacae
KVNHVMRLPQRDPYAPREWQPHEKPALLGSPSTPEHPTPKRIAYGVVGLLVCLTGALGNAVVTANLQNLQGTFGAWSTEIAWLPAVYVMTNVSINLLLVKFRQQYGLRAFTEGFLVLYVLVTFFHLFVNDLSSALMVRAAHGMVAAALSSLGIYYQIQAWPAKHRLKALTIGITGSSLAIPLARLFSTELLQLDEWRGLYFFELGLALISLACVMVLKLPPGDRRKVFEKKDFITFFLLAPGMALLCAVLSLGRLDWWFEAPWIGWALALSLVLIVSAIVFEHNRSNPLLNTRWLSSGSIVRLGLIMLLIRIVLAEQNTGVIGWLQYVGLQNEQMTHLAWAIFAGIVCGIVTSCLTIKPTKLAWPIITSLVLMIVASLLDSQSNNLTRPDQLIFSQFLLGFGSAFFLAPAMLAAIGGVIADPRNLVSFSVMFGMSQNLGGLLGSAILGTFQTWREKYHSSLLADQLTTLNPLVNERIQLYTQMYKSLIGDSSLLGTQAITQLQTVTALEANILAYNDTYLLTASIATATLVWILWRLLRLRITARMALKNATGNK

SEQ ID NO: 10223 - protein, 483 aa, Enterobacter cloacae
AGGVPAAAPWHVGAGDHRHAGGETMTLRPIAGLLMMAILAGCQSVDVEPAKSSLHIPAQWRATSGPASPTEQLWWRNFHDSNLNRYVDQALKNNSDVLIARERINEYQARVFAADGSLFPSLDAGVTGTRARSQSAATGLPVYGTLYKGSLTASYDVDIWGVNRSTSRAAEASLEAQKAAAAAADLTVASSVASGYVTLLSLDEQLRVTQSTLKSREEAFNLAKRQFETGYSSRLELMQSDSELRATRAQVPLLQHQIAQQENALSLLLGSNPGDVARGESFDALTPLKLPSQLPSTLLNRRPDIVQAERQLIAADATLAASRASLLPSINLTATGSVQDRTLSGLLDNPLQLWSVGGSILAPLLNRQALNAQVDISQSQRNQALYSYEKTVRNAFAEVNDSLDAITRYQEQLTELLAQQAVAQETLRIAQNRYRNGYSSYLDVLDAQRTLFSVQTSVVQVKNNLLLAQIDLYKALGGGWSSA

SEQ ID NO: 10224 - protein, 231 aa, Enterobacter cloacae
FGGYCCYTRYHGKRCGERLSVNFQDIHTYYQQLNIGQFFPHMLCKGEALTVAANKKLTVEPGYIYFCTEGSLTILMPDDGLNIGNTIEYMPIGLMERYCPLAKYEYRSSAKVKLVRISWVDFDQIFFQGGPERMQALATILTYMSIFTIDLHNERRQVTSYQTIKPMLYRYLYRQETHTGENEGLALFIIKRTNLSRTHVFRVLADLKAGGYITMKRGKLVSIDRPLPDAY

SEQ ID NO: 10225 - protein, 696 aa, Enterobacter cloacae
FEIKLFIVKSRNIWREEMQQLASFLSGIWQSGRGRERTITHAISGETLYQVTSEGLDMAAARRYAIEHGGEVLRAMSFIERAAMLKAVAKHLLSQKDRFYALSAQTGATKADSWVDIEGGIGTLFTYASLGSRELPDDTLWPEDELIPLSKEGGFAARHVLTSKSGVAVHINAFNFPCWGMLEKLAPTWLAGMPAIIKPATATAQVTQAMVKAIVESGLVPDGAISLICGGAGDLLNHLDSQDVVTFTGSASTGQSLRVHPNIVAHSIPFTMEADSLNCCVLGEDVTPEQPEFTLFIREVVREMTAKAGQKCTAIRRIIVPEAQVEAVSQALIARLENVVVGDPAQEGVKMGALVNSEQRADVQEKVDHLLASGCQIRLGGKADLQAPGAFFPPTLLFCPQPDETPAVHATEAFGPVATLMPCRNTEHAMQLARAGGGSLAGTLVTADTRVARQFIAGAARAHGRIQILNQESSKESTGHGSPLPQLVHGGPGRAGGGEELGGLRAVKHYLQRTAIQGSPSMLAAIGKQWVRGAEVQEDRVHPFRKYFEELQPGDSLLTPRRTLTEADIVNFACLSGDHFYAHMDKIGAAESIFGERVVHGYFLISAAAGLFVDAGVGPVIANYGMENLRFIEPVKPGDTIQVRLTCKRKTLKKQRTAEEKPTGVVEWAVEIFNQHQQAVALYSILTLVARQQGDF

SEQ ID NO: 10226 - protein, 76 aa, Enterobacter cloacae
RISTRGENTMMTYDRNRNAITTGSRVMISGTGQFGVIKAIHSDGLNAEQVRRGKTVEVEGCEGKFEPIELIRLGMH

SEQ ID NO: 10227 - protein, 312 aa, Enterobacter cloacae
RDLPKWLLWARNIPHYYKIRFLNFRVNIMIYDCFLYYDEDMLLDIRLHTLADVVDRFVIVEATHSFTGIPRELHFDITKFAKFKDKIIYVPFDAQPILNRADNNQVDAWANEAALRNSIMNGLKDAADDDLILVSDVDEIFSPDTVRAINPRALCTTIHQNVFNYQFNLQVHNTDGTPRKCTLPRATSYYNLKHFFHGEPESFRNWKRARKDKNWSWFKWNWLKINNKIVKDGGWHFSWVMTPERISEKMSTISHTEYDLPEFNNPEHIMKVITNAEDIWGRDRKLVRQEVSKRTLPSYLVDNQHHYSQFIL

SEQ ID NO: 10228 - protein, 115 aa, Enterobacter cloacae
PCYAYSLHSEKELQMKRLPWITALLLMSASPALLAAPDSCERVKSDIQQKIINNGVPESGFTLNIVPNDQADQPDAQVVGHCANDTFKILYTRTSSGNYPVSGAGTQENAPAEPQ

SEQ ID NO: 10229 - protein, 89 aa, Enterobacter cloacae
PCGCRATRYQKWGYGARLQRPRRSAHCCESHPAHHARRKRDGPGRWHDANMNGDRVDHGSCINTLTTHRPSPLAKGNPQHTNLVQIEKA

SEQ ID NO: 10230 - protein, 260 aa, Enterobacter cloacae
AFRQSSNRRYSLLIKLKKERTHQEDRRLALWLATSAGLLNAIALGAFGFFPSHMTGNTSQLSSEVSSTDLSDILFFGAIILSFVSGAIAARIIVIWGIIHNIRLVFSQVLFVEGLLLAGVSLYEMYFHSFATNQEIIIFLCGLMGIHNSTSTQLSGGRVRSTHITGTLTDAGISLASVMVAMLRRDYSKDTAAQKSQLKTHLTTLFSFISGGIAGLILFREFGFHAMLALGLMLVVVAAFSIVRISWRVRKVRAALSRQV

SEQ ID NO: 10231 - protein, 223 aa, Enterobacter cloacae
QTVAVGGAMETIHYILDNWDYLLTLTLQHLWLVALAVGLAIIIGVPLGILIVRHKWLATPVLGIATIVLTIPSIALFGLMIPLFSLIGQGIGALPAITAVFLYSLLPIVRNTHTALDSLPPGLREAGRGIGMTFWQRLRWVEIPMALPVIFGGIRTAVVMNIGVMAIAAVIGAGGLGLLLLNGIGGSDIRMLIAGALMICLLAIVLDWLLHRLQVVLTPKGIR

SEQ ID NO: 10232 - protein, 500 aa, Enterobacter cloacae
FRHEDFMKNNNYQQLTRTFQRLSRFSHLSSIASWDMFTMMPPGGSAARGEALAEMSVLQHQILTDKKVGEWLAAAADEDLNDVELANLREMTRYYQQATLLPESLVEAKSLAGSRCEHAWRTQRPANDWQGFSANLKEVVKLSREEARLRAEAKGCTPYDALLDIFEPDMTSARLDVLFGDLKSWLPELLAKVVEKQAQRSFVPPQGPFPTATQRELGLEAMKMLGFDFNGGRLDVSAHPFCGGVPEDVRITTRYDEDELLSALFGVIHETGHARYEQNLPRAWAGQPVALARSTAIHESQSLFFEMQLGRSDAFLKHLLPAVHARFGSQAAFSEENFIAWNQRVKPGYIRVDADEVSYPAHVVLRYEIERALINGEIEVDDIPALWDEKMQAWLGLSTKDNYRNGCMQDIHWTDGGFGYFPSYTLGAMYAAQLFHAAKTALPGLQISIAGGDFSALFDWLRQNIWQHGSRFSTSQLITQATGEDLNIRYFREHLTSRYL

SEQ ID NO: 10233 - protein, 486 aa, Enterobacter cloacae
IPFPPDLPRRHSEYNPLPPAPVRRHSSFPLDLCYQYTILYINTVFINGDHNAVFHPTWRYQSELTMFALCDVNAFYASCETVFRPDLKGRPVVVLSNNDGCVISRSAEAKPFVKMGEPYFKQKDRFRHHGVVCFSSNYELYADMSNRVMNTLEEMSPRSEIYSIDEIFCDLTGVRNCRDLSDFGHEMRATVLQRTHLTVGVGIAPTKTLAKLANHAAKRWQLQTGGVVDLSNVDRQRKLMAALPVEDVWGVGRRIAKKLEMMGIKTVLQLADTDIRFIRKHFNVVLERTVRELRGEPCLELEEFAPVKQEIVCSRSFGERITEYDDVRQAICSYAARAAEKLRNEHQHCRFISVFVKTSPFALNEPYYGNSASVKLLTPTQDSRDIIGASVRCLDAVWKNGHRYQKAGVMLGDFYSQGVAQLNLFDDNAPRKNGQKLMDVLDHLNAENGRGTLYFAGQGIQQPWQMKREMLSPRYTTRFADLLTVK

SEQ ID NO: 10234 - protein, 331 aa, Enterobacter cloacae
PCTFPTANRSARHPCGHFCLTTWPIFMFIKVLGSAAGGGFPQWNCNCANCQGLRDGTLQATPRTQSSIIVSDKGKEWVLCNASPDISQQIAHTPELNKKEVLRGTHIGGIILTDSQIDHTTGLLSLREGCPHQVWCTPEVHEDLSSGFPIFTMLRHWNGGLIHHPIAPLTAFSVEACPDLQFTAVPIASNAPPYSPWRDHPLPGHNVALFIENRRNGQTLFYAPGLGEPDDAILPWLKKADCLLIDGTVWQDDELQATGVGRNTGRDMGHLALGDEHGMMALLASLPAKRKILIHINNTNPILNEQSPQRHALAQQGIEVSWDGMNITLQD

SEQ ID NO: 10235 - protein, 402 aa, Enterobacter cloacae
RRALPLPRWSGFYGACCACASPPVWPLRTPLATSNDYFSGEVMSQQDAAKEQANTRKNVRVVSIFTAAAIGIVGVLVILYAWQLPPFTRHAQFTDNAYVRGQTTFISPQVNGYITEVHVQDFAQVKKGELLLQIDDRIYRQRVHQAEAQLAMKIAALNNNLQQRRSAEAVIAKNEAALKNARAQSLKTQADLKRVKELTADGSLSIRERDSALASAAQGSADIDQAKATLEMSRQDLQTVIVNRGSLEADVENAKAALELAQIDLQNTRIVAPRDGQLGQIAVRLGAYVAAGTHLTTLVPPQHWVIANIKETQLANLRVGQPVKFTVDALNDKAYQGRVESISPATGVEFSAITPDNATGNFVKIAQRIPVRIEVLGEPEAYRLLRPGMSVQVTIDTREAKQ

SEQ ID NO: 10236 - protein, 285 aa, Enterobacter cloacae
RYRLRPGSGYQSAVRRESRYRQPGRCLRSPPLTARWEGFSFPAYFVSSAPTLQPGGLMSVIIDTFIAPPCHDDIEILWQDEHLLLINKPSGLLSLSGKNPQNRDSVHHRLVQTFPGCTLVHRLDFGTSGLMVIARNKAINAALCHQFSQRAVSKVYTALLCGHVEQDEGTVDAPIAKDQALFPLMTICARTGKPARSRYRVMERIYQDTTMPLTRVELTPETGRTHQLRIHCQQLGHPILGCDLYGGLEWPGAEETPRLMLHASVLNFIHPLSGETINACHAAPF

SEQ ID NO: 10237 - protein, 346 aa, Enterobacter cloacae
KVLLMKTLLPTSTAGSLPKPTWLAQPETLWSPWKLQDEELLAGKQDALRLSLDEQIRAGIDIVSDGEQTRQHFVTTFIEHLSGVDFENRQTVRIRNRYDASVPTVVDAVARQKPVFVDDAKYLRQLTDKPIKWALPGPMTMIDTLYDAHYKSREKLAWEFAKILNQEARELEAAGVDIIQFDEPAFNVFFDEVNDWGIAALERAIEGLKCETAVHICYGYGIKANTDWKKTLGSEWRQYEEAFPKLQTSKIDIISLECHNSRVPMDLLELIRGKKVMVGAIDVATQTIETPEEVADTLRKALQFVDADKLYPSTNCGMAPLSRQVANGKLKALSAGADIIRRELAR

SEQ ID NO: 10238 - protein, 833 aa, Enterobacter cloacae
RWWRASRVTSDTPLSCRVSLRLPGLQLPDRGCDAPPLFFNLARLTNNLADAGKRFSCAPVRITLTLHNKHNKMRSAMGSNSSFSARRTALAMAVALCCAWQSPVYAHGSEAHMVPMDKTLQAFGADVQWDDYAQMFTIVKDGAFVKVKPGANTAIVNGKPLTLQVPVVMKNNKAFIPETFINDVFQSGLDQTFQVEKSPHPLNALTADEINQAVAIVKASADFKPNTRFTQIALAEPEKAKVWDFVLNGTAVDAPRQANIIMLDGKHIIESRVDLKEKKILRWEPIKDAHGMVLLDDFNTVQQIINESPEFAAVLKKRGITDPKKVITTPLTVGFFDGKDGLKQEDRLLKVISYLDVGDGNYWAHPIENLVAVVDLEQKKIQKIEEGPVVPVPLTPRPYDGRDRVETVKKPLEIIEPEGKNYTITGDRVHWQNWDFHLSLDSRVGPIISTVTYNDNGKKRQVMYQGSLGGMIVPYGDPDIGWYFKAYLDSGDYGMGTLTSPLVRGKDVPSNAVMLNETIPDYTGAPMEIPRAIAIFERYAGPEYKHQELGKPNVSTERRELVVRWVSTVGNYDYIFDWVFHENGTIGIDAGATGIEAVKGVQTKTMHDATAKDDTRYGTLIDHNIVGTTHQHIYNFRLDMDVDGINNKLVAMDPDVKPNTAGGPRTSTMQVNQYDIDTEQQAAQKFDPGTIRLLSNTSKENRMGNPVSYQIIPYAGGTHPVASGAKFAPDEWIYHRLSFMDKQLWVTRYHPDEMYPEGKYPNRSTHDTGLGQYSKDNESLNDQDNVIWMTTGTTHVARAEEWPIMPTEWVHTLLKPWNFFDETPTLGKKKEQK

SEQ ID NO: 10239 - protein, 678 aa, Enterobacter cloacae
HTFTRIRSLHKQRHSLLRGFRMRINEIVRSLALAGCFISTSSAWAAEAPKDASAATQQANNALFNQLPFSDNTDFTNAHKGFIAPLPQEIIKGEQGNTVWDPQQYAFIKEGDKAPDSVNPSLWRQSQLINISGLFEVTEGVYQIRNLDLSNMTIIEGKEGITVVDPLVSAETAKVGMDLYYKNRGNKPVVAVIYTHSHVDHYGGVRGVVDEADVKSGKVKVYAPAGFMEAAVAENIMAGNVMSRRASYMYGNLLKPDAKGQVGAGFGTTTSAGTVTLIAPTNIIEKDGQKEVIDGLTYDFMLAPGSEAPSEMLWYIEEKKLIESAEDVTHTLHNTYSLRGAKIREPLPWSKYINQAIVRWGDKAEVIMAQHHWPTWGNENVVNLLKSQRDLYRYINDQTLRMANEGLTRDEIAANFKLPNSLANTWANRGYYGSVSHDVKATYVLYLGWFDGNPATLDELPPEEAAKKFVEYMGGADAILSKAKTDFDQGNYRWVAQVVSKVVFADPNNQAARNLEADALEQLGYQAESGPWRNFYLTGAQELRNGVVKGPTPNTASPDTVRAMTPEMFFDYLAVHINGEKAADAKSVFNIDLGSDGGKYKLELENGVLNHTANAEAKDADATVTLNRDTLNKIILKEVTLRQAQDNGDIKVTGDAAKLDAMLGYMDKFEFWFNIVTP

SEQ ID NO: 10240 - protein, 385 aa, Enterobacter cloacae
RQHSRAEVPPAQGKFSSMEKRHPATPEPATWPTRKSMVVHGLAVNLPWLAFVNASFALMVLLRNSLFGHIDALLHISPPLRQMIDASMLGVVILSVALVIMAWRHIRGVSAVLFMCSLLWSISCYWFINVLHLPHPWPIFVTLLMAGMTALYFHPVALLCFTVPLWISLPVASMLLNQEINYRFAGLWVVFTFILVCGRYILLSWFEEAWRRNQQNQRLISRLDALAHQDPLTKTANRRAMELVLENAVEQGKRFAVLMLDVDYFKLYNDTYGHQAGDACLARVAEVLNTSVRTPEDVVSRYGGEEFVVILFDCEESVAEKVAARIQAGLRTAAIAHSASKVSECVTVSMGIAGYTAGLAGPEIIARADAALYRAKEAGRDRWSR

SEQ ID NO: 10241 - protein, 145 aa, Enterobacter cloacae
FRKLPVISPSITHAGSASFSTMAGFLPPSSSVTPVSVSAATRAICLPVAVEPVKLTLAMRGCEVSAAPQTAPLPVTTLNTPSGIPASLASSATRNRVSGVVSEGLITMEQPAASAGITFHMPIISGKFHGTIPATTPTGSLRVHA

SEQ ID NO: 10242 - protein, 316 aa, Enterobacter cloacae
MQQCENSDGAARTSMACASEQDNFQQWLAQINQVCGRFAARPLEGAFLGELETSYTQSLKLSTVTAAGVNLFRTRQEIKNGNDAWFYTVFQLEGSAGIEQDNQRAMLKAGDITLIDASRPCSIYWQERSRQISLLLPRQIIEQHARFQEVRCALPLSSSLPTVQLSYRLLQESMGNADLSASESEAALEAMVCLLRPAFQQQHEVLPRKERQFRHVLSLIDDHIQSEALRPEWIASESGMSVRSLYRMFAGKGLVVAQYIKNRRLDLCAQALRSISDDEKLAGIGYSWGFTDHSHFSTAFKQRFGVSPGEYRKRYR

SEQ ID NO: 10243 - protein, 339 aa, Enterobacter cloacae
RGSKITGESLMKLAVYSTKQYDKKYLQHVNETYGFDLEFFDFLLTEKTAKTAHGCEGVCIFVNDDGSRPVLEELKKQGVKYIALRCAGFNNVDLDAAKELGLKVVRVPAYSPEAVAEHAVGMMMSLNRRIHRAYQRTRDANFSLEGLTGFTMYGKTAGVIGTGKIGVAALRILKGFGMRLLAFDPYPSAAALELGVEYVDLKTLFSQSDVISLHCPLTPENYHLLNQSAFDQMKDGVMIINTSRGGLIDSQAAIEALKTQKIGALGMDVYENERDLFFEDKSNDVIQDDVFRRLSACHNVLFTGHQAFLTAEALISISETTLGNLQQLDKGEACPNAIV

SEQ ID NO: 10244 - protein, 279 aa, Enterobacter cloacae
NMAFVTTKDGVSIYYKDWGPKDAQPIVFHHGWPLSADDWDNQMLFFLAEGFRVIALDRRGHGRSDQVSEGHDMDHYASDASAVVESLDLRNAVHVGHSTGGGQVARYVAKYGQPQGRVAKAVLVSAVPPLMVKSDTNPGGTPIEVFDGFRQALAANRAQFYLDVASGPFYGFNRDGAEVSQGTIQNWWRQGMIGSAKAHYEGIKAFSETDQTDDLKAITVPVLVLQGDDDQVVPYKNAALLQDKLLANSELKIYPGFPHGMHTTHADTINADILTFIRS

SEQ ID NO: 10245 - protein, 231 aa, Enterobacter cloacae
LEVSMCGRFAQAQTREEYLAYLADEGERDIAYDPEPIGRYNVAPGTKVLLLSERDKQLHLDPVFWGYAPGWWDKAPLINARVETAATSRMFKPLWQHGRAICFADGWFEWKKEGDKKQPYFIHRADGQPIFMAAIGSTPFERGDEAEGFLIVTSAADKGLIDIHDRRPLVLSPEAAREWMRQDVGGKKAEEIIADGTVPADEFIWHAVTRAVGNVKNQGAELIEVAHKMEK

SEQ ID NO: 10246 - protein, 283 aa, Enterobacter cloacae
WEAGRYRYKLRNHFQVEGMILNDIAIIALAGFTTGITTVLFGFGGGFVVVPFVYQLMLRQTELALNAMHIAVATSTSVMIFNAGWVTYRNWRACELSSQMLFPLLWFIAIGAIVGSCLAGIFSESVVRALFIFYMLTTISDCLLRKGFLGGSSLRRLSFPVVTGGGVTIGMIAALLGVGGSVMTVPLLRRHGYAMRECISASNPLSLPVALCGAVTYAVIGWQTIPVKGFLGFINLKILGMLVLTGWAGIVFSRRVIPAVPDIWHARIYVMLLFLVLLAMLFQ

SEQ ID NO: 10247 - protein, 202 aa, Enterobacter cloacae
HPALSRSSHWPHGSTVMSTPCDVKLRPLEREDLRFVHQLDNNASVMRYWFEEPYEAFVELSDLYDKHIHDQSERRFVVECEGEKAGLVELVEINHVHRRAEFQIIISPEHQGKGLASRAAKLAMDYGFNVLNLYKLYLIVDKENEKAIHIYRKLGFMVEGELIHEFFINGEYRNTIRMCIFQHQHLAGHKSSSASLLKPTAQ

SEQ ID NO: 10248 - protein, 774 aa, Enterobacter cloacae
VMSEVEHHGGISRRTLVKSTAIGSLALAAGGIALPFGLKSAAAAVQSAIQPAEDKVVWGACSVNCGSRCALRLHVRDDEVYWVETDNTGEDVYGNHQVRACLRGRSIRRRINHPDRLNYPMKRVGKRGEGKFERITWEEALDTIAASLKSVVEKYGNEAVYINYSSGIVGGNITRSSPYASLVARLMNCYGGFLSHYGTYSTAQIACAMPYTYGSNDGNSTSDIENTKLVVMFGNNPAETRMSGGGITYFLEQARERSNARMIVIDPRYTDTAAGREDEWIPIRPGTDAALVAGIAWVLINENLVDQPFLDKYCVGYDEKTLPEGAPANGHYKAYILGQGDDKTAKTPDWASRITGIPAERIIKLAREIGSAKPAYICQGWGPQRQANGEQTSRAIAMLPILTGNVGINGGNSGARESTYTITIERMPLPENPVKTQISCFSWTDAIVRGPEMTALRDGVRGKDKLDVPIKFIWNYAGNTIINQHSDINKTHDILQDESKCETIVVIDNFMTSSAKYADIVLPDLMTVEQEDIIPNDYAGNMGYLIFLQPVTAPKFERKPIYWIMSEVAKRLGPDIHQKFTEGRTQEQWLRYLYDKMVAKDPLLPSYDALKKMGIYKRKDPNGHFVAYKKFRDDPDANPLKTPSGKIEIYSSKLADIAATWELQKDETITPLPVYTSTFEGWDAPERSKFPLQLFGFHFKARTHSSYGNVDVLQAACRQEVWLNPVDAEQRGIKNGDMVRVFNDRGEVRIAAKVTPRIMPGVSAMGQGAGMTPT

SEQ ID NO: 10249 - protein, 206 aa, Enterobacter cloacae
PMTTQYGFFIDSSRCTGCKTCELACKDYKDLTPDVSFRRIYEYAGGDWQEDNGVWHQNVFAYYLSIACNHCEDPACTKVCPSGAMHKRDDGFVVVDEDVCIGCRYCHMACPYGAPQYNAAKGHMTKCDGCHSRVADGKKPICVESCPLRALDFGPIEELRKKHGQLAAVAPLPSAHFTKPSIVIKPNANSRPTGDTTGYLANPKEV

SEQ ID NO: 10250 - protein, 240 aa, Enterobacter cloacae
TDWPWAILWSAYDRRVSNCRLTQVRGATRAQVRKVVMNDVSHRESFAFSARVLGALFYFAPDSEQIAPLVSALTAGDWVQDWPLAEENLLPVASMFKTPSDEALKDAWQRLFIGPYALPAPPWGSVWLDRESVLFGDSTLALRQWMRENHIAFEMQQNEPEDHFGTLLMLAAWLAENGRETERDQLLAWHLLPWSTRFLSVFVENAAHPFYTALGKLAQLTLAEWQSTLLIPIVEKTLYR

SEQ ID NO: 10251 - protein, 96 aa, Enterobacter cloacae
ETRNPDARVSMVTTWDKTFAESDKVDHRKVTFENRYGITLAGDLYIPRNSGDQMLASLLVVVKYTYVYTESNPIPLQRACILGRYLCPPVCSRHQQ

SEQ ID NO: 10252 - protein, 245 aa, Enterobacter cloacae
RMRTGRHTAMHPLLKRSLLFVGAIIVVLALLTWGIGLETIKARQVDLIYLGQQHLILVFSSMFFALLVGIPSGILLSRPAARGIAEYVMQIFNVGNTLPPLAVLALAMVVIGIGDKPAIIALFLASLLPIVRNTYAGLCSVPASLLEAANGIGMTKWQRLRQVEIPNAWPVMLSGIRIATAINVGTAPLAFLIGASSYGELIFPGIYLNDFPTLILGAAATALFALILDTLLAALGRLLSPHLAR

SEQ ID NO: 10253 - protein, 303 aa, Enterobacter cloacae
QGASMRLFSGLTALCAAALFTSQALAAPLILATKSFTEQHILSAMTVQYLQKKGFQVQPQTNIATVISRNAMINKQIDMTWEYTGTSLIIFNHINKRMSPQESYETVKRLDAKHGLVWLKPADMNNTYAFAMQRKRAEAEHINTMSEMVAKIEQIRKTDPDNNWLLGLDLEFAGRSDGMKPLQAAYKMELDRPQIRQMDPGLVYNAVRDGFVDAGLIYTTDGRVKGFDLKVLEDDKGFFPSYAVTPVVRKDTLEANPGLEEALNTLSAQLNNDVITDLNKKVDIDHQSPQQVARDFLRSKQLL

SEQ ID NO: 10254 - protein, 445 aa, Enterobacter cloacae
TEYLHFPTLILWSYPSPETTGMFKQGLCVSRTTTVDIAPASDIDDLPAAPQPVQFIKRGTPQFMRVTLALFSAGLATFALLYCVQPILPVLSHEFGVSPASSSISLSISTGMLAIGLLFTGPLSDAIGRKQVMVTALMLASVCTLLSTMMTSWHGILIMRALIGLSLSGVAAVGMTYLSEEIHPSFVAFSMGLYISGNSIGGMSGRLLSGVFTDFFNWRIALAVIGCFALASALMFWKILPESRHFRPTSLRPKTLFINFRLHWRDQGLPRLFLTGFLLMGSFVTLFNYIGYRLMLSPWHLSQALVGLLSVAYLTGTWSSPKAGAMTARFGRGPVMLVSTAVMLFGLLMTLFSSLWLIFAGMLLFSAGFFAAHSVASSWIGPRARRAKGQASSLYLFSYYLGSSIAGTLGGVFWHNYGWNGVGGFIALMLCAALLVGASLHKRLH

SEQ ID NO: 10255 - protein, 280 aa, Enterobacter cloacae
LPPPECDMRKSVVLLLGTFSLFAGFSHADDGDDDAISAKEVKTLFFGHDDRTRVTDPTESPWDAIGQLETASGNLCTATLITPRLALTAGHCLLMPPEGKPDKAIALRFVSQKGIWRYEIHGIEGRVDPSLGKRLKPDGDGWIVPPGAASWDFGLIVLRYPPSGITPLPLFDGDKAALTAALKAADRKVTQSGYPVDHLDSLYTHTDCVVTGWAQNSVLSHQCDTLPGDSGSPLMLKTDNGWQLIGVQSSAPAAKDRWRADNRALSVTGFRDRLEALAQQ

SEQ ID NO: 10256 - protein, 145 aa, Enterobacter cloacae
RGKAESDAGDPSVQTRYPVVDARRDDHGLRATASALSHGHRQSGLAHNPTGISMQKNSIVAFRRGYRLQWEAAQDSHVILYPEGMAKLNETAAAILELVDGQRDAAAIIAILNERFPEAGGVDDDVVEFLQIAYQQKWIIFREPE

SEQ ID NO: 10257 - protein, 765 aa, Enterobacter cloacae
NPGTVTIMTIRIVELAGGLRATLVHQPQATRAAALARVSAGSHHEPPRFAGLAHLLEHLLFRGSQRYQGDDRLMAWVQRQGGNVNATTLARHSAFFFDVAADNLSDGVARLRDMLQAPLLSRQDIQREVAVIDAENRLIQQHDPARREAAARHAMEQPEVFRRFQVGSHDSLGQDTGSLHAALRGFHRRYYGARHLQLWLQGPQTLDALAELAHTFATGFASGGVPEAAPPLRLSAEADYQLAVTERPALWRCPLIRKSDNVTLLREFLLDEAPGSLIDGLRARGLAEEVSLDWLYQDDDYGWLALTLDGERPEAIDAQITRWLRALQQTTQEQQRHYYRLAQQRFSALSPLDQLRQRAFGFAPGAAPVDFSAFCADLLAAPTSYLACKKMETAEIIASQGFALPLSHWRRQPVADESPIAFSFYPQATQYSAPALTPEAVPLLHLPAQAQAPTLILRRPFYSRVSESQGVAIGKQLRPLLAEMRHIGSSGEWQTVDGSWQLTLRLPDAVVMAEPIIGAIIDRLSRPTPAITPAPDGIAIRQLLKQLPERLASEPSRNGWLAALAGGSAGHAHGLARQLGLLRAPVNAKPLPLSDCPGGVEHIPHASADSALLVFIPLPPGASLAALRLLALCCEPRFFQRLRVEQQIGYVVSCRYQRIADRDGLLLALQSPDRSPVNLLGCCKRFLRELTLCDESEFSLLRQQLATQIRSPMDASATAVAALRQRYGLPVLTPQAIDALQPDEIVALWREMTRRRRRWRVLFTG

SEQ ID NO: 10258 - protein, 221 aa, Enterobacter cloacae
IKCQQATGQPPQSNTKQEFPMSKVLVLKSSILAGYSQSGQLSDYFVEQWREQHSADEITVRDLAANPIPVLDGELVGALRPSDAPLTPRQQEALALSDELIAELQAHDVIVINAPMYNFNIPTQLKNYFDLVARAGVTFRYTENGPEGLVKGKRAIVLTSRGGIHKDTPTDLVAPYMTLFLGFIGITDVNFVFAEGIAYGPEVATKAQSDAKAAIDSLVAA

SEQ ID NO: 10259 - protein, 432 aa, Enterobacter cloacae
ISRRSSNNAVNMMNKATTLSANITTRSNWHWQDNIWTLGLYGTAVGAGTLFLPVEIGTRGPVIFLVMLLLGLPLSLIPHLLLCRVYMREEKTENGTLPIFGSFFSGRGEKLITLFYCVTFFPVTLVYGVALINALSNLLVEHLHITALSRGPLSFIVVAALYVVLSKGRDRVVAIMSALALPFAASVLLIAVSLIPGWHLSNLTDTAAEMNATPLPVTLKNIWLTLPLITFSFCCAPMVSPLTSYYRERKAEGEKKALFVIRIAYLAIFASILFFVLSCVLGIPHDNFVRAKAENLNVLSVMKGNGDFSLIYHIAPLIAIIGMTKSFLGVGLSVAQTFGQLAASVSGKKASASKRLASLALFLLTYGIVYANPDVLSLIEMFCGPLIAVILFLIPAYLIYTRPSLAELRGVTGFLVVLGGLATLSALLWTML

SEQ ID NO: 10260 - protein, 81 aa, Enterobacter cloacae
TIMFVELVYDKRNVQGLEGAREIILTELTKRVHRIFPDASVTVKPMQANGLNSDASKSDREKLNRMLEEMFEESDMWLIQE

SEQ ID NO: 10261 - protein, 298 aa, Enterobacter cloacae
PTSFTPVHGISPQSRPACASLQWRHTNVALTTCRRACYVSTTQKALRNSEMIILVTGATAGFGESITRRFVANGHKVIATGRRQERLQELKDELGDSILTAQLDVRNRAAIEEMIANLPAEWREIDVLVNNAGLALGMEPAHKASLEDWENMIDTNNKGLVYMTRAVLPGMVERNRGHIINIGSTAGSWPYAGGNVYGATKAFVRQFSLNLRTDLHGTAIRVTDVEPGLVGGTEFSNVRFKGDDAKADKTYENANALTPEDITETVWWVANLPKHVNINTVEMMPVSQTYAGLSVHRG

SEQ ID NO: 10262 - protein, 235 aa, Enterobacter cloacae
LSEKSQPMAAESQLNPTQPVNQQIYRILRRDIVRCLIPPGTPLSEKEVSVRFDVSRQPVREAFIKLAENGLIQIRPQRGSYVNKISLSQVRNGCFVRQAIECAVVRRAASLINDNQCYLLEQNLHQQRIAIDRKQLNDFFQLDDEFHQKLAQIAECQLAWDTVENIKATIDRVRYMSLDHVSPPEMLLRQHHDIFSALEKRDVEAVDKAMTLHLQEISESVQLIRQENREWFSEE

SEQ ID NO: 10263 - protein, 123 aa, Enterobacter cloacae
SDCLHPFKGNAMTTLSKRLCLAAALALSSFAFAATASAETSKLIIESGDSAQSRQNAAMDKEQWNDTRSLRQKVNKRVEKEWDKEDVAFDARDKCQQSANVNAYWEPNTLRCLDRRTGRTVAP

SEQ ID NO: 10264 - protein, 308 aa, Enterobacter cloacae
LNLTPTAVRRGTPPATWQTRRRCEMGSGWHEWPLMIFTVFGQCVAGALIVMGFVWLKENDDKARMRIVRSLFFLWLVMGIGFMASVLHLGSPLRAFNSLNRVGASALSNEIAAGSLFFAVGGFWWLVSVIGKMPPALGKIWLVVSQLLGIVFVWAMTRVYQIETVPTWYTGYTTLSFFLTMVLAGPLLAALLLRVANVTFKGTLAASVSVLAIIVCVAVVVLQSNTLGTIQSSIQQASALLPDYGSLQVWRIALLAAGLGCWICPLIRRQEPKTLGLFAGVVLVALGELIGRGLFYGLHMTAGLAIAG

SEQ ID NO: 10265 - protein, 150 aa, Enterobacter cloacae
SRLSKKRCTDNSTWLVHPLCRPGSHIFAATQRHNCYTVYNYSIRGCTMAVETKFVVVRKGEEKMTFASKKEADAHDKLLDMAEAFTDWLLQSGMQMDETQAENLGLYLAEQKESVQHILRTSKLPERNAATDKTASDADSSKKIRAVKAA

SEQ ID NO: 10266 - protein, 418 aa, Enterobacter cloacae
YSYVDCGRADDLSFSDCARLVAAPFAGGTDSEGDSIMIKLENLTKQFSQKHGQTFKAVDNVNLNVPEGEMCVLLGPSGCGKTTTLKMINRLITPSSGTILINGEDTSGMDTVTLRRNIGYVIQQIGLFPNMTIEENITVVPRMLGWDKARCKSRAEELMDMVAMDPHKFLHRYPREMSGGQQQRIGVIRALAADPPVLLMDEPFGAVDPINREVIQNQFLEMQRKLKKTVMLVSHDIDEALKLGDRIAVFRQGRIVQCASPDELLAKPANEFVGSFVGQDRTLKRLLLVSAGDVTDQQPTITVRESTPLPEAFATMDDNDIRAITVVDEHGKPLGFVKRREARNASGSCGDILHPFRMTGKAEDNLRVVLSRLYESNTSWMPIVDEDGRYNGEISQDYIAEYLSSGRTRRALNIHSES

SEQ ID NO: 10267 - protein, 471 aa, Enterobacter cloacae
AFRPGTARPFSARIPFANLPISRHNIVSSPLNHDFMQRLHAYPDIRAMFRRLLIATVTGVLAALAVAVFRHSMYLLEWLFLSNESGSLVNAAAALSPWRRALTPALGGLAAGMLLWGWQRMTAQRPHAPTDYMEALETGDGQFDYGASLVKSLASLLVVASGSAIGREGAMILLAALAASFFAQRCTPKSEWKLWIACGAAAGMASAYHAPLAGSLFIAEILFGTLMLASLGPVVIAAVVALLTTRLLSPGANTLYDVHLSEMLTAVDYFLIVGVGLLAGVCGPLLMWLMAASHRLFLRLKLSPPWQLALGGLIVGLLSLLTPKVWGNGYSVVQAFLQSPPLLSVIAGVFICKLLAVLASSGSGAPGGVFTPTLFVGMATGMLFAQIFALWFPGSETAILLGLAGMATLLAATTHAPIMSALMVCEMTGQYFLLPGLLVACVVASVLSRTLRHDSTYGQHTAESREIDVVR

SEQ ID NO: 10268 - protein, 354 aa, Enterobacter cloacae
IKNCSGTSMAKPIITLNGLKIVIMLGMLVIILTGVRFAADIIVPFILALFIAVILNPLVQRMVRLRIPRVLAISLLISIIIVAMVLLVAYLGTSLNELARTLPTYRSSLATPLLQIEPWLQRAGIEVSVEEMLKYIDPNAAMTIVTSLLAQLSNAMTSIFLLFLTVVFMLLEVPQLPAKLQHIMVRPVEGMGAIQRALDSVSRYLVLKTAISLVTGLVVWGMLAALDVRFAFVWGLLAFALNYIPNIGSVLAAIPPILQVLVFSGLYDALILLAGYLVINLVFGNILEPRIMGRGLGLSTLVVFLSLIFWGWLLGPVGMLLSVPLTIIVKIGLEQTAGGQSIAVLLSDMSHKAD

SEQ ID NO: 10269 - protein, 120 aa, Enterobacter cloacae
QVTSAMALIPKNYARLESGYREKALKIYPWVCGRCSREFVYSNLRELTVHHIDHDHTNNPEDGSNWELLCLFCHDHEHSKYTEADQYGTTVVAGEDAQKDVGVATFNPFADLKAMMDKKK

SEQ ID NO: 10270 - protein, 345 aa, Enterobacter cloacae
KTVGCAMAIFDGHNDLLLNLWLHHRQDPVTALFSGIENGHLDYPRMQQGGFSGGLFALFVPPQEYIARMAPQYACEPWQPVDILWQQLTLLKQLVAHSDGRARLCLSAADIERCRQDKVLAMVAHIEGAGGFDGEGGDLQALYAAGVRSIGPFWNIANRFGTGVNGAFPGSPDSGPGLTAEGIALIKHANALNMLIDVSHMNEKAFWDTARHSSSPLVATHSNAHTLCPQPRNLTDRQLLAIRDSGGVAGVNFGNAFLRADGKRDSDTPLSTIVRHIDYLINIMGDDHVALGSDFDGITLPDDLHDVSGLPRLISALRDSGYDQFVLNKLLWGNWQKVLQNVWQQ

SEQ ID NO: 10271 - protein, 280 aa, Enterobacter cloacae
RAVAAASRPCAAGNRSELGRDEHHASGLTMHIRETLSPQEFEHALRAKGAYYHIHHPYHIAMHNGEASREQIQGWVANRFYYQTTIPLKDAAIMANCPDPHTRRKWVQRILDHDGSNGHDGGIEAWLQLGEAVGLSREDLISERHVLPGVRFAVDAYVNFARRANWQEAACSSLTELFAPQIHQSRLDSWPQHYPWIKEEGYFYFRSRLSQASRDVEHGLELAKRYCDSAEKQNRMLEILQFKLDILWSMLDAMTMAYALQRPPYHTVTDKAAWHTTRLV

SEQ ID NO: 10272 - protein, 394 aa, Enterobacter cloacae
NSCKSLINRSGLFSVSQNKPAVNPPLWLLAELTYRCPLQCPYCSNPLDFARQDQELTTEQWIEVFRQARAMGSVQIGFSGGEPLTRKDLPELIRAARDLGFYTNLITSGIGLTESKLDAFSEAGLDHIQISFQASDEELNAALTGNKKAFQQKLAMAKAVKARDYPMVLNFVLHRHNIDQIDKIIELCIELDADDVELATCQFYGWAFLNRQGLLPTREQIARAERVVAEYRQKMAASGNLTNLLFVTPDYYEERPKGCMGGWGSIFLSVTPEGTALPCHSARQLPVDFPSVLEQSLESIWYDSFGFNRYRGFDWMPEPCRSCDEKEKDFGGCRCQAFMLTGNADNADPVCSKSPHHHKILEARREAACSDMKIGQLQFRNRTRSQLIYKTREL

SEQ ID NO: 10273 - protein, 154 aa, Enterobacter cloacae
QQDRFRMTDNNTALKKAGLKVTLPRLKILEVLQGPDNHHVSAEDLYKRLIDMGEEIGLATVYRVLNQFDDAGIVTRHNFEGGKSVFELTQQHHHDHLICLDCGKVIEFSDDSIESRQREIAARHGIRLTNHSLYLYGHCAEGDCRENEHAHDAK

SEQ ID NO: 10274 - protein, 79 aa, Enterobacter cloacae
RRRIAPVLKLRKNPPEKIEAFKSVLNVLKKEKAHEQFATQENVRVMDYQACIQARKTGNDQEVAKRCDKIWNEIRNNNK

SEQ ID NO: 10275 - protein, 141 aa, Enterobacter cloacae
KIDSMYNLRMYSRIGRRNPLYSTAIGKVLLAWRDREEVKQILDGVEYKRSTDRTITSTDELLSVLDNVREQGYGEDNEEQEEGLRCIGVPVFDRFGVVIAGLSISFPTLRFSEERLHEYVAILHTAARKISEQMGYNDYPF

SEQ ID NO: 10276 - protein, 119 aa, Enterobacter cloacae
TMATFHISFKKLRRSEGKSSVYLSAYQNREKTKDNRTGATWDYSKKEGFFGSAILSPAGTPAELVKDSGTLWNAVEAGEKRKDAELCRYLDIAIPKELDDGQKKQIVLDYCQENFVDYA

SEQ ID NO: 10277 - protein, 101 aa, Enterobacter cloacae
MRYIHMSEYIKVFLALCSFVFTGTLAHAASSGTITFTGSVNSETCAAVVNNGNADATVTLPAVPTSALSAAGATAGATTFTINLTGCEFYPSGAKVQRYFQ

SEQ ID NO: 10278 - protein, 152 aa, Enterobacter cloacae
IMLSAARGEDQMNIPYRFADNGGALEVPADKVHELRLRLAQQGLPKGGAVGFELLDQEKFGISQFSEQVNYQRALEGELARTIETLGPVKSARVHLAMPKPSLFVREQKSPSASVTVNLEPGRALVSGGVMRLHESPIICSTSAATSCPARR

SEQ ID NO: 10279 - protein, 158 aa, Enterobacter cloacae
PSDNSAMLEKAIAAVAAAMTDPSRVKMLCALMDGRAWTATELSAAADVAPSTASGHLARLVEGQLITCLSQGRHRYYRLAGHDVAALVEQMMGLSWSRITPPETSARPGSRLTVTEAEGDFCSRTNRDGLGIARCTRALFTGPKVSIVRASSPSSARW

SEQ ID NO: 10280 - protein, 248 aa, Enterobacter cloacae
RLLGKKEPTVNAPVRGLYMWGGVGRGKTWLMDMFYQSLPGTRKQRLHFHRFMLRVHEELTALQGETDPLEIVADRFKAETDVLCFDEFFVSDITDAMLLGGLMKALFARGITLVATSNIPPDELYRNGLQRARFLPAIDAIKQHCDIMNVDAGVDYRLRTLTQAHLWLSPLNADTASEMDKLWLALAGAPRDKAPALEINHRPLSTLGVENQTLAVSFATLCVDARSQHDYGPLSHLGLNQPDRMIYG

SEQ ID NO: 10281 - protein, 112 aa, Enterobacter cloacae
WRNCVRIETSLFTTPECMKAITLYDVARVAGVKKKKKKKKKKKKKKKKKKKKKKVRQAMAALHYVPNRGAQQLAGKRTRTLGLMTSDLALHAPSQMASGLHLEGSRNRESTI

SEQ ID NO: 10282 - protein, 141 aa, Enterobacter cloacae
IPMRHFPGLGIISKLIVLFMPADASMAVIPELTSVPVRITLLVSGIVVNALATGMYIGAGFGAGPRDGLMTGIHARLGWSIRSVRTAIEVTVLIVGYLLGGAFGVGTVLYALTIGPLIQLCLPWFRQRPRIQKAAQPERIV

SEQ ID NO: 10283 - protein, 128 aa, Enterobacter cloacae
NSLCGDWQRSLMMITMAKNLGFSKATLRKVGANSDGDGFLCFAAHGNSMEPVIADGSTVAINCHDKRIVDGKIYGINQGGWKRLKILYRSGPDKVTIRSYNSDEYPDEEVDMDSLEVLGRLFWVSTIF

SEQ ID NO: 10284 - protein, 430 aa, Enterobacter cloacae
RFFGDAMRQLQPKTNAVFGGQYHIAGRDVTYEPATQADGQFAAKGEVITAKWVEAEQLFGCLRQFNGDVSLQPGLVHRANGGLLLISLRTLLAQPLLWMRLKTVVTQQRFDWVGYDDSRPLPVSIPSMPLSMTVVLTGDRESLADLQEMEPELAEQAVYSEFEDNIQIADADDMAQWCQWVMAVAERFALPSPAEDAWPGLIREAVRYTGDQETLPLCPLWIGKQLREVGVISGNGPFTGEQLSQMLAQREWREGYLADRMQDEILLEQILVETEGERIGQINALSVIEFPGHPRAFGEPSRISCVVHIGDGEFTDIERKAELGGNIHAKGMMIMQAFLMSELQLEQQIPFSASLTFEQSYSEVDGDSASMAELCAVISALADVPINQNIAITGSVDQFGRAQPVGGLNEKIEGSSQSASSPTGAGRSCA

SEQ ID NO: 10285 - protein, 343 aa, Enterobacter cloacae
RRVSPLCRLSNFSLGQRTLLKFCPVCAREDTFHYGVTYWHLAHQLHGVTTCHRHPVALESIHVPSSPHIRIGLMPPVSYTEQLSNEIDFDFAKFCYESLNIIRRKDITHPNYMDVLKKLNLLSLDGNLKKNVFYAHVYAKCQLFGEGSSGLIPTSLTDYHYWEPILKDKCCQHPTKHLLLCYCLLNTCWPTYAGSRTNKKKEIFKSHKKYSFHIVENNTSVSNLGKEFSRSRCYIKTLIYKKYLRAFKRNTKINIFTELLIKSMAVRGFSLASIAEKNSLSEGAVSSVISSCYGLCSWRKKCKKDSLRRRHKQKILRFIHNQSVSITRKLVNLHDGAERKRAT

SEQ ID NO: 10286 - protein, 81 aa, Enterobacter cloacae
TLQPVVKMSEKRAQSVVDYLVSKGIPANKISPRGMGESNPVTGSTCDNVKPRAALIDCLAPDRRVEIEVKGIKDVVTQPAA

SEQ ID NO: 10287 - protein, 160 aa, Enterobacter cloacae
TELHGNTEIAMKYQQLENLESGWKWKYLVKKHREGELITCYIEASAAQEAVDMLLTLENEPVLVNGWIEKHINPALLNRMKQTIRARRKRHFNAEHQHTRKKSIDLEFMVWQRLAGLAQRRGKTLSETVVQLIEDAEHKEKYASQMSTLKNDLQALLGKK

SEQ ID NO: 10288 - protein, 65 aa, Enterobacter cloacae
ISKQIKIIGEAARRDYNVTEVANMLYTFPVGPGFQPRGNIPASHGRREFRVLEIFIPSAASACWV

SEQ ID NO: 10289 - protein, 273 aa, Enterobacter cloacae
GIGDFYPVRGKRLLGMTEPGKALLTIAERILNEAGNVRRLADLFTNDASGVMTIATTHTQARYSLPTVIKAFREIFPDVRLELIQGTPQEIEVLMHNGGADIGIASERLSNDPLLVAFPWFRWHHSLLLPADHPLNQVSPLTLEEIVKWPLITYRQGITGRSRIDEAFKRKGLTPDVVLSAQDSDVIKTYVELGLGIGLVAEQSGGEYEAGNLVRLDTRHLFDANTVWLGLKRGQLQRKYVWRFIELCNAGLSVDEIKRQVMEPEEVAIDYQI

SEQ ID NO: 10290 - protein, 72 aa, Enterobacter cloacae
DTVESMVRALRTGNYSVVIGWLPEDLSQEEHLRLTEAAEEGNAMGFIMRPVRGDSYRRGQHPGLKIHSNVYH

SEQ ID NO: 10291 - protein, 142 aa, Enterobacter cloacae
ITQIFMEFIMFKSIMTVSLLAAAIASTSAVAADNSAGGIINFTGAITDTTCTINGGKSADFTVALSPISVKDAGTTVGLITKNKKSIALTFSGCSPAAGTTGTPLKVYFSSADNISTDGKYLLNNSVNESDASVARNVGFAL

SEQ ID NO: 10292 - protein, 341 aa, Enterobacter cloacae
GSGPALKPRLRSIGAAVDPRRDRPRAPVTARIGARGVPARFDRTSTHRRGMLAKVHIAKVQLGMSDDDYVAVLLRATGRTSAAECTDRELDDALREFKRLGFEPQARSPKAAKPADHPLALKARALWISLHHLCAIADPSEKALEAFARRQLGCDRLQWANQSQGHRLIEALKAIAARHGWNLAMDGVKPEAVLIVTKRRLVDAIARQAARARHRAGRVERAEDRTAADRDRGRLDPVRNRRGTGPHRPGAPAPSCGRRWRPGYDRARHPRICRAVSRAAALPGMWPLALAGRTVLGGMRMVPPRAAPCAGRAGADRGMTTQTQIVSRNEQIEELAARPVF

SEQ ID NO: 10293 - protein, 94 aa, Enterobacter cloacae
CCLRVLAAARRPAVFLARVLVERFPLCLGFLGLVSFGAGGLYIGLRTIPVIFDIIKDVEDICPNAWVINFTNPAGMVTEAVYRHTGFKRFIGVC

SEQ ID NO: 10294 - protein, 114 aa, Enterobacter cloacae
IAFPASPVGLRHLKVSVIRFLVFPVCEFWLVDVDDGLELLIFFFVLCFRLVDFAGVPFSLLFSLVRRLALFDAVFVSSLLRVGLLFFWRVCWSSAFRCASVFWAWFPSGLVACI

SEQ ID NO: 10295 - protein, 228 aa, Enterobacter cloacae
FANQRERQSLFFSTTFEVMGHLTKSKGRVTEADIQVASVFMDRMNLHGESRIAAQNAFRIGKSDNYPLREKMRQFRSICFGRFDLIRMFLEIQIQAAFADGSLHPNERDVLYVIAEELGISRMQFDQFLRMMQGGAQFGGGYQQQHSSGGWQQAQRGPTLEDACNVLGVKPSDDVTTIKRAYRKLMSEHHPDKLVAKGLPPEMMEMAKQKAQEIQKAYELIKEQKGFK

SEQ ID NO: 10296 - protein, 192 aa, Enterobacter cloacae
AGVNVPDSVFYTSAMATADFLKRQEGKKAYVVGEGALIHELYKAGFTITDVNPDFVIVGETRSFNWEMMHKAAYFVANGARFIATNPDTHGRGFYPACGALCAGIEKISGRKPFVVGKPSPWIIRAALNTMQAHSEETVIVGDNLRTDILAGFQAGLETILVLSGVSQLDDIDTMPFRPSWIYPSVDEIDVI

SEQ ID NO: 10297 - protein, 114 aa, Enterobacter cloacae
NACAPSPFCGIFISKQHHNATGLTEKVMCSIFGVLDIKTDAGELRKKALELSRLMRHRGPDWSGVYASDKAILAHERLSIVDVHAGAQPLYNEKKTPALAVKREIYQHQALPPE

SEQ ID NO: 10298 - protein, 228 aa, Enterobacter cloacae
RLIMKYQFFWSSTPKIYELLLNLTIGIAIINYLVPTEQGKIGFLINLCMLLSFLTTLGIGPVFSNFVSRSNNYNLISGKFKDSISLRFCGYIVFLVISFLLIYIIKPNLLILAIPFLLGKFFFSLDIYYNFVEGQGRFKDYAISKFFSLTLINGFRLYCVVQKLDVFWVAVSYFLTDFLTFFMYFIFYDKLKLLGFRFNYKKSLVLLKINYKLALSSLRRCRSRDITS

SEQ ID NO: 10299 - protein, 197 aa, Enterobacter cloacae
PIARLVQDYPIKSCSVIAHIRQANRGEVALENTHPFTRELWGRNWTYAHNGQLSGYKSLETGNFRPVGETDSEKAFCWLLHKLTERYPRTPGNMTAVFKYIASLASELREKGVFNMLLSDGRYVMAFCSTNLFWITRRAPFGVATLLDQDVEIDFQKETTPNDVVTVIATQPLTGNETWQKIMPGEWALFCLGDRVI

SEQ ID NO: 10300 - protein, 329 aa, Enterobacter cloacae
TLIFQPPCVKILFLASLLFMAPAAFAATTWPLTIENCGVKQTFTQAPQRVVTVGQHETELLLALGLEKTIAATSVWFGTLPPTLEDAGKNLPRLADYSPSFEAVVGQKPELVLAQYHWHIGPQGEVGTREQFASLGINTWISPADCTDKTVTETSNADGARSAPFSLAEITREVTDLATIFDVSARGEQLNRALAERIKKAQARASAKQLSVVFWFSSSRLNGDPWVAGNYGAPGWISRTLGLKNIIDSHDEWPAVTWEHIARSQPDVIVIAGMSRRLYPADEVEVKKAFLRSDPVTKNMPAVRNNHIIVVPAMSLNPSLRNVDAVELI

SEQ ID NO: 10301 - protein, 73 aa, Enterobacter cloacae; identical to SEQ ID NO: 6038

SEQ ID NO: 10302 - protein, 345 aa, Enterobacter cloacae
PKRRPSGAMELDNANNVGGYPGYSITNLAPFLQARYDIDAITLSGGVRYQYTENKVDDFVGYAQQQAIATGKATSADAVPGGKTDYNNFLFNAGILGRLTEQQQLWFNFSQGFEIPDLAKYYGSGTYQLVDGHYRLQNSVNVNDSTLDGIKVNAYELGWRFTGDNLRTQVAAYYSLSDKTITINKSDMTINLEDDKRRIYGVEGQVDYFFTDSDWSTGANFNAIKSETRENGKWEKLTVDSASPSKASAWVNWAPGDWTLRVQSTQTFDVSDADGKKIDGYNTVDFLGSYALPVGKVSFSVENLLDKDYTTAWGQRAPGLYSPTYGAPGLSTYVFSTRRPRIRRK

SEQ ID NO: 10303 - protein, 205 aa, Enterobacter cloacae
  UNSURE (205)
RNNKIQRMKKRIPTLLDTMIGTALYSQQGLAADLASQCMLGVPSYNRPLVKGDTNDLPVTINADSAKGNYPDNATFTGNVDINQGNSRLLADEVQLHQKQPEGAQAPVRTVDALGNVHYDDNQVILKGPKAWSNLNTKDTNVWEGDYQMVGRQGRGTADLMKQRGENRYTILENGTFTSCLPRSNTWSVVGSEVIHDREEQVAEX

SEQ ID NO: 10304 - protein, 121 aa, Enterobacter cloacae
VETTKLWISLGTIVSPITGTFFTKIITQYNHKYLLWYNGEYLIKPGDNIKVNNNGIVISEKLRKINIIQIDKYSPTLWRVMHNMSSCPGDKEPENSFCTSSVRCIFKTCPYGKKRRNACKR

SEQ ID NO: 10305 - protein, 266 aa, Enterobacter cloacae
DSGHYNKSLGWLSLFAGTVLLSGCDSALLDPKGQIGLEQRSLILTAFGLMLIVVIPAILMAVGFAWKYRASNKDAKYSPNWSHSNKVEAVVWTVPILIILFLAVLTWKTTHALEPSKPLVHDEKPITIEVVSMDWKWFFIYPEQGIATVNEIAFPANTPVQFKVTSNSVMNSFFIPRLGSQIYAMAGMQTNLHLIANEAGTYDGISASYSGPGFSGMKFKAIATPDRATFDQWVAKAKQSTNTMSDMAAFEKVAAPSEYNKGGVLL

SEQ ID NO: 10306 - protein, 146 aa, Enterobacter cloacae
PATGLFPQWSRCPGTGGVDLRQSGAILMKRVAFVFTSAPHGSASGREGLDALLATSALTEDIGVFFLGDGVFQLLAGQQPQAILARDYIATFKVLPLYDIETFYVCADSLAARGLNEKTPFVLDVTILTSAALREQLSHYDTVLTF

SEQ ID NO: 10307 - protein, 146 aa, Enterobacter cloacae
IIPPGSKSGDFSWDKTSNAFCVNGDGPRRTVPSRASSAVQFAHALLDAGHELASVFFYREGVYNANQFTSPASDEFDLVRAWQKLNETQGVDLHICVAAALRRGVTDATEAERLGLAGANLQPGFSLSGLGALAQAALTCDRVVQF

SEQ ID NO: 10308 - protein, 204 aa, Enterobacter cloacae
HKLDRQARGEELRIIFILLSDVFNLYRDSHVKYQQSYQNSIRDPLTRLYNRSYFYDSLNHALNTATVTHPVSVVVSDLDRFKRINDCYGHLQGDRVLQFVSNLLTDSVRPQDIAARIGGEEFVLMLTNTPSDVAHQVAERIRLKLSGFDKASSGGQLPEPITISMGVFTATSPETSAETCVESADKAMYEAKETGRNRVVVFRT

SEQ ID NO: 10309 - protein, 129 aa, Enterobacter cloacae
RRALIDHRLKPLELTQTHWVTLHNIHQLPPDQSQIQLAKAIGIEQPSLVRTLDQLEEKGLISRQTCASDRRAKRIKLTEKAAPIITEMETVISKTRGEILAGISPAELEMLIGLIARLEQNIHDLQSRD

SEQ ID NO: 10310 - protein, 155 aa, Enterobacter cloacae
RLEGSKTHREWRVPVVRQLRLRLQLLLSRATEAGAGPKDNLFDVSFYIAGRKAKFERNDVSVMHQKIRSFFRRLSKECGFAVSPHRFRHTLATELMKAPERNLQLVKDLLGHRSVSTTMEYVELRMDIVGKTLEEELSLHTDLCVERELQLLTQN

SEQ ID NO: 10311 - protein, 133 aa, Enterobacter cloacae
SWNPNELLTGKTECNKCEEASPGNVTLKTIEGVVRNVPFYGEIAGSRVKKGPWWLIILKRWLQKSLTRGFSHFNPDQYNGACLLGLRGIVIKSHGAANQRAFTVAIEQAVQAVQRQVPQRIAARLGSVLAKSD

SEQ ID NO: 10312 - protein, 173 aa, Enterobacter cloacae
AYMYTKILGTGSYLPKQVRTNADLEKMVDTSDEWIVTRTGIRERRIAAPDETVSTMGYEAAQRALEMAGIDKEQIGLIVVATTSATHAFPSAACQVQNMLGIKGCPAFDVAAACAGFTYALSIADQYVKSGAVKYALVIGADVLARTCDPTDRGTIIIFGDVLPSPWKIRICV

SEQ ID NO: 10313 - protein, 263 aa, Enterobacter cloacae
QVTVTNDNGKLDIRLTGPWREVIMWEVPLLAVISELAHRYRSPETGVTQAVAALENKLVEFSRLTEGLDMSRFRLMDFGTRRRFSREVQEAIVRRLQQEPWFVGTSNYDLARRLDLTPMGTQAHEWFQAHQQISPDLANSQRAALAAWLEEYPDRLGIALTDCITMDAFLRDFGPEFAERYQGLRHDSGDPVEWGEKAIAHYEKLGIDPMSKVLVFSDNLDLSKAVDLYRHFSSRVNLSFGIGTRLTCDIPQVKPLNIVIKLV

SEQ ID NO: 10314 - protein, 173 aa, Enterobacter cloacae
TSDQTVTTQKQQIEEAGYQVSKCFTDEAVSGGIKDTERKGFSDLLNYVREGDTLVVIGIDRLGRNTIDVLSTVETLQAKGVKVISLREGFDLSTPVGKAMLTMMAGLASLEKDLIAERRTAGIKRAQSEGVHCGRPIKATTEQVQELIAQGYFPAQVQEELGISKATFYRLNK

SEQ ID NO: 10315 - protein, 216 aa, Enterobacter cloacae
CMNLISISAFQDNYIWVLVDDDRRCIIVDPGESAPILHAIKENGWQPEAILLTHHHHDHVGGVPDLLARYPHLPVYGPAETQDKGTTQVVEEGESILILGWEFSVFATPGHTSGHLCLYSKPYLFCGDTLFSGGCGRLFEGTPEQMYQSLQKINALPADTVICCAHEYTLGNMKFAASVLPEDRAIQDYYLKVKELRAKNLKTLPVMSSLQRARSH

SEQ ID NO: 10316 - protein, 140 aa, Enterobacter cloacae
DSCITSYSVAGVLMKPARIPQTVAPPERWAELPWGEYYREALELQLKPWLAKMNGFHLLKIGNLSAEINTESCAISHQVSVSLNGSPVQVKADPMHLPFAEKSIDACLLAHTLPWCSDPHRLLREADRPLIVVVDQPVDW

SEQ ID NO: 10317 - protein, 283 aa, Enterobacter cloacae
SQAFVRNYGYELAHRVICALRAALVEKSMNDEMKNKSGKVKVMYVRSDDDSDKRTQNPRTGKGGGRPASSRADGGRRPARDDRNNRGDDRKRDDRKRDDRKRDDFVRDGGSPWRTVSRAPGEETTEKADHGGISGKSFIDPEVLRRQRAEETRVYGENACQALFQSRPECIVRAWFIQSVTPRFKEALRWMAANRKAYHVVDDAELTKASGTEHHGGVCFLIKKRNGTTVQQWVSQADADDCVLALEDVGNPHNLGAMMRSCAHFGVKGVLLQDAALLESGAA

SEQ ID NO: 10318 - protein, 142 aa, Enterobacter cloacae
MKTFTAKPETVQRDWYVVDATGKTLGRLATELARRLRGKHKAEYTPHVDTGDYIIVLNADKVAVTGNKRTDKMYYHHTGHIGGIKEATFEEMIARRPERVIEIAVKGMLPKGPLGRAMFRKLKVYAGNEHNHAAQQPQVLDI

SEQ ID NO: 10319 - protein, 131 aa, Enterobacter cloacae
AMAENQYYGTGRRKSSAARVFIKPGSGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 10320 - protein, 202 aa, Enterobacter cloacae
TSVRQLRPDAALASIKSTVLVIAVHQSIGAGIALAIPLTAAGQVLTIIVRTITVAFQHAADKAAENGNLTALSWIHVSSLFLQAMRIAIPAVIVAISVGTSEVQGMLNAIPEVVTSGLNIAGGMIVVVGYAMVINMMRAGYLMPFFYLGFVTAAFTNFNLVALGVIGAVMAILYIQLSPKYNRVAGAPAQAAGNNDLDNELD

SEQ ID NO: 10321 - protein, 157 aa, Enterobacter cloacae
QVSEMVDMTKTTTEKKLTPGDIRGVFIRSNLFQGSWNFERMQALGFCFSMVPAIKRLYPENNEARRQAIKRHLEFFNTHPYVAAPVLGVTLAMEEHRANGAEIDDGAINGIKVGLMGPLAGVGDPIFWGTVRPVFAALGAGIAMSGSLLGPLLFFIL

SEQ ID NO: 10322 - protein, 137 aa, Enterobacter cloacae
SVGLRVSSGCMRMNAPDIKALFEQVRVGTRVQIINEPVKFSVEPDGKRYIEVHRPLAQAEGENPQTVPFTHSAAFTAFAAESGSDKTLIDKALARRAGIPVAVSTGNGSSASNSVLSVQNSRVSAAVAEDEGEKALQ

SEQ ID NO: 10323 - protein, 215 aa, Enterobacter cloacae
LLALTAIRYTPLCYFINTEGLSCMYQDLIRNELNEAAETLANFLKDDANIHAIQRAAVLLADSFKAGGKVLSCGNGGSHCDAMHFAEELTGRYRENRPGYPAIAISDVSHISCVGNDFGYDHIFSRYVEAVGREGDVLLGISTSGNSANVIKAIAAAREKGMKVITLTGKDGGKMDGTADIEIRVPHFGYADRVQEIHIKVIHILIQLIEKEMVK

SEQ ID NO: 10324 - protein, 290 aa, Enterobacter cloacae
RRFSAIPLVDYFYGLVVVIWGTTWIAIFLQQGPVAAPVSIFWRFAVASATMMIVLVALRRLRRLALRDHLYCMLQGCCVFCFNFWCFYTAAAHINTGLESVIFSMAVLYNAINSFIFFGQRPPARFWTAAALGLIGIITLFWNDLLASGWSASLLTGIGLSALGTYGFSLGNMISMRHQRNGMETMTTNAWAMLYGTVVMGLIALFRGDNFMPEWTVSYMGAMLYLALFGSVIAFGAYFTLVGRIGPGKAAYSTLLFPAGGAVDFNGVTRLPFGILTGFSGCFLIIGGHF

SEQ ID NO: 10325 - protein, 89 aa, Enterobacter cloacae
KKNTMFQQEVTITAPNGLHTRPAAQFVKEAKGFTSEITVTSNGKSASAKSLFKLQTLGLTQGTVVTISAEGEDEQKAVEHLVKLMAELE

SEQ ID NO: 10326 - protein, 282 aa, Enterobacter cloacae
GRVMISGILASPGIAFGKALLLKEDEIVIDRKKISADKVDQEVERFLSGRAKASAQLEAIKTKAGETFGEEKEAIFEGHIMLLEHEELEQEIIALIKDKGMTADAAAHEVIEGQASALEELDDEYLKERAADVRDIGKRLLRNILGLAIIDLSAIQDEVILVAADLTPSETAQLNLNKVLGFITDAGGRTSHTSIMARSLELPAIVGYGSVTSQVKNNHYLILDAVKNVVYVNPTNDVIDHCAPVQEQVGTEKNELAKTEKFANHPAWNGFRLKLCANIRYG

SEQ ID NO: 10327 - protein, 119 aa, Enterobacter cloacae
NHNPTLLVTDIEKNPVNLLEFSHQLNQMLNCFLLVFTFSGDGNNGTLSQAQSLQLEQAFCASAFAVGSHSDFRSEAFRFFNKLSSRAGVQTVRSGNGNFLLEHCIFLLPAGLEDLCSRD

SEQ ID NO: 10328 - protein, 63 aa, Enterobacter cloacae
LSADAASPVVKIPEINQITIAKFFSGQGLSLMGAALIYEMVLKAHDAMTDLIWNEYEVKTMNG

SEQ ID NO: 10329 - protein, 76 aa, Enterobacter cloacae
DEHMRASATRSEDLGHPENKSELAWNENKKWKKNQESLLLNGVEIPIVSLDYEIEINQEIGNYNAFKDTCYLENYR

SEQ ID NO: 10330 - protein, 141 aa, Enterobacter cloacae
GGTLTGLLFEQIEERKMSYLEYINEVKVSGIVISAVEKKMTDQSIGLLIKLKNRMKTEVDGEITEREFSVQIKVSPEMYSTCFTGINQGDELMVSGYIVVDTIMIEGREHPLDYMRVVATSKLAHIPKPLKGFGQSSFNQI

SEQ ID NO: 10331 - protein, 65 aa, Enterobacter cloacae
INYLRYFIFIYIEYRKKTKLITTYCSSPKFLFHGDSKRRNPMKGFLPFRVGLMSDLIKATLSKTF

SEQ ID NO: 10332 - protein, 122 aa, Enterobacter cloacae
SSAALEEQIMLDDCNDDMGWDIFFDQDYLMSEKKLAVKWTDREIMDVYIKAFKSTLELFDELVSCDLLTKRNAFGKLEINPIFENHFEWIMSEAFEIVGNHLGYNVPQIRKLMATICQMNLK

SEQ ID NO: 10333 - protein, 85 aa, Enterobacter cloacae
RFLSMVAETGWINAARCLTWRNQFWCEVNVGIETIIGLAALVISAIAGAFGLGHIRGTSKAQAKADQQRTEDNAAATVAAAERRV

SEQ ID NO: 10334 - protein, 136 aa, Enterobacter cloacae
VNSKGKAFDVKLEAYALSENDGKNGIRGTLISRNGHAIAGAAFAGGLSSLAGSLSPSKVSSFYIDPYSQAQYQSPNFGALGALAGVGAAQGGLNRLVDYYTAIAEQQWPIVEISPGRAITFVVQTGTTIPTNLTSR

SEQ ID NO: 10335 - protein, 160 aa, Enterobacter cloacae
MDSLEKKESPESAGPEITKKMVRERTTKKITFEIDIEKILKYLFFFAFAVLVIIYGYKGFMNVYDYFNKQSQPSYKIAVLDMPELRKEFFKHHGGRTADNDRSQFEEYFRTLMKIYRDRGYLIIDATLAVTVPDSVEIVTYMELEDSSEAVQSSSYNAKK

SEQ ID NO: 10336 - protein, 307 aa, Enterobacter cloacae
TFTNFFRKDFLFWQILHGHYSALCNLIQSVTKPEEEIVIFSTGNLFDYGPEPIELMKAINSGFFDGRFVRHFSAAGAGEEMLKKLLPLNKDRRTFYPSTYLNERWCVMGGKWHKAVNRYYLEEEVKKLLNTQLGTMMQILLKGDIKIGVCPSDYAPIRTSFTDTYNALQAFNYANVNIFQSQFLFGMDHAVIPMMINDVNLMVLGRNPVNSIRKAHGRTQNNLPVLIGNCLHINTGSLYMSKLEDQVIVAPGIPQTDSPALTLVEIIMKNNPVLLCHQLIQTTNKFYSLKTYPLELDSIENNIEVTR

SEQ ID NO: 10337 - protein, 115 aa, Enterobacter cloacae
TRVRNPLMDIRKIKKLIELVEESGISELEISEGEESVRISRAAPAASFPVMQQAYAAPVQQPALSAAVAPAAAEAAPAAATENHGHIVSSPWLVLSTAPRSRTRKASTKCVKKST

SEQ ID NO: 10338 - protein, 60 aa, Enterobacter cloacae
GGGKGEGEVGGTREERRKRGLGKGRAMEGGEGGREGKVEGGAEVGGGVGGGEGGGGGGER

SEQ ID NO: 10339 - protein, 79 aa, Enterobacter cloacae
KRRKRKKKKDLSAKGQAEASKRTAKATTNPLTKENSGNKETFTKAPEREEALGQKTVEIQLQQGLEEKEKASAFWPTKE

SEQ ID NO: 10340 - protein, 62 aa, Enterobacter cloacae
TALASSPDLRIMRGLVVIDGGFNLNQSSSLCYSTMLPIGELRKNGYTLPSIVMGLRSNHFRL

SEQ ID NO: 10341 - protein, 70 aa, Enterobacter cloacae
ILTRVTESVRTGSGLVLSTLIKAFFIALFPLVLKKLPTRPDGGVGQKIMPVPYSSSQHAYAGTLSGQHEH

SEQ ID NO: 10342 - protein, 112 aa, Enterobacter cloacae
PTPPSGRVGNFFRTRGNRAMKKAFINVDKTNPLPVLTDSVTRVSIQCTAKDENGAGIEVNILDLIQDHDTDEVKVQFGSSPVQALAMLRRVMTALEKQANAELQQNSCSRMQ

SEQ ID NO: 10343 - protein, 114 aa, Enterobacter cloacae
NGEKPKRRTLVYATGNRNRFRLQRNRVHKQNPAGKAPSMSSVLNKKTVTVIADTAIPIFERIAEEAKLKEGESVSTDTYTLVLTNDEMNDIINAHADLKEYLRKHAEKMNKGQA

SEQ ID NO: 10344 - protein, 113 aa, Enterobacter cloacae
TYGEDMVITYSLSETFNMFLREIIASGLAVFCAWCVLCLFSDQERGKEVPVSMKKITSKSAFSYFISSQIAAFIISLLGSILSTKWDNIVWNDEIRQSDLHVFTTTSQIRSNA

SEQ ID NO: 10345 - protein, 63 aa, Enterobacter cloacae
SPNVCLSIRLVKYGSSLIKICSLIVFFAGSPRLFFVSSPESSKYFSIFLENREQDGVLLFEQS

SEQ ID NO: 10346 - protein, 163 aa, Enterobacter cloacae
  UNSURE (10)
MHSLMTVAIXIQNQQGFFDLFKSQERKSKEVISILFEYVRENSVWVEHYESQISITQDDRYSLVHFNQYQEPNWSFISKEKLEETYPEFDFHVSRKSLENWSNARLSTQTIKKLLKEKNWTMKEVAARWNRSESWMSKVVNDEERELYWEDAFKGLPSKIHEK

SEQ ID NO: 10347 - protein, 97 aa, Enterobacter cloacae
GSIMSKELVRPIMEKPERARKESSLTNIAAKKKNTTGETPKTIRMTPAEKMLAQELVEQIQALTHKNITVSTLLRAGLYLAQSAGPEKVLKAIKENI

SEQ ID NO: 10348 - protein, 96 aa, Enterobacter cloacae
KMDKQLYHIRWKLHHTLAELNYSLECFGDYLAKQNDYPYDIDGFEAIYLYLQRKYSWPLDKSRGMSLSDIRLALSVEMKGWTLPRDAIFEEFPGVY

SEQ ID NO: 10349 - protein, 63 aa, Enterobacter cloacae
  UNSURE (27)
STNNWEKEYLPPPKGLEFMEIPTDPFXCVLLGWGGGIKGGPFPGGESRTNYPAQGGPTFPWVV

SEQ ID NO: 10350 - protein, 64 aa, Enterobacter cloacae
IQKVTFIMPSLLGISNKKSLPNLLDISNLHLIDNHMHSDYSVDVPFGGPALREQKKRPIGRFAL

SEQ ID NO: 10351 - protein, 70 aa, Enterobacter cloacae
KSGYPPFPQAGDDYMQDNELAKVRDFWLTVKLMAENSLKEISLLNTHQEILQKSHREAMSNLSSLLKEQV

SEQ ID NO: 10352 - protein, 144 aa, Enterobacter cloacae
KGAGPGMSRIIARTGMIRSSSILTHRFIRAARSRRASVRPRAQGQWHRRRSIRPVLMSCKKSSVAQADWTGARGLMEAGKRQLENALRARDVYKNEYTLSKRSINDLLSVEQDVWSATSAKIMAEYDGWSAAINYASAVDNLMP

SEQ ID NO: 10353 - protein, 64 aa, Enterobacter cloacae
LTEGSRSRAKRILSFIVIAATGDIPAWPLFALAAVTTNEIKVREADNLSNLLLHFIFIISPDSR

SEQ ID NO: 10354 - protein, 98 aa, Enterobacter cloacae
ISFAVRHLRNDIGFTCSGPVFTNRWMIHFSFIYLARSRYFMFVIRFQNVTFVIVKSILLINIALSYKFINKSWIVHYYCLNGKSVTAIFDTNGCVRND

SEQ ID NO: 10355 - protein, 130 aa, Enterobacter cloacae
AFNNRSEYIPKRSVLIVPDAPISIEDGSNAFPVQTVIMNDPTLIDKFVGEGNINEENAFDYHKSNVLEPNYKHEISRTSQIDKAEMNHPSVRENWARAGEPYIVPQMSDSERNLKIKRFQKPTSGANHGH

SEQ ID NO: 10356 - protein, 232 aa, Enterobacter cloacae
KLNDSRNLQVELIMDIKKAWENKTVRLSVIGALLVVIVYIISQSIFSTPVKKEKKTQKKDMQTNLLLDDSQMNKLSNEESQKVYKEMVKQNRLDQNAAKEDREKAEKAQQETKAQVASLTSQLQQLSQQINDMQTNRNGNRNLDAGSSRKTINEQAPAAPYQLNANAPINGVNPNYASITPTRNSPMRTITQSSIKTNGTDGVIQVMPVSENRIKEGREVIAGLHQGPEDTH

SEQ ID NO: 10357 - protein, 74 aa, Enterobacter cloacae
CPKALKGIENPFRRAFELQRRSSLKCPSCPTICQQNVKTSIQVAGIYVECEKPQTKIKKTLTVSFQQRNLCYSP

SEQ ID NO: 10358 - protein, 84 aa, Enterobacter cloacae
HFFARNWEKCQPNLTDPDAYERQLQQKGKGLALRFVEPWLLAFVNPDAKQGRCQPVMVCYALLGKTRGKVSTATASENFRYTNS

SEQ ID NO: 10359 - protein, 75 aa, Enterobacter cloacae
RGGVKHTPFATILKPLSDRCSSLPGSWRSDLVVKTYHPPAQPVGIFGCNRFKLQFLPSVMGMIRGQNLDNYSNNP

SEQ ID NO: 10360 - protein, 89 aa, Enterobacter cloacae
  UNSURE (50)
  UNSURE (66)
  UNSURE (72)
  UNSURE (73)
  UNSURE (88)
  UNSURE (89)
RNQLPATATLPFCSSIPGGEVLFSSAQGAALRPAVNSADFSEHSRARDVXLWTVEGSAGTIDTGVXNEYGTXXIIALFWVRPIFLGKXX

SEQ ID NO: 10361 - protein, 79 aa, Enterobacter cloacae
GGGVYHKLWQKMQWLFFILVAPRLLVDADYEGTLSNMLAAIKCLSPVRHSLIVVTKNRALFFVWVNNCFSNFLNIDARK

SEQ ID NO: 10362 - protein, 81 aa, Enterobacter cloacae
ASAATSGSLLPVPVPGYSRQWQIQVCSFIFLIIKQRMSATMKVKAAEYTTSYGKKCSGCFLYLSRRDYWSTRIMKVLCPIC

SEQ ID NO: 10363 - protein, 105 aa, Enterobacter cloacae
QSEIEGMHRTKFERLKDDLIGEAVLSILKENGPITFVSLANRLRAMANVESNDERKNALIAAEDEVRQRVTGVSHDRGRVMGNYDMGRMRSLFTHNTLLTPDKKH

SEQ ID NO: 10364 - protein, 60 aa, Enterobacter cloacae
RDKFFKFFFAIDAFRNAFPSRHVAVYLYRFNNAIVIVVSNKVLNYIAVKLQSININLSDG

SEQ ID NO: 10365 - protein, 81 aa, Enterobacter cloacae
ITGSSTYNEMNLAHLKKQIHYNRVMYIAVLHLRHLPHRLIIFIYDHKDIFYVPQKVITHEYINHDHCVYSFILWGSFCSVQ

SEQ ID NO: 10366 - protein, 184 aa, Enterobacter cloacae
TSLFIFVRLSFDSCQTLIWKTKKSFLLIRFTEILLRYFGYYLNNYQKRGAAMRKSYTFGIPFGLQRESGLFLDITEVSRGIDCNCICPACKTDLLAKQGEVKLWHFSHSTAVAGDCDGLMEAIRGKIIEVINEHQVLGFPNLLAGDDGGPVSLNEVSGSGSMFGGTADLFVSVKPLPPVAITND

SEQ ID NO: 10367 - protein, 60 aa, Enterobacter cloacae
CPTHQIAATYETVPRQIMAQSQIYQCSRKMKLGYFPRFSIYWGTSQDYESCFTVCVVRSL

SEQ ID NO: 10368 - protein, 81 aa, Enterobacter cloacae
NYFSDLRGLYYLPSAKVSHNFTISTYQNFLGLLFCYVKCHILKNMAYMLIHNAIKDVLALSLSSNESCTPQQPQMMTDQRL

SEQ ID NO: 10369 - protein, 102 aa, Enterobacter cloacae
KQLAPGNRAARKGERAGAAPQKEDRRRHGRGVQKGQKPAEGNNNQQKQEIQTAQNEPDKQSKTRTDGRGKTGQPQKEGEEKGTQEEQAERTQSSRIKIFTCP

SEQ ID NO: 10370 - protein, 70 aa, Enterobacter cloacae
PGKGWFGLGKRNPHGAKGNYDMVETVKGWKGTMGNMGYLGDGFARITRGDASLFLGKNKTLVRMMRKRRQ

SEQ ID NO: 10371 - protein, 64 aa, Enterobacter cloacae
ILQLEIQFHKLLDSFPDFDFFSHTLMARFPCLFFASLTSVYSSSTYPTLHHHLKSIFLIPLSFS

SEQ ID NO: 10372 - protein, 103 aa, Enterobacter cloacae
RDLYTVLNQGELMNELKSKNENSTKSNFPPVDNQFCFYHVDFSIERLLSTAEDLQLEYIFQKPGSEVRKDLVERFERGERFVTASHCDNFCEILGCQGHQENA

SEQ ID NO: 10373 - protein, 84 aa, Enterobacter cloacae
RHIPACRSADTSARAFFGHHISGQEILSGRGVTEQQLGHCQQLADLTPLIAKLGFCSDVDLPFWAGFGLLTLTSIIRNVLDDAD

SEQ ID NO: 10374 - protein, 60 aa, Enterobacter cloacae
YRLTSYSYMPVCRHQCLGYFRSKQDLARDLIKRGVTEQQLGALSSACKFNPLNRQTWVQS

SEQ ID NO: 10375 - protein, 77 aa, Enterobacter cloacae
VMPMFTRIQKDNGWDHLNDLREKFNGKVFKVNEQIISRFQIKNTPAIITTDQDKFRITLFSEAEVRGIGAPNLSEEK

SEQ ID NO: 10376 - protein, 139 aa, Enterobacter cloacae
FLRVKIMKLRKTIASTIIASMIANTMSWAFYISLINMVMTPRIYAADAIFDQLESNFNLANPNANRNATTSAQDIVEKYKNADSGENVSGKITEKYVGKAESANLNLGKYGAGNSNESVMKNAASDGKSIGSAVQLPSM

SEQ ID NO: 10377 - protein, 66 aa, Enterobacter cloacae
VRKKKKKKKKKKKKKKKKKKKYPPGQASASYAPEPHLTVFMTDYFIPIRPGPTIVSIATRREESIG

SEQ ID NO: 10378 - protein, 65 aa, Enterobacter cloacae
SYHVTMVLSGLLNQKINWSTGSRGILRKQCKRDSSESFFICIEKGSIMNENILQGNRKNLSHYPR

SEQ ID NO: 10379 - protein, 60 aa, Enterobacter cloacae
MKTYYKVTGKTCHTIHAELRKIGDLINPIPNKKYHIKRMMTKATRLLLIKSISERIKNNR

SEQ ID NO: 10380 - protein, 306 aa, Enterobacter cloacae
MNAIQKLVESILVKMGFVGAVVENIYLDSKPFRHIRFVADIPVISFLPHLVKYLKGADHLYCGNDDLHPLFIYFSEAATLKAGPVNLANFRFEVSIASTHLRLVSEQPDLLIKGFNRDNLEYVYYRSDLASKDLILGLVEHGSPFIKHLHGLIQKRILNEFSLIFSVLEKILESAKPQILACFHSVDYEMNVKIIAEAIPETVSNQIVTSDYIVNSISDADKFINHVRRYLAGRVMKRRIYAELDVCEETSNISLVNLGCFTSPLLVTEYQMFKPHSSGLYRKAINNSLKQFKPEMHVPSEELFYN

SEQ ID NO: 10381 - protein, 176 aa, Enterobacter cloacae
MFKESDHVEFVSAFLYQNLGLNVPADDITVQLSDTSFDKVTFDYDVDIDNLNCMLDLYISELIKHNASYSDSILLKQKIIYFLGVFKNFGFFTFDIRGYSNTLSPVKVIDIVSMIINDCEELSKANSSTDAIRNLYLDKMKVDGKVLVAKFALKQFFHSDFGDFISFVEEKNYRLS

SEQ ID NO: 10382 - protein, 222 aa, Enterobacter cloacae
SFIVNHLRFPIVLREGCKIERGEVYSISNCTYNKERLQYLFSQDIYGKLYNSLEKELSSFFSFINVEVHELLKDAVCFALKILNKISLDTPERLIKAFNYRDWYCSYDVELFRKGLPGHILEELIAPDILLSDLNGCRKILRNAKRFLNGHTKTNCVYIKYEWWLGPVDTSHSAKLMSDKEINNRSDLKNFSKVFFKECLSSGKSEYENHLSEKEHALRYNY

SEQ ID NO: 10383 - protein, 165 aa, Enterobacter cloacae
LRNLHLNSFFIPTLVTLSHLSKKRITDCLNETLRIIKAVEHGFVRVGQHKINRRINDDLKLCIDFNTDDYPANMPDIYIKFNDTFDGNGALYCDNDALISLYTDVASIINVPVMMEVRLINKRGRVVCDSSHSTYVSLESNDRYRVTDRTLLITEAFDDFRNASQ

SEQ ID NO: 10384 - protein, 89 aa, Enterobacter cloacae
  UNSURE (24)
PNFYLTQWGSRFPSGALPLKFEVXYMTHSSDDKNYVRAVLSYLGIDFDEADIVLSVCHCQSDELSFTCNIKAIELKNAVDLYVDSISEQ

SEQ ID NO: 10385 - protein, 64 aa, Enterobacter cloacae
IRYLWIHLKDLLKLLIIVTGIVVTMLSFLGKAYLVIFWKSSLLQISYFQTLTVVEKYLEMQNDF

SEQ ID NO: 10386 - protein, 77 aa, Enterobacter cloacae
IQQIAVKNSTALNDKKIPFNTTKITLAIIINFIYYRHSVLNVCLSLIEPDASHSVFFYLSLRQPTFNVLPLGNDNDY

SEQ ID NO: 10387 - protein, 61 aa, Enterobacter cloacae
VNFDYFHLWDIKSLILFTSRLIPTKIFQMILRALQHINQNLKDCSEEPAFLLPYYLAIFFF

SEQ ID NO: 10388 - protein, 76 aa, Enterobacter cloacae
RQGLTQRELSAMLGVTQQTYARLEANPSKASFERLYKVLHILGVEISLSSAPLSTYTKPTNFVEKEFDSPARREEW

SEQ ID NO: 10389 - protein, 168 aa, Enterobacter cloacae
KLTFSVLITACGDKDGQVKNQSVRIVDIQQVIINSGLAEQEAEHLKSVRKTLADGLTLAQAQYENLPEEKKNEAKQNDNKLIEYQWQNERFLARKAVGQTIQNAIDKWRIKNNISIIIPRQQALSLDEGLDITPLIVKELKGAKVKFGELPVISLKQKENSPSEKENG

SEQ ID NO: 10390 - protein, 67 aa, Enterobacter cloacae
SFKLINKRQVLMLSNIRMDRIKNQSLRLVDIQQVIIISGLDRQEANHLKKLQGKSSSMDLRLLRRSV

SEQ ID NO: 10391 - protein, 70 aa, Enterobacter cloacae
SPEKTSGEKFIDGLALAQALSMKIYIKRRQMRQYDNKFIEYLGRRSGKLVLLSTKGLLSNKTTVSAFLGI

SEQ ID NO: 10392 - protein, 239 aa, Enterobacter cloacae
IACGLTFKNSCKGGQMLSSKKRKSPTNIKESLNDNADRFYKMFRIHTTAKVAMSLIAMTAVGFSFYNLYEQWQDAEGKKDHIAVIRISGEMGTGSETGDGTVIATALAKAYNNPHAKAVIIEAESGGGGPSDAIIIYRQINALKNHQPQIERVSDAGGSLSSVAADKSNKTGSTERGDEARSKQNSLEVLSSGTGRFFSDIADSYKPIIVSVKGICASACYYAVSPADAIYADSNALIG

SEQ ID NO: 10393 - protein, 194 aa, Enterobacter cloacae
TSYRRGIKPQIHPETTHSHIVTIEDSPFLSRLKFKIITAIDQLPDPNGLYTNTFNSIIDRALLTHLKTEQEKIDSPRVCKNVISAFADSTLSLPVFNIGLNEQYRYWTPWGINFIEFSRQAAKARTAVFVPDVGQIEWKSAEHKELAELSLIDQIIPKQYHWLLGIPTMWRNNYCNHDQRLALFREWRESNGCG

SEQ ID NO: 10394 - protein, 229 aa, Enterobacter cloacae
LFFVNGGKAMAADNTSRAAVLRTMLFFGMVIYFGYSLAFQNTEELKYQITQEVNASRSIISNDRWKSVIANSEATLNWLVHDYKLIDYLNTILIPDTKKPARGINIVAEKFTSINYTMAKNIPLLLYQSIFRWNLILGWLIVFLPYLFAMLADGMYQWKLKRYVFGKVTVQFYRIWFRAFWVISALTMVYLVMPNMSLFNNIAQLFPPVALLILGIALNRLWSNFQKLM

SEQ ID NO: 10395 - protein, 169 aa, Enterobacter cloacae
GSMNNIFLQFHIYGLDASKDYSLSIITRNGSQPATVINIDDPKNRDLALLKVEKNTIVKAPPNWKLPVCDNVLAPGESVWVLSGMYNTLSNTYASPDSTYYYKGIVGSDGLTAFYQNGVSGSAVLNQSKSCLYGVVSQQDIKKINVYQIYITKITTNEIIRGFIGYKNN

SEQ ID NO: 10396 - protein, 85 aa, Enterobacter cloacae
MSVILQQAIPTLSALVYLSEPLKGTSIMYKLLPAILVFLSVFLGLIALLSAIKNGSDELAVFLITLSAWFAALSKFYSLKLYKNS

SEQ ID NO: 10397 - protein, 60 aa, Enterobacter cloacae
RKSTTALSYYIYGAKEDGGEVVLRPFIVNPDELMLTPADVVEFNSQVINVDRQRHPEWFR

SEQ ID NO: 10398 - protein, 60 aa, Enterobacter cloacae
PPPPFLGGLGAWGMVYMTKQGLEGSTQQLKANWQDLPDSVPDVKGYTGWDHMRCDMDAGR

SEQ ID NO: 10399 - protein, 236 aa, Enterobacter cloacae
LMKGLCTVLAATSVVLATGCQAKEPPTQVVYRFDDHRFLELKGWGCEGELWYTDTLRGIHTRPVSQFYRIFTKKFVHPSERYIAIPTWDDPGTMISKDYGKTWSPQFFSVGPNEPDGTNQPSYEDIISFTVVNDQGFLLTKHRLYMSSKPFEDPRILPGGPGIAYTVDDGMRNKVSDTLDPRFPGWAWGMVYMTKQGLKHSTQQFKANWQDLPDSVPEVKGYTGWDHMRCDMDAGR

SEQ ID NO: 10400 - protein, 236 aa, Enterobacter cloacae
  UNSURE (212)
LMKGLCTVLAATSVVLATGCQAKEPPTQVVYRFDDHRFLELKGWGCEGELWYTDTFRGIHTRPVSQFYRIFTKKFVHPSERYIAIPTWDDPGTMISKDYGKTWSPQFFSVGPNEPDGTNQPSYEDIISFTVVNDQGFLQTKHRLYMSSKPFEDPRILPGGPGIAYTVDDGMGNKVSGKLDPRSPGWAWGMVYMTKQGLEGSTQQLKANWQDXPDSVPDVKGYTGWEHMQCNMDAGK

SEQ ID NO: 10401 - protein, 67 aa, Enterobacter cloacae
  UNSURE (29)
GDKAMKGVIRLNDPLISGRKVTKASGANXMGQPVALKDDLAQCPLHKGKFAITDCHQPGTCIGLGLW

SEQ ID NO: 10402 - protein, 65 aa, Enterobacter cloacae
MAKLTDIYSYPSLIEIAYQALSYLSFNLSTVYIRKRDKKQFLYNLFFVSKGDSFDTAEKGLKRCV

SEQ ID NO: 10403 - protein, 61 aa, Enterobacter cloacae
TGDQDREWFGHECFRRGGGEYQLKAGVYQSWSHSLLVKVRHIIKTKRGKKLFAQGNIPLRK

SEQ ID NO: 10404 - protein, 100 aa, Enterobacter cloacae
ARDSARPVRQDEGAKAGALVPATRQITVKPVRHGSDQENKRTGKRRPDDRQVKCQDEERNEHNAKESEQRRDIKSHDDGNCLLSVKFSSMLLQSPQCFNE

SEQ ID NO: 10405 - protein, 73 aa, Enterobacter cloacae
IMNITDKELISNTVRQYGWNLREFNHSTPFTSHFIYITDYHKDNTWMISLSQEDFNTTKILTSLSLGKVRTSS

SEQ ID NO: 10406 - protein, 171 aa, Enterobacter cloacae
MVEARYQGKPVSSLPEEAFAEGLSRSGLSPVLLLASPTTVPVTTDERWWLAKENVSGHYGRIFYAAVRELVIRSDIISVVRSIADENFTSEHMGYFERLTSDEKEVVFSDYLRTLAEGGLTCTEKNLVKLTQDLYPIDATPDNIRKLSTDRDALNELHIDGMVLFITGPAL

SEQ ID NO: 10407 - protein, 166 aa, Enterobacter cloacae
RSNMIVNKNRFMHKNGKRFKSIGRYLRFWQAVASSGLPMDMVIREKPYQLMVALIALYTAIPVVTIVILSGQQSHKLELIAVHFSTIITMVFVLRRKMGKRWLDLFEEKLAIYKPNDKLALSELHESIREKNGLDLQDLQDWYWKEKMTYEYHKERKTTISYQKFK

SEQ ID NO: 10408 - protein, 61 aa, Enterobacter cloacae
YGFSRITMSMGKPEDATACQNLKYLPMDLNLFPFLCINLFLFTIMLDLYFSVILEECYLNP

SEQ ID NO: 10409 - protein, 66 aa, Enterobacter cloacae
ITPKLCTSSMFLACWLSILMAAIAFALSKSAAKMAIAILFMICAPRLRAVIRGNALLLCSGFLIKV

SEQ ID NO: 10410 - protein, 62 aa, Enterobacter cloacae
RDPPGFLIPPFSASPCRKRGKRHKTTTILQIGDLAGCFIAPLNDILPVVRSKIVDNYNIPLN

SEQ ID NO: 10411 - protein, 77 aa, Enterobacter cloacae
RRWHMEIDLDNLLFNGLDEAEERNAERLDDADKKAQAIVADDDCGECLQDLKKKHRAPRCFFYECLLLPDIRSPAFC

SEQ ID NO: 10412 - protein, 77 aa, Enterobacter cloacae
PGKKQRHRCEQIKLHAKVLVITKRVNHHFENFKQIPQCQQYGEPGKIDNLPNSTMVYGFTEIRTVKESQMKHHIPKS

SEQ ID NO: 10413 - protein, 370 aa, Enterobacter cloacae
VDHFLPVVDKMALNYIRAEREAEEPYRQMLSQALADGNIGQPNLRSELIDRCIVAWRADNRGATLEAAMSTEKGSKELLNQLYMLADVGLKHLPGVRNFISSKGYELVRLSVNASGKLVAYAAPANFECDNRMEGHAWVHRMVLATSRNVLNVTHQRFAKMKHFLPAENTLFEDEQLVATWSGKKTAFKSFEEKQRYFDTCSRGAQALKQFLKLNDPVIYTNLLGQWIEAYESINETSEYVQQVSLMAPVAVKSEKGKASLIYIGTKDLADWFYQKAPTPELQALFLEEYLSKFENKEVNKEKLLSRRNTALSLSFYTMDNGEVPDEILVTKSVDNARRWYSGMFTSMPTMLNDQWSVFTTGAGRIRAYL

SEQ ID NO: 10414 - protein, 91 aa, Enterobacter cloacae
NWQICYTVNLHRRVIVRFHRRYLLSKVSRFATFFMYSLSGLESFIVQSPEGAPHRLPEHWWSQLKCDCSHPKALITGYKSIGGRQCDSTTV

SEQ ID NO: 10415 - protein, 152 aa, Enterobacter cloacae
RRGRRYLMYRNDRNVDSFNLVNALQPVFRNTGCGMFEYDRKKQNETADSILRALALNADFARALKQYVRINSVRRVVQFDDGSVRYGIHAEFEGHNKINSFRIFKDEDTDAFDSYFYSVCDNKAELVDFKMDSLDIQLQAVFEKVTGIFLSH

SEQ ID NO: 10416 - protein, 122 aa, Enterobacter cloacae
KKLQCGLLASRSEFYIIPKNTGGIMKTNLAYASNCSDSVYSYIYQALQKRSGAENESLYQQAISSCCTDKQKKKLAGYYAGPWKLLFNAWCNNRVPNTAVLALLLQQCLSHFQCEKVIAAWQ

SEQ ID NO: 10417 - protein, 184 aa, Enterobacter cloacae
NIDEMNMKNVNILDTDIAAINALSGVKLTDFLTAGYQVNWLGEREVSLVGFPCLASNKQPVEVGPGIFINRVYSRDSQSLSGKLRYDLSNGLATSAFSFFSQSGWYGGFRVVSFRDNGPAALINIGIVHENVLNAFCADFPRANVSVTRFHCGMTLEQIRMFISDTAYDMPLYNNESDFRRLAS

SEQ ID NO: 10418 - protein, 78 aa, Enterobacter cloacae
NRQQISTPIKKLHYYRSYEITIISEYYDFFPYRTNRSRHLATYFFYVRLQRSTLREVSKTGRSQPVPPPRSPAFRRKH

SEQ ID NO: 10419 - protein, 80 aa, Enterobacter cloacae
RITLSSGGKTTDDDVRASGLYWPRMCADIYGRSGGRLSHVQKSFYILAVNFNNSAFNICQVCTIEMKSIISFHLGIYSAA

SEQ ID NO: 10420 - protein, 61 aa, Enterobacter cloacae
TSTSTSTFSNKDEIFVRISPVLLFLSLTIEEVLTSNKFDITYVFLTSWFRSAILFIQRRRS

SEQ ID NO: 10421 - protein, 209 aa, Enterobacter cloacae
  UNSURE (161)
TTVRSNMEAINNYNSGLNRHQLGGFIPVYDQLAGTHYFLIDGNRLGFMFICNPSPGVFDNQQDVLAEMFKMDFPTDTVCQISLTALPDLTLQLSAWSAVRGGRMTGNDKLKADLLNGYQLDYYDRSMHKPLKPDHDTLMLRDFQVWISLSIPLQFAFPTEXEHSRIDSLYSELVSKLITIGLHPFKVDAENWLYCIDKVVNPAKELPVG

SEQ ID NO: 10422 - protein, 152 aa, Enterobacter cloacae
TFPLGFIMKTPNEAESELLQTLAQVRSVNKKRHHDEAEEPDKPSVVKRQRVTQGLTRISTLDRQAVLHAAIRDILLGKITQGEALKRLRVEVLGLKQDEYAKLVSVSRKTLSDVENNRGNYSADVINKIFKPFGLQTGLVPVSKSLIASLFS

SEQ ID NO: 10423 - protein, 62 aa, Enterobacter cloacae
YSHNSNQPGWFNPSVPVHQVSFFSVRMSIDGAPQKEVGVTVILPEIPLCSGCVLSFRQDTWL

SEQ ID NO: 10424 - protein, 312 aa, Enterobacter cloacae
VMTIESFFIGTRMSGKRYGPQSKDMQVSEFIALISPKNEPEKFVLPDFSGLARRIDAQIRNQFIQQKEDDYYRRYRQLSDRWYQAGSISDRNNRSQRFEKVMDESLEFLVYSHDVMPNINPYNLKYDDRVQVSTKGKMYCVALLFHIIARAAYEPVSVGADPTLQRHCKWLKDWINKTLGDHFLEGMMITFALCYPDHFPALQRLSGELETRDVDTFLADEVRKARQHTEEQVNYHNGRYRLKFEYTHFHQEQFDFLAEMRDLHYRIDRIEQLLQKLIDNPVVDFSEAAVAGQWIDEQVQLLETNETKLILP

SEQ ID NO: 10425 - protein, 96 aa, Enterobacter cloacae
SPLSRTPAPCGAEECLTLIESINVNKRTLSSSIVSNRNRRQWLDAYTQSPEIHMPFSDFLKIIQKFQCATVLEKVLMLLFVILIIVQQVIDTFCSR

SEQ ID NO: 10426 - protein, 198 aa, Enterobacter cloacae
SRGIMARTYVKQTVQNNEQLFDSLVINAIDFLESSIDDLNIRPKNSIVDFYTAIELFLKARLMLEHWTLILDDPSKANKQKFSVGDFNSVYFNDAVQRLKTIIGIKLDDNILDEFRTLGAHRNQIVHFAHTGYSSTQANKAGVVAQQWSSWHHLYNLLTVEWKDEFIKFKEEFERVHKRMLQQKDFLSTRFNELSKGD

SEQ ID NO: 10427 - protein, 150 aa, Enterobacter cloacae
VKTNRFIVSTVDCINEFASDVPQSVSLRIDTMLEQRIRKLAAYVKENDLHLTEFYFYDANWSFCGEDEIQEIKDMDEYKHSDSIKQEAMLREVMPSARTECPVIRVMKDSFQLSALPRHCGDDMTLNTPFIPLSELKTNNTAFITPPTYN

SEQ ID NO: 10428 - protein, 137 aa, Enterobacter cloacae
CSIYRGSGKYMFIEKSDSFLELSSEVIFPEAANAAILKHDKWADVWETLTTDADLNYTDEKETVSLSSLVMSATSAIYQAITDGWTMCVGYSGGKDSHSLLHLFLMALIRAVRNGTNISEHHFIQMSDTNYYHTVTA

SEQ ID NO: 10429 - protein, 73 aa, Enterobacter cloacae
DICGDLISTLWTFIDILTEKFEWYFTLWAKQTIGELLYRIALAIPKQEIHKSSPPFMSIINFNRLSTAPFDRT

SEQ ID NO: 10430 - protein, 75 aa, Enterobacter cloacae
AKPLARSLSVRFAKTSYQYLMAVGNLRDAYAIRPNRLENHLIAEISHPLFADDVLLFFLFVFAILHHLIQVLICE

SEQ ID NO: 10431 - protein, 310 aa, Enterobacter cloacae
HDWFIGTIYSPYVMNIFLPQHLDIANPYVKIQKKSEQDREMESKNSSFYFDRVDFLSKSISYSTLMISCLSIVGIFLNSHWLYGIATLTFIIQLLTWFAMHFKTSYAAKAIETKRLEMLRGIIGEENFYRERLYIDGNAENKNGFRAERLITLIQENAYWNSILYIKAFQQKLFYLLLTILLLITIIIIMYTTLTDNLDFQYSRAIFGILVINNFYNLFSEVSGFLNAHNEMKKIDSFIEINNRKAPEYLSYIYSKYEHEIFIAPSINNAIYLKHSMQIKQTWAQRLYNKNNFQSKQLIDAITEFTLVRP

SEQ ID NO: 10432 - protein, 263 aa, Enterobacter cloacae
PPLRAPLPLVAGVENQRLIAHPSGSGLFADVLTLKTHSSGDEVISRYTVQKDYNPQEGGGNYFLIKAACAARDYPALANDIYFTVVNWDLLHRSNLVLAELLKTVNLSAKNSSGFKVPESWQVNPLTETRLVVEHSFDGINYGVINLCFFSQEMLFTAQDVFSVSIKRFHDREPAVTLKTEALATIPNEFNPSLGKTLWTCRGEMFSAEEEMRAVYQCYIFSVGKVWCYAELIGRHRNYHDYHFEANKRCLEIILSTFHIENV

SEQ ID NO: 10433 - protein, 132 aa, Enterobacter cloacae
LTESTAMNEMTMFGYVDRALTLAQKRYADVKNRDPQSPLLQMYDSIVQQLLFLRDLIEGKEKDRAKLWDMTFGMYAGKEFDHSDELFFERLSDAWFIVDQIRRGLKVRLPHEVDTNYNKKKQNLMKKFPDEF

SEQ ID NO: 10434 - protein, 83 aa, Enterobacter cloacae
FSEVSYSTHGIRYQEHINASKNDACNNSKSYKRPEISQVIGFMSDTAYSIYLKKWQSKYYHQIQIKKKTNNNHNQVVHNITSL

SEQ ID NO: 10435 - protein, 134 aa, Enterobacter cloacae
CVKQLKTLNGRTGEVTKMTTNTTTTTYRSEEIVPFRRPKGDLDSRYMPQVYAMVRNWASNPAQYGEGVLASYRQPAVNLAYQVKGTRVVLILVPVECEPPGVIMTETVLWPSLSLVEVLQTLQEAWQNIPALNP

SEQ ID NO: 10436 - protein, 101 aa, Enterobacter cloacae
SHTKEGIMNTFLYVLLAWIVVLFIANKLLARRKPNTVKILVQRNGKAAEVDAVVVQGSKRANNSSVADSDAVDSYFEMNPYSRENQANGWAMLARDDDQLK

SEQ ID NO: 10437 - protein, 102 aa, Enterobacter cloacae
PFRLDAIKLTTSVYDDDIDTFQFSSLKSRLNSPDVPLVLLKRVLQLEGSGLSPFPPVAFLQSTVELAYVVFLLYDVYTMWGYENVINLRSAMSRQLKGEITK

SEQ ID NO: 10438 - protein, 73 aa, Enterobacter cloacae
TGWICGVCCAVEVPILGGGVINIPLDVLPEPLVPLTELTGAGALFELVQPASQSETSDNAATRLHRRGRQEPQ

SEQ ID NO: 10439 - protein, 186 aa, Enterobacter cloacae
LMRFLNPQWRKPCTLLVGKVRLLKRLALRKELSGSGSGGSRKFLRSMQWQSQTQLMELLSLMNCVLICRLFSLTRAMRCDMSRHAGGIMNHSDFVRKYSFDNPLQRLVMLRILMGGSMDGEGERVIDHQVLYEFCCCSKQAMFKEIKALERAGFLKVRKIGALDTGLAVRLEPARGYTITPVQEFV

SEQ ID NO: 10440 - protein, 69 aa, Enterobacter cloacae
SPNCLFSINKGNLRNTLRISASIINKFNYHSYCEWIRSKSVEPTNLPAKRLNETSGEDKPQIFPDVFTH

SEQ ID NO: 10441 - protein, 66 aa, Enterobacter cloacae
NSGSGSSNEDLCPVIIVTKYRIKPSLSLANDENLFYHSKNQGGLIRPERFQVTLSSGCTNHPPTFT

SEQ ID NO: 10442 - protein, 117 aa, Enterobacter cloacae
HTPRNKMNIEVLRYLESDGREHVEEKVQPTKYDSEATFAVIKILIANDGNADALSDKQKFHLKTFVEPLINRVPCSGIYGEDTCTGDGFVDDESLLMSYQEDDFMCQHCRYDAENRH

SEQ ID NO: 10443 - protein, 132 aa, Enterobacter cloacae
KGGGMSRKSTYKTKAENEHLARVAALGCIVCKNIGHEDTPAEIHHCSKGTGLAVRADNFHVIPLCAIHHRQGGHGVAIHAGRNTWVQKYGTEAELLAQVNAELGIAAWHSIQSISSHYNLNGAASLLKEENK

SEQ ID NO: 10444 - protein, 93 aa, Enterobacter cloacae
ANLNYSDVSNDNTLCKYTVWWFLTGDIMHISDDVIPGAAGHTGPVLVYLECGRISGGFVLQPDEFVTSLAALDEARQHAGLTPCSFSHPVSDL

SEQ ID NO: 10445 - protein, 88 aa, Enterobacter cloacae
TVNRSFCYWYLSENNCKEKEMLGWYCKKRSANRTRVRRGGDVNAIKWGDAPPLLYCFNSSLIFCLIMIRQCNKKKTVTMASQTQNKQA

SEQ ID NO: 10446 - protein, 95 aa, Enterobacter cloacae
LPPPNGALMPPSHVVEDKRMKNIRTVKKVFSEMLVRFENFQEICRLYVDRKMELCFTTDSADRSKLWEIQSRENCSYGEAIEILYAQEVAAGLAA

SEQ ID NO: 10447 - protein, 82 aa, Enterobacter cloacae
RHIPACRSADTSARAFFGHHITGQEILSGRGVTEQQLGHCHPLADLTPLIAKLAFSPDSVLPSWAGLLTLAPLIRNAPADKD

SEQ ID NO: 10448 - protein, 191 aa, Enterobacter cloacae
REYYRYGDARRFTSESILMNFQTNEVFNKFAAVIKSRIVNEPSSCYLLHDNEIDITILKHGILENDRNLLYVVRPSGTCLLRCDKYFYPKYYLRCRGDYKSFIYVHLDLHSGEAKEITWEQADDMLSSPGKPPLKGNLGRFEYIKVVVEDLRIRGYADYLPAYNLDDLRRFALQDDRPSLVRYIDNVMATV

SEQ ID NO: 10449 - protein, 307 aa, Enterobacter cloacae
WPTCIREASITTGGCMKLATDLVKAILIRNGVEPVNISESSKLSLKQPLTELKFSLYLRTEHLSHFLPGYVYSIKECPLSYDIGIEIQKIFESLHLLNEEFESLGFVSVWIEMHQSIFEQSRFKKSNFTFREEEVELAKGLVCSHNSQISNAAYFWLQHFEEFMIYVRNKLIDLFREAYDLILGMQQVFFIREKEELLKTISYGDDLYEVKLMAAELYSIEQNLKCSESISTKSQASAYINRIREFVRSGWRQGYIVCHHKRSNQISSLSLPMYLKDTSGRSARKRVKRLISSTVCGRNKDLGLTDF

SEQ ID NO: 10450 - protein, 450 aa, Enterobacter cloacae
SINVEGPRALFLKFCVVGFSLSSAPQKALRNSQCQIREIIMTYASPALRRKPQEVSEHFIKLVHARIAEVSGWKYIFERIPAFKDACAKAPSQVPCPFTGAGKSKFRFRQKDLYTGCAIHNDFPVNEFCDGIDVLAKYYELSKTQTCKKILSDFFGMDLHAPLTDADIENERRYKSAVRATETLDREEVAKRMRKLDVMYHYTGEIKPNTPVALYLRNRGISRLLSHLPKDLGFNNRIYYWDKDKQKSIIYPGMIAIYRDTRGRPLTIHRTYVDKNGDKAPVENPKLMMKPPADMTGGSIQLFDPHYDSGSSTWTLGVAEGIENALSVVEATSTPCWAASSAWCLENVTVPDFLLPPPDVKYINFYIWADKDIANSQGTRAGIEAAQRLQSRMVEFLAKRYPASKLTIEVFEPAQDIPDGKKGIDWNDVLQLTGQDGFPIHWAPECLNQL

SEQ ID NO: 10451 - protein, 115 aa, Enterobacter cloacae
SLFLLREDHMKIIEKIINAFLVVQHKKIQVKNITFLDNGQGMFSGMSFDADVSLEFMYESAKAYSSCFCDIPFPGFEDANLEEITKFQLDALKQRKNHLVPLLSSSGRARSIKTP

SEQ ID NO: 10452 - protein, 108 aa, Enterobacter cloacae
DKCSVRKYKLNLSSVSGCFKDNLDDSLIFTGSTPFLIKIAFTRSVANFIQPPVVIEASLMQVGHQGKYVNQLATNQTVAITLSMYLTRDGRSSCKAKRRRSSRLYAGR

SEQ ID NO: 10453 - protein, 187 aa, Enterobacter cloacae
RSSDSRLRECKIGYYMNINKDDELLVIVKYEGRFYWFVAFKEMWVLDRVKWVEDFVKSGVEINLQNTHKERYDIPVVNEENAQIFIDGLINDGYSYDKDDIAEEFYKRLSQKTIWWDIYELMPDLFIDFDNKRLYSEYVESMHYQEYVPDGWQGELVDFCSNGSLPQDEMFWIKNETDHRSVLIAKG

SEQ ID NO: 10454 - protein, 113 aa, Enterobacter cloacae
VVFDPLPEDAFGANVNIKIDKVFKLDQNAQRCIVVPFFITDKNKIQIASATEKFDVSINVTGKIYSLFYEVCEGDEIYYNFTLVPEKEAITAKFLLDDPWGGKKYNPLKEGFF

SEQ ID NO: 10455 - protein, 65 aa, Enterobacter cloacae
TATSTEPLPLEDSAEKVTHNRLTQLNVIRWHYCYDGEHHLTEVISQLRDRNRPRTQVSFRYPHTL

SEQ ID NO: 10456 - protein, 89 aa, Enterobacter cloacae
QYTIDQGNEFHDNQKYAEALEQNQKAWQALPEPKLEWELANWIAACMYSACFDLADYAEENKWGKTTLRTRGSDIDTAPLIDLGMVCYE

SEQ ID NO: 10457 - protein, 102 aa, Enterobacter cloacae
RIKYIFGKPFLDIAMVDSTRQFVFVLSETKPLPIVLTIFNAQGEKLFWSTSPESAIFYYLTLNQSKEVVVVCNFTVIQNGWHNWFYSWDMKRNALSRSGPSY

SEQ ID NO: 10458 - protein, 78 aa, Enterobacter cloacae
TCYYNSGVKAMTDEELRKNLVFLIKKYVPESQQKAFYDDISKSTVPVKGILADFNKIKTRTVDEVDGDLIRDIYFYFC

SEQ ID NO: 10459 - protein, 166 aa, Enterobacter cloacae
QIQQEQLNQEKKAKEAKAEETDRPSSITISTANSGEGKENKENAETGSGKEPEHTERNKDTNKTTKAQGKGKGKTNSAGYNQRTAPGETERAPQRAERHGKNQREAASRTGGETEKPKEEERTGARRPRPERPRSGPAKTPKPGGGAQSTEITQIKTAGLAGNAIP

SEQ ID NO: 10460 - protein, 66 aa, Enterobacter cloacae
SPGRCETWSSVFSATRGWCPKIQTAEVLHAKWPELVLRLCPVKLADSNGVFGKNKCDSTIPKGFRG

SEQ ID NO: 10461 - protein, 87 aa, Enterobacter cloacae
  UNSURE (16)
ICPRTYRRNFNTRKVXTSFPLAEKKARTVQVRAFFCFSCTRQPASLPVVMMMVVVMVVMLMRFMDVVYSVIIICLCSILLGLKDRAP

SEQ ID NO: 10462 - protein, 229 aa, Enterobacter cloacae
RVGPRSHPAGGHMSEPRSNAQMFDIDMSALRELREAVGATQQQMLMAYNRALNRTAKHMHRVSVGMMIDALAVKKRKVANKRIKPFVKRRNFGKESTGELSSAKLWYGLNDFRVHDLRGSMRKQRKQKQKRDPETGQFMKTEKGARGATFIPKSAGLHSMSWPDSFVAKRYSVKSIWIRREGGGVEEARVPVHEALEDAIDDYIFENIGSVFMRYFEQDLRGRVAGNVQ

SEQ ID NO: 10463 - protein, 196 aa, Enterobacter cloacae
AGFTGPRGGERSMTATAEAGMDAFDEYTNRVRAAVLQIPFVKTFGVYPEIPEGFQTPAVFFEIENWEPSSEVIAGSALTVSLNCSLYVLREFAADQYGQKARNAALYISSWIDGRGFGPATLPATFGGSEPADWIKNGKALGSHSVWCVSFSQVVGVGVGPFVTPADAPLLKEVFVGLAPDIGKEHEADYVRVFPR

SEQ ID NO: 10464 - protein, 65 aa, Enterobacter cloacae
GRRGKRSHPRQQAAYKLTVLLIPFRFLACRLVVDIVFNTSFKRNCLVKLRMGVLLLTGLLLAGCD

SEQ ID NO: 10465 - protein, 103 aa, Enterobacter cloacae
NTLHGQLADMKVKISRMSFGCPLADLRRSKHSEPRYGAQNDNRNNEFCQDAVSHQGNAAIIIPFPDHNFKPGTQVKPVCCSQKKHQNKQSRLGKQYPPPGTVE

SEQ ID NO: 10466 - protein, 124 aa, Enterobacter cloacae
  UNSURE (16)
  UNSURE (17)
  UNSURE (18)
  UNSURE (19)
  UNSURE (20)
  UNSURE (21)
  UNSURE (22)
  UNSURE (23)
  UNSURE (24)
  UNSURE (25)
  UNSURE (26)
  UNSURE (27)
  UNSURE (28)
  UNSURE (29)
  UNSURE (30)
  UNSURE (31)
  UNSURE (32)
  UNSURE (33)
  UNSURE (34)
  UNSURE (35)
  UNSURE (57)
  UNSURE (58)
  UNSURE (59)
  UNSURE (60)
  UNSURE (61)
  UNSURE (62)
  UNSURE (63)
  UNSURE (64)
  UNSURE (65)
  UNSURE (66)
  UNSURE (67)
  UNSURE (68)
  UNSURE (69)
  UNSURE (70)
  UNSURE (71)
  UNSURE (72)
  UNSURE (73)
  UNSURE (74)
  UNSURE (75)
  UNSURE (76)
  UNSURE (77)
  UNSURE (78)
  UNSURE (79)
  UNSURE (80)
  UNSURE (81)
  UNSURE (82)
  UNSURE (83)
  UNSURE (84)
  UNSURE (85)
  UNSURE (86)
  UNSURE (87)
  UNSURE (88)
  UNSURE (89)
  UNSURE (90)
  UNSURE (91)
  UNSURE (92)
  UNSURE (93)
  UNSURE (94)
  UNSURE (95)
  UNSURE (96)
  UNSURE (97)
  UNSURE (98)
  UNSURE (99)
DEAQVRKRLMPVPVDXXXXXXXXXXXXXXXXXXXXGLTDKDVAGKYVNARGEQRMRXXXXXXXXXXXXXXXXXXXXXXXXXXXXXXXXXXXXXXXXXXXPPHSCLSVYPCQSAVMAAVSIATPD

SEQ ID NO: 10467 - protein, 85 aa, Enterobacter cloacae
NPLRIKVAVFSMRGEKRVDEKIGGLCGISFAGNFARQRAGSAGSASQRLERSDARPSGADPGAFERYCRRRPSGVQPRRPGRAGD

SEQ ID NO: 10468 - protein, 125 aa, Enterobacter cloacae
EDVGWRVTRATKKDLSWFNLSNYDFINNLTLSEFIVELEWRDFLYRNVNEDDLFFDEEYEIKYQRIFGGDPHLDIPNEEEKEIDEFVRKVNSETPSLLNMYGTLPHLPSDPRVSPISFTELSKYG

SEQ ID NO: 10469 - protein, 61 aa, Enterobacter cloacae
  UNSURE (50)
PLRIRVSISAIGSCMLICLYSRDSIGNYQLAFFKPGTSPRMAASRSLIRXSPGGGKDKRKG

SEQ ID NO: 10470 - protein, 106 aa, Enterobacter cloacae
NSLKQVEYSRYSISASPHPSWQAKKEWLSQQLVTSMCLSAKCRKANNTAAAVVQTGYSDLLCLLNTDLNLSLKLAAIFRYGHLVLNSLIATSYNVEIHCGYYNYYY

SEQ ID NO: 10471 - protein, 61 aa, Enterobacter cloacae
LAFEVYTFKPGATAESFYLSLAQARKCSQFCLNNPFSIKYDLRHDDSMTPPRYRGGRKFVD

SEQ ID NO: 10472 - protein, 248 aa, Enterobacter cloacae
RKQTSLNHNTHGNPVWVIHLNGKEVIMSVELKTFGGAYFPKDKALKKLPDLKPLAIAVNALNKSIAEAVIFGKLAAEHPEHIDDYFKVKIWEHREDLPCPALDDFSQDFFSTVATWNVNAGEPVAATQPEVDESQDQSDDQQAGEMKSVRLLDQHSRAACLALFGPVEHITAAQYGQVVDLINDDDGCFQREMAEAFTREPRVLALSAERQKECWRGSVKPCWFRLNGQRLKSSSPNGWILLQRSVSR

SEQ ID NO: 10473 - protein, 79 aa, Enterobacter cloacae
LDQSGWYLMKLGDETARVVRALQLRGRAGARDIACRAGMRNEEVIAALLDLEKRKKVDQSNGFWWLAVDLEEKSGRNRK

SEQ ID NO: 10474 - protein, 80 aa, Enterobacter cloacae
LSHSFFACQLGCGEAEMLYLEYSTCFNEFYVEQLQLFNERLGFTLNVSLRDGATIFRVYPHLDQPYLAQNVKNPHLYGTL

SEQ ID NO: 10475 - protein, 220 aa, Enterobacter cloacae
TEITFSSPNILATNKMVVLMIVLKSFLFFVGAAAACALIVLCLWVDMRFVGHDIPELSLTEIMQETVLASIVFLHFRLAKMYDSMRYCNILVGGFFLTMLIRELDALFDLISHGSWVWFALITAVLALIRPVMHFRATLEQLAKYTQSPWYGILLSGLLAVLVFSRLFGMQVLWHAILEHGYMRVVKNAVEEGSESFGYMLCLAASLGYYVTFPAHARQK

SEQ ID NO: 10476 - protein, 83 aa, Enterobacter cloacae
NQRLSLDYQQKEAGMSDFDTDKNAQYAGDKAKNKLDELSGSAQQQFGEFVDSPKHQVKGAAKNYAVFTYEADRSALRCAGQGG

SEQ ID NO: 10477 - protein, 82 aa, Enterobacter cloacae
ICRHRLRRFESFPHHHFLAASTPPELVGKIDQLEQKREKSLFLLQKELGSRVSGCGHRIMAITSAFQADDAGSIPAARSNTC

SEQ ID NO: 10478 - protein, 64 aa, Enterobacter cloacae
VPQRAQPLSFVASGQAGNSKETASDKLEEGGDDVKSSWPLRVGLHTCYNGAYKEKRPRESKRTS

SEQ ID NO: 10479 - protein, 120 aa, Enterobacter cloacae
VADPLYKRYAVTPRRCSHCLYVHGFRFFFTPLAGVLFAFPSRYWFTIGQSGVFSLGGWSPHIQTGYHVSRPTLRVHSMCIFVYGTITLYRRTFQTVPLTHKLIQTPGCSPFARRYWGNLG

SEQ ID NO: 10480 - protein, 64 aa, Enterobacter cloacae
AARYLPAPWAEDPLNQPYTTDIMGTATAPDPETLTLDVYYYKTNAAAATVGELSSNVTYTISYL

SEQ ID NO: 10481 - protein, 143 aa, Enterobacter cloacae
CRTGKSAQTSGVIMEDLETTIMELLVNAGAARSAAQTAKQKARKGDKDEAEKAKEESREKEKQVPDKRSRRSKSVKTKGQENSRKTRSPIILRTTRRTRRKNRIRRATRKSKIDASRRKTENADIKKPAEAGFYIYAHQTKRS

SEQ ID NO: 10482 - protein, 74 aa, Enterobacter cloacae
ESDVEKEQLVEIANTEMPFGKYKGRRLIDLPEEYLLWFARKDEFPAGRLGELMAITLLIKTEGLTQLVQPLKRP

SEQ ID NO: 10483 - protein, 143 aa, Enterobacter cloacae
HIPIAARPLVLLKLTPSLPIPLFYGEKDLNMTTLKPVSLSAMEIGSVDNSSGGNDIASQITRLTKQITKVTQQLKEVAMGDATAEEKQKQQELLESQLAMLQAQLAQLQRQQAEEAMPKQEKGEAVAEGINKPSAEHQINIYV

SEQ ID NO: 10484 - protein, 69 aa, Enterobacter cloacae
WKISPSHGIWRGELIRNNYYPQAARQGGEYLAHTLIHTSDFYLHPHEKKAQVAKFINRFAFHRRLWRAR

SEQ ID NO: 10485 - protein, 66 aa, Enterobacter cloacae
YMIVPSGISLLTAIDDILSGILTLLAVLNTDALSSEHVSAIAAFEKISRQKNVATLIHPEIFISPS

SEQ ID NO: 10486 - protein, 104 aa, Enterobacter cloacae
RPVMSKIPGTDIQPAVQRRVEVVIFPAAIFAAITIHVIPQHQRGDPGIPEHRVYAAACDMLQHGLGDTDIKALSAPVKFQPAFWQDGLEIAPLPGISGAQPAFF

SEQ ID NO: 10487 - protein, 146 aa, Enterobacter cloacae
QRYDSSLGKVYSDGRQRDGGHGERQASLYNKLLLKSDILIAVAYVMRFLFSFCLGLLVLLNTTVCFATCSATYLYNPVPKVPLLTNSISLGKDAPVGTVLYRQTITPSGTYDMKCDSNTDVTFLYIIADPVGLHYEVAKIAAYIPP

SEQ ID NO: 10488 - protein, 82 aa, Enterobacter cloacae
MALGRMTHSSALLRARMVQDIYDIGHQKDYVLDMRSKKYQKHHNSNGIQRNAFVLLVHQTTQNSCSYIKDSFAKGLSQKAFA

SEQ ID NO: 10489 - protein, 149 aa, Enterobacter cloacae
TLKKGGLCERKDRNKKVLFIRVYVNSNLHGVIMELSLNIGLSEKKSNTAALFKTKSAKVILFVLLTVLFCGLAYAGSDDGALGDIWSYMSESMTGAPGKILAAAMLISSVYFSVLKPNPGLALVSLFMMLVMANGEKIISTFMDAGVPL

SEQ ID NO: 10490 - protein, 120 aa, Enterobacter cloacae
FVKQCGNLNLSDISIIKKLRKVATYNFRSSKEALSWPLPNKVESYLVCTGYNLLKNKLFISAMLSASFTTGLTSRLNVQKSNFSNELLTIHLYAFLTQAYMLAHSLNAVEQDGFVRTLFT

SEQ ID NO: 10491 - protein, 118 aa, Enterobacter cloacae
  UNSURE (68)
SCMRGFIPLSGFLMSKQNDVPQHTYRFPFRINMPLLILFWDAKKLGLAFILVAFGNIFECFGFSVVAXVVYWIAYNKAAESGIRGLLKHKLWWLGFLPSKAVFSSRYFNDPFIRDLYS

SEQ ID NO: 10492 - protein, 178 aa, Enterobacter cloacae
VYLLDVSALFGKFEVHVSCSKQEEDMNNSKHTVIEVDTNLVEIEKGFNPREAVIGDLCYEQEPVKSMIVSIKQAFKEGRQVDMIKVVKRKGKYLVRQGHTRFHGLKLAISEGANIPKLSVILIDYKNEIEEYLENLDGNRSNGLNPVGQAHALAHAVSLGYSVEELGKVRISGEILLG

SEQ ID NO: 10493 - protein, 65 aa, Enterobacter cloacae
LNSSVIRFSFGKLFITYSCKCFLRIYLNAISIPVNAFLIHSNAFRMHPNAGSFHKVTIINELKMP

SEQ ID NO: 10494 - protein, 71 aa, Enterobacter cloacae
HVSESPAKCKRFALKRMRNLREIAGAKKLKILKFKELLMSNYLKIRFCTFSLLVSLKEQGKVCATARMPTE

SEQ ID NO: 10495 - protein, 313 aa, Enterobacter cloacae
IRGSYMVYENELWHSFLLRSQIMYNLSNCRNIISKHGALRYDAFPRFELIDMYKLHSLQDIYDILATRNGYILTSNIVSLSSGVYGYFNAIEDACRKNFHITNSYPLVNISNIRYCHKCIVEDIHSKGIGYLRHRWLFESKCAVHSTSLYEVCFDNYLNAVKGLSDLIISGINPHGYCSLVVDVSNPFKNPVYILPCARNKILKWISDNKNMLIYFLFDLFKCKSHSSLSKVIEVKIMHDRYISAVFKMLSEVNFCNFNSFISDIFEDVSYASIGLDDYSVNVHFLRLRAADCKFCQLNGKYFCSLYNVKLLR

SEQ ID NO: 10496 - protein, 556 aa, Enterobacter cloacae
MNADKNDMNCFSLREGDGRFEIACEFDDLPDFIMIDDRVQTTLASEHLLNEDGNFEIVKTFKATTSGKPEQTCIRCIHPDEEPLRNLLGMKISELKAVGKEVEKNVADKRTASLWRQAIREAAAPYTCSEIMLDVDKEFGTDTKSLWGKILDLLPTYAIFKADRESSDGDSEAKNPLQQAVKDAQAALQDKITALENEIQDSVLDVAQRTLDKLREMAPELASELTPRFKEKPKWTFNFTLDGENGIPINKRGSGIRRLILLNFFRAEAEKNVAGTPRNVIYAIEEPETSQHPNYQMMLMKALLALAGQPHRQIIVTTHVPALAGLIPVEGVRYVTRNEAGEPVVKMPDDAVLKEATESLGVLPETGMERAQGIVLVEGKSDVTFLRHAASSLKQSGALPASLEDVKIVPVLIGGCGSVKHWVTLNLAKDLGLPWCVFLDSDIGGDPAQVLSIQKRKKEVEEAGKVFFATRKREIENYLCPDLIEEITGVAVTFTDTCDAKKIIGRAVGMKPDNVLDKFWPQMTSERIISRSTYHDGTQERSELVEILSDIVSMTR

SEQ ID NO: 10497 - protein, 182 aa, Enterobacter cloacae
QIIDRPSEHLWISLNQAGHPVKFERDIAFFGPGFEKLEDFHDFRSEVKHDPVRYQLIIICLCQEQHIADHFGHPVILFKTGIEDILKFPLCSILTQCDISLRHQIGDGRSDLMRDIGREIGLAGKDILNLSNHMIERDNQLLQLNGNACPFQSRIKILGGDVLNGIVDITKGQVPLDGQRFE

SEQ ID NO: 10498 - protein, 60 aa, Enterobacter cloacae
TQKKTVPQFIFVNHITPSYLISSIFLRSIIVIGSLSLYFKSQPCPPSKASRLVSDIEYCP

SEQ ID NO: 10499 - protein, 111 aa, Enterobacter cloacae
FPAVMLTHYGDREWLRPVLDKVNTSTAVPGAEAQTPAAISSPPNSLLHLNNLFLPTCITVRVAVVYRHPVMQAMAYKEANPLMFVRIIVPMLARVMNTNNSRCYPWEDRKQ

SEQ ID NO: 10500 - protein, 75 aa, Enterobacter cloacae
VNITAGNYRCLLLSTSGIIINATFILPECNFSDCPYMENQSYIEILQKYNNKIVWKKNNVPANCRGDDYQASMRP

SEQ ID NO: 10501 - protein, 261 aa, Enterobacter cloacae
VVILRQFCPAATAFFAIRQSIMQRKLSIKPQLLIKRIELFAGNIDKNKFSISPFKGSDLKIFEPSIINTGSGSALNINIKWDYPYELKMRQLNECYKSINKEAKLEHEINDKLGVRCLEINTGEIVLYPLTNTDLIDFMAPINVEKKEYKTRAPFSIFNIMINDAMTLLHIENKLTKAVEGPSLNISYTDVEGKKYSLQYKSYFIVKEITALLYTNSISGILFFEGTKMPLANRVNHLYKKQKGIFINFVRNKLQNIKLRS

SEQ ID NO: 10502 - protein, 221 aa, Enterobacter cloacae
RMTTLKIKYLYGKALHLNQVIDGKTGIRLSDLSHYSRLENEKMRDDEMSKVFIAKREEIIMEVNGIRINTSDLTNDPIIRITPRHCYCLCLSSKGDDDYLYSNFQADTCIAFDVDKLEERLSIASQKFQGSFVVGDDIIYYNQTSLHGLGQTPEKLVFYKPDFFSHEHEYRIAWFYPLDKDGFRAGDKNIPFTFKNESSHLFFFHKERSFITDCIINVFRK

SEQ ID NO: 10503 - protein, 106 aa, Enterobacter cloacae
  UNSURE (93)
RVERPMIRCTFHLNNSQLSTLSCPGVGFFPAYSGNAGENRNNPDKIAVAGIGPLPPGKYYIVMRPGSSAAHFTKSFTSSILSGSNHFKSFGSXFTTRPRTTISPPS

SEQ ID NO: 10504 - protein, 79 aa, Enterobacter cloacae
ESTSLIQNYYPDIADEIRRIADNIPRRSRAALREKLKDANAKNKVLQDEIQQLQLRISKQATINEMLNYNLKNKPSRNK

SEQ ID NO: 10505 - protein, 395 aa, Enterobacter cloacae
SQLAHFLAKTGCPREIFFPHLCHQGPIIPNKNLDKYEKCTHSYKKFDIPNLVADENEHDMSSGLDRVKTSSEDEMSTEHVDHKTIARFAEDKVNLPKVKADEFREQAKRLQNKLEGYLSDHPDFSLKRMIPSGSLAKGTALRSLNDIDVAVYISGSDAPQDLRELLDYLADRLRKAFPNFSPDQVKPQTYSVTVSFRGSGLDVDIVPVLYSGLPDWRGHLISQEDGSLLETSIPLHLDFIKARKRAAPKHFAQVVRLAKYWARLMKQERPNFRFKSFMIELILAKLLDNGVDFSNYPEALQTFFTYLVSTELRERIVFEDNYPASKIGKLSDLVQIIDPVNPVNNVARLYTQSNVDAIIDAAMDAGDAIDAAFYAPTKQLTITYWQKVFGSSFQG

SEQ ID NO: 10506 - protein, 188 aa, Enterobacter cloacae
PIGRKFSVLHSRGEIIMSSYSYTVAETQTFSVTHARHMAAKVATDLRRMQRFYGYPSDADIEAYEEELVVILKAGYLGEVSYGFQKNNNWIEPTLRYTAGDLLGSGTDDDPGKIRQGKDVSGASFYSFMTYSSKYLNATQSEKDTALKDLPFKRVGAQSPGINGYLENDKTYSAGGRSLTRTSVRNFV

SEQ ID NO: 10507 - protein, 198 aa, Enterobacter cloacae
INEVLSYSSPSGSSNGYSSGGGGSSSSTRPRWSRAGSSVIYTPAEVRTHTPARENVERRASVPDLRDVFLCHAWDDRKDAAKELHDQLEMNGVSVWFSEKDVLLGATLLREIDEGLAKSRVGIVLVTPALLKRLAGEGIADKELSALLARDLLVPIVHNTTYEDLREVSPLLGSRSGLSTAEDSMANIASKLAELVTI

SEQ ID NO: 10508 - protein, 71 aa, Enterobacter cloacae
KFIKIFDIEILTQSNFSGFLEKHFRQSCVWLHLFLSNSNRDLAYNLPAILKPGNYVKHRDLTQEILWNTLF

SEQ ID NO: 10509 - protein, 73 aa, Enterobacter cloacae
EIAAAVSGFERPSSEMYSTPPVLNIPSLVTISLDDTEFGLGDKSSFKGFSMSISKTGIIPAVILAICSGSDIE

SEQ ID NO: 10510 - protein, 87 aa, Enterobacter cloacae
ISKEVALMDEKIVLTRQQILSSALKVSKCRSLVKRRFQSLGLKYADSQEIPDRLTMIDKNAFHHFGKNLSDPTISIPYSSMGKYPCP

SEQ ID NO: 10511 - protein, 217 aa, Enterobacter cloacae
KGKRYLCSAVEQPSLFNNEQFMITFFRRAGLGTKLSLLTGASVATLFLLFTFLLSHNASQQLEDLAVEDLHNQSTGMVDMVEMFNTSLSEEVESYTRLFTTFLPQPLNSDSSQSRTINGLTVPLLKGGETELHENNTLSDDFLSRTGAISTLFVRSGNDFIRVATSLRKENGDRAIGTVLDTTSPAFAAVTKGEVYRGLAPLFGNRYQQPQERVCPK

SEQ ID NO: 10512 - protein, 80 aa, Enterobacter cloacae
TEAQSPDHASGDVIFILVISRYFKYHLFKSILIGIAHDGSATASNFTGTPGANRVYHRRESDRTFRDLPRYRATGYQQAG

SEQ ID NO: 10513 - protein, 195 aa, Enterobacter cloacae
GSKRSMPMKTQRVIKVATFLAFCLPGLTLAEDCQITLSQPIVDYKQLKRDDIVTSQQSWHKLPEREVTVNVFCPDKQKLAVLLQGNAGEKGRFRFGQNGGVAVKIDDMNVDGKSYTVGKTVDQLNFTPESGSPSPFYLRNNEAVVAVENNQAVTGQQMTFTATIFPVLNESAFSNNADQTTLESDFSWKILQNNP

SEQ ID NO: 10514 - protein, 73 aa, Enterobacter cloacae
IIKSGITQGYPLKLFIAFIIVTILLEIKKNEKCSLIFLFFDQFKKYIIFSKKKRPGINLTVKIKIELALFYNA

SEQ ID NO: 10515 - protein, 94 aa, Enterobacter cloacae
RLTGGIEGIENFNGMRQELFAHERKLSPQTAAIEQAGSGKLFQFVQRFGECRLTEVKGFSRSPQRSLLSDGHKSMQMAQAYALTEQTIFFHRRC

SEQ ID NO: 10516 - protein, 67 aa, Enterobacter cloacae
RQNASLVEEASAAAASLEEQGARLTEAVGAFRLNGARAGRAPAAANAAKPSPLTPAAVVSGDNWETF

SEQ ID NO: 10517 - protein, 88 aa, Enterobacter cloacae
WAAFDAVYDLIGGEIKKFFILPPLMDAVVTPSCKQPQCVDLKKIKSGQLKKHVLPLLQVHNHMLTEFLVETFRWVKLLVSTWVLPTLV

SEQ ID NO: 10518 - protein, 67 aa, Enterobacter cloacae
SASKEEEKQSKKKEGSSDEKEKKAEREKEKEKDTQKEKSEGEEAADPDNPEKEEREEETAKDTESQV

SEQ ID NO: 10519 - protein, 93 aa, Enterobacter cloacae
VNQHHELQKSDPQTKDKKEREEAVPNLYKETIKAKQPGKEEKANREDPKIQQTIREGSLEGKRKERDKDDQRKIQIGDNCVFSHKAVWQGYLC

SEQ ID NO: 10520 - protein, 208 aa, Enterobacter cloacae
LSVVSNRGGRSGGLKGFGIMSLSSLYSSSDAEYIQVNQYLVFVPNPKKLPYNDESLVREGAKYVFEHTKATQASFGYNPEKQKAALATCKIDMAVVNKWSTCDLPSKPDADVFPTDSMYSFQAIRPATGTEIPELNLPAGDYAVIRYVFIPFKGNETSADFSGIIFRSDSPNTTTPGGVAASINGKDYYLFTGEYGKKGFPEKTLKAK

SEQ ID NO: 10521 - protein, 149 aa, Enterobacter cloacae
FQLANTVDPDGDISPSEGISRYLTEDRPMHADVCTLKTPLDTLSWLCLLESELLSIRAFQRLDLHTERDEPNELTYLEDAIINAGTAYGWFVCFLRDGDIPPLPATAREILCTLDSLGKEINRPFWEKAVARGQDEACGDKAIAALEMM

SEQ ID NO: 10522 - protein, 226 aa, Enterobacter cloacae
IPLFFFAEDLSMKDLSSSPASMSVVYTIEHVSTVPLRHWHAFVLAVTETFWQLPVRLRPGNMYLPSLNRAADLFPVADVMAFCGDSGGSFWPVNMTIERERSNNTLSIQELDFQHQPCDFFARVVMVLLHNLCPGSFRIHSSDEGRSWAIPLRWIERHIGLPEQSSLTTPQPVLQTPVSEGAFDSLLLQLLSGGERVLSSEDWNAFVLAEFHLYELKRVTERTDAP

SEQ ID NO: 10523 - protein, 335 aa, Enterobacter cloacae
LSPSREDTAPHGAVSSFFYERGVFTMSEWCHNRLEITGKPVCIDVMLQWINGTDAPRHRHAVQQSIQLFLAGAAGILKPVRTTSYPPFQGLVRAGTGLSTAANQAFENWLALLLTDAVLDAETIRVIDRLYHQSGLGALKWENIPVSSRDVMAELIIRQYTDWFGLVSAGDESDAAAAWERLSQYPERSQPCDMLAVIPSRLAAELNGAGGLMSGVSTTTSLYCRQYGMEWPAGHNVSWQRHTPNSLTLQMDTPWLPPSGEVVGEISAVFDCEVRHSYSEPVSGLSGYDCYDGGEHVDGHKGASGAPQPGQVLYLVSDEPDSPAQDATSYREVRG

SEQ ID NO: 10524 - protein, 75 aa, Enterobacter cloacae
WLQKQHISLLIFRANGAYVNCGIKWVTHSMLRAVNNMMLDMPAAIARKYYQDRLMRQIKRKKEKDRERLAHKEKI

SEQ ID NO: 10525 - protein, 66 aa, Enterobacter cloacae
FKILSRRNYLQSMIPRRTLKAHFLPWGSAIDDTPSPARYPLSRAARNGMIKYCANLISPGVYPDFC

SEQ ID NO: 10526 - protein, 396 aa, Enterobacter cloacae
HAFVHVQQLKRSRRMSRRGERFSRMHLPLPQLNHIRACGACQQSGVTALCALPQNRDRLFPNNVYLRLAGDVNDICHRDAKRGGQFTQNGNAGVGSPFFDLYQHAFADAGAARKLVQRQFFLFPPAADTVRDGQAYLGNIGTRIGHYIDFISHWSLPWYKTVNTGLFMSLVTPSIDSRLVGIAPGFRALSILVEAAPITQPEVAPAALAQACQQMLNDDVPWAENHLAAWDEVFKAFGAKPKRTPCSASALRKRVMRDGSLPPLDPVVDIYNAISIRYAIPVGGENLAAYSGAPRLTLADGSEPFDTVKEGEPVVENPEPGEVIWRDDLGITCRRWNWRQGIRTRLDSQAQSMWFILESLPSMPLAALQEAGDELVSNLQKLMPGATARIQLLELA

SEQ ID NO: 10527 - protein, 72 aa, Enterobacter cloacae
QPASRLPAIPEIRHFVRHLSVSNVSWQIAVPNNRTALSAVFFTSHRILLQVNRLFLHHYHPVNGSARTLTHG

SEQ ID NO: 10528 - protein, 132 aa, Enterobacter cloacae
GALIFIGQIMPHTSSWWGLMLELYRSHKTSFDIFLLIVLGVIVRVFYWGGKLRECCGDILIGTVIMTFAAAHLPNVMIAIPQIGSVKFSHNEIAFVIGMLGYKGIKAVIFLVLKNRFGIDLPARIAQRKDNV

SEQ ID NO: 10529 - protein, 171 aa, Enterobacter cloacae
PAHAGFFMEQTMTDRCKWVATARKYIGEAEVHGPKHNPLILQMWRDIKRGGIKDDETPWCAAFVGSVLEQNGIQSTRFESARSYLDWGIELQEPTYGCVAVLTRDGGGHVGFVVGQNKAGDLMILGGNQSDAVNIKAFSRQRVTSYRWPRGQSSVPQSLPVMSAEHSTSEA

SEQ ID NO: 10530 - protein, 128 aa, Enterobacter cloacae
SGRGRVAHRCKSRLRAMSCYDDDLNAGDEQMLEAFGRPVRLPNRADPIIAIFNEPYARTDLPSSGGGFITGTVTSITVKSGSVDGIARRDVIQGTKKARNWDEKRKPWFWGQLELNYFLESSPCPDGS

SEQ ID NO: 10531 - protein, 323 aa, Enterobacter cloacae
TAGNNFLFHLGYTQMQVKSLGFSITNDNENIKTIDVMNEFIKSSSRQYNRADYTRRFLMSDVNDFYYGLVVTFKNQKKNCMSQFIDGKFKLKVEELQGDEKLVTFNLFLLNKTNLRGLYMSHHGSCSLNTLFSHFQTVSNEFIRKQNAADIEKLGDNPKQKEVTAVNKKYKKRFSFSIMTTKEDIKSILGQFKEIKKASFKFDYIDFKGGALTPLEAFANSTTIDMSINPDDKYKVGALSQTMSDTFEAMKGGISKARVTAVDHGGIEKIIDFMDCPAFFESYDFDVIAEKINGLTNDNYTSNPVFDMIKDEILNGTNKNAFV

SEQ ID NO: 10532 - protein, 98 aa, Enterobacter cloacae
MNADIYIYLLRRSKMADAAFTLPKGVYQKHKEFFEKLKMDIEVHTSDKNVDMVSMSCHKDGDNQDFWDLVEATRLTICKQENLTADTGGAGVVWIFHK

SEQ ID NO: 10533 - protein, 78 aa, Enterobacter cloacae
EIKLCRLYCSLRYIDLGNTGIFIRSCIVIIFTGNSPIIDQSADTFKIAICLKRLSLSLAKLRLSAIKSYLKWSRINLK

SEQ ID NO: 10534 - protein, 94 aa, Enterobacter cloacae
SSCITNSAHSLPKCYSVILKLVLKDIVSGKTFGEFVKPLNKLAHKLFPKNSGQKLPSLKGKPSPDRKVKGHIIYFFSIITKIIYFIFYSFIKES

SEQ ID NO: 10535 - protein, 66 aa, Enterobacter cloacae
RHLRGEDRDTLRRMAAELNVPLNYFFCDDQTTAELALLISRMTEEERSKLIEALKTSSGDNTADKK

SEQ ID NO: 10536 - protein, 62 aa, Enterobacter cloacae
RLDPMRSFASPLNTNIAYAKKIIWQSFIPQTFAEVRVIYMSFDQGILSEIECLNRTESSDDQ

SEQ ID NO: 10537 - protein, 154 aa, Enterobacter cloacae
KQRGRKLMRGKELDTQIEHELQLMLIEGFDKSPISAINLHARLKSKGIINGGLSTLSNIERRRLIAAYVDQQLSPLNLRPKEKQQYVNRKTRQALLGRNQQLQEENKELREQLAQNTLSLIEIVKAVKINTVIPVESLLAPHLIMELHKRKKDQ

SEQ ID NO: 10538 - protein, 413 aa, Enterobacter cloacae
VILNDSEVSVKPVAIQYIEDDILDARAFYSILFGLKILCCEEFPGFTLEDYEDLEFIPRPNAFNWEIYQDIDNILEPLEKSMITKGLFEIATGLARGKTYDIKELKHTAVLALSYATGARPVQLAKLSVRDLRIDTCDTHTGLIRYSILLPYVKQRRLTTERLLLAIPPEIGALIKHYVDKAQLLSHDRMFEMGVSAPAFVSQSISQAILNFSPPEYQTAVGRGEAAPPSITSTDLRHNVGHSLAMQGASAEEIAHILGHSSLVVAKHYIRATPALALIRAKALGSNPVWQNMVAMMLTGKLVPSKEWEGRRVVGMVGDRLHYEIGGCARTDDECPFCEVRCCYGCLYYRPFLDGHHQGVLNSVSKEVDELIAVSDSVGNALNPLISVHETTQIEIKSVIARCHLHNVRGCGK

SEQ ID NO: 10539 - protein, 86 aa, Enterobacter cloacae
RALSKKQHKVSTRSLFDTRTQVRLQLSRSVHKTLASAKEILQGRGVDSVSIEDLVRACLEENQPIDLASLYLENLLKQKGTSICDF

SEQ ID NO: 10540 - protein, 150 aa, Enterobacter cloacae
WWIVFCFTIPNLRKKQKTKLLWLSLNLNRLKEKGVKMELGIMVCIVLLLSVAAAWISNKTVDLLERFYFKRPLSMEYAAWLRVMCAGLLLVFIQVAPQFTLLYTLKLVTLINLGIQTMKLNGVYKYKRTGILPPGGALSNLTRLNPFKKK

SEQ ID NO: 10541 - protein, 179 aa, Enterobacter cloacae
NMSTQKQLSRTTGTERMFKEELALSLICWVFTSPFTNWTDKVFSGIEVPSEGPSSLRGETEKFFRFVVNEEGYDAGRAAIGLDLCCFSLPLCLFPDAALSEEEVMSKLTGEVIHGILLSLPEFIDMPEVLAYQVRDEILAFNTRCGDGIFHGWNTASELWKFEIFPRTTIMMQHTSAIH

SEQ ID NO: 10542 - protein, 304 aa, Enterobacter cloacae
GTTMQWISTASQKIDERLYRVCVWVKKYHADAINRVVLTVDLSKARHDPDEDQVRAELLCGHYFLLRKENASNSAPDDQKFAFLPDGRNLCWQTATPVLQHLLLNKNVPESLRLLTDYIHMRLARLTMVPMSGTIMNEALLDSISWVKVDLTYFWQYEQLSSHLGPIQITHKALVRFGHLAKNDENSSAIRILRQRLSSEFLQEFQMAEDELKRKQSLMGTMDVKMLFHAHYPSQKMLVARYKNGWVMVDCFLFHHTKPKKKAKNKTTVAKPQLKQTKREGSENGTGHYGVHRVVTLSGGGVDQ

SEQ ID NO: 10543 - protein, 187 aa, Enterobacter cloacae
CIYFIDGYHLLYITLNDKNRPHQRPYWRQYEVNMQHQDALQRKLPERIFHAVCFEGIATAILAPTAAWLMQRSVVEMGGLTIILATTAMLWNIIYNFGFDRFWPVQRVKRTAKVRALHALGFECGFIVIGVTIVAAVLGVTLLQAFTLEIGFFLFFLPYTMLYNWAYDTLREKIIKRHQQRRALASE

SEQ ID NO: 10544 - protein, 100 aa, Enterobacter cloacae
PRNTFLSLLCDPIEDACNLLVLIIKAGQRGILPGQATCGRLLVFERSFYVIIEIIKWYAAGKMEYLPGVAIIGIQNSCTALSLYIDAGQGKIESFLFLIN

SEQ ID NO: 10545 - protein, 468 aa, Enterobacter cloacae
HVSSLRCWLHLLDANNMKRKIIPVLIGCALSFSGLAAQPTAERYIVSFPDGSHVKYSGAFADAFPNGLPVGMGSGLLFTGKQGDALTFATVTDRGPNADSPKMGKNDAKIFVTPDFAPLLMTIRVQNGKAEAVDARPLHDDKGEINGLPLQSGVIGSTNEVALSDTLKVLKGDNRGLDTEGITPDGKDGYWLCDEYGPFLINVDSKGKILAIHGPQATQGEKSIAGGLPNVIKWRQANRGFEGLTRMPDGRIIAAVQSTLDIDGKSKKQALFTRLVSFDPATGKTAMYGYPVDSAAYSKNSDAKIGDIVALDNHTILLIEQGEDKNDAMRNLIYRVDLSKASDLAAFDKPGEYPEFDDEKTLAQRGITLAEKTQVVDLRALGWQQEKAEGLALIDSKTLAVANDNDFGVKVAMQNPVEGKKLKDYRVNAEGKLTLDDKPVETTLSVKPLKKPESDSELWIVTLPEALK

SEQ ID NO: 10546 - protein, 72 aa, Enterobacter cloacae
NAANNNKNGEHHQQYFCKKTKLYIYCKRKKKKRTPGKERRPSGQLIYNTATFEPNKMNNNFLSSPRGCQVPR

SEQ ID NO: 10547 - protein, 71 aa, Enterobacter cloacae
PTLFLSGLELIKYKKQNGINMIFSRCARAEIKENMRKRKNKKAHVTSNVGLNIGGTDGTRTRDPLRDRQVF

SEQ ID NO: 10548 - protein, 61 aa, Enterobacter cloacae
LNGIPEVKSALNGRKYFAKQIVSFRFCGEIKPVLRYSSDDKVNDSCQKAGAYREQTYNERK

SEQ ID NO: 10549 - protein, 87 aa, Enterobacter cloacae
YGHFDSLCRKYDFVLPFWRCDQRAHCGAVLHKFSLINKLLFLVAKCLVGNTPFTFSELLTGACRRGPKSLVFRIGAYFRRWGLLTRS

SEQ ID NO: 10550 - protein, 106 aa, Enterobacter cloacae
RGSHCLYVHGFRFFFTPLAGVLFAFPSRYWFTIGQSGVFSLGGWSPHIQTGYHVSRPTLRVHSKCVFVYGTITLYRRTFQTVPLTHKLIQTPGCSPFARRYWGNLG

SEQ ID NO: 10551 - protein, 77 aa, Enterobacter cloacae
PDFSAISSTSKVDVSEFSTHWTISLTTLSAYVFVIICPLITKFYIYLKKKYKFFIHEELSRNTIYVTISDHLLQPEG

SEQ ID NO: 10552 - protein, 65 aa, Enterobacter cloacae
AAVTAMSMMFISLIILSVVMVTPLMLMIAMTMFFLTMIMFFISMTMFMAASFMCMPTFHMPLLAM

SEQ ID NO: 10553 - protein, 66 aa, Enterobacter cloacae
YFRIKLINRKSSVMAKHKSNSLVLRHHGPRKIANLLTLCFHENDVAPHLLVYPNDLYHQQSLIYEE

SEQ ID NO: 10554 - protein, 66 aa, Enterobacter cloacae
ATRHFLHWDRLPRYHRFIYKTCSFTYLTINRHSLTWSNFDNVIKDYIINWNIDNNAITQHMRLFGL

SEQ ID NO: 10555 - protein, 62 aa, Enterobacter cloacae
INHSEFMCDKIVWSFFIYSVNRFTSRELIQPEVGYFNGGAMGVLFLMNGMFVKRIANNVRGI

SEQ ID NO: 10556 - protein, 709 aa, Enterobacter cloacae
NGDNGMTEAKTKPYAPRVVSEGDIPVHKTLGEVAQTRNVGIPRPMPGIVILVHGVNDVGEAYQNQEKGILAGLGKRLNRQDFYAHEWKDYRIITPGRSPIIPFYWGYKPVTHADYRADQKRYREEVGKLSDKAHLPYDAYQEDNETNKKSLGNDGKGPFQYQNDNFKNALDKSFAKGGGTFANATTTIPDMLGPGAGGFGVAAAGFASLHFNDGDFTHPIYENPHRIYQFFAAQRLADLIIQIRQPLVTQNDVINIVAHSQGTIITMLANMLVKQAGYDPVNCVILNHSPYSLESRVAENIQPGYQQTDDARQQTFKNFCRLMHTQWKGGGKMAESELLALEASCTLRKPSDNPLRTDGRYCRSNDGKVYNYFCPNDGVVSLENVQGFGWRGIPQNIASDIPNLFQRVFYQHGEVGNIPDANPFELPPRNEGDAKYAFLTNASYSARDVVINGEELPEPFIFKLQGEDNHPDNDPKTSDNPYTYYVDPDSPDAYISYSAKASAIKRTVTTTFAVNRYQNIGWQPGHVLSASELKEESFERKHEVIYGEVSGSRDFQLVTLTWKKTPEELQAEWQKIDPVGYSQHSSIVMSEFAPSHAMAFDLAIGQCKSFDYQAGKFWEGLLHRADWRDPQNENPYARAYYRTGKLDEPTTKFFMNKPYDVLPKGEYGVVNKFNNATTVKPSSDLVAGNQDVANLQWDMPKPISDSQLA

SEQ ID NO: 10557 - protein, 236 aa, Enterobacter cloacae
SMKISFMGLMATAVLLAIGCQAKRTATQVVYRFDDHRYLELKGWGREGELWYTDTELGIHTQPVSQFYKIFTKKFIHPSERYIAIPTWGSPGTIISKDYGKTWSPQFYSAGSNEPNGDSSPPYDDIISFTVVKDQGFMLTKHRLYMSSKPFEDPRILPGGPGIAYTVDDGMGNKVSGKLDPRSPGWAWGMVYMTKQGLEGSTQQLKANWQDLPDSVPEVKGYTGWDHMRCDMDAGR

SEQ ID NO: 10558 - protein, 236 aa, Enterobacter cloacae
LMKGLCTVLAATSVVLVTGCLVKEPPTQVVYRFDDHRYLELKGWDCEGELWYTDTKRGIHTEPVSQFYRLFTRKFIHPSERYIALTGWGVSGFIVSKDYGKTWRSVAFSPNHNEPNGDDYAPYEDIISFTVVNDQGFLQTKHQLYMSSKPFEDPRILPGGPGIAYTVDDGMGNKVSDTLDPRFPGWAWGMVYMTKQGLKHSTQQFKANWQDLPDSVPEVKEYTGWDHMRCDMDAGR

SEQ ID NO: 10559 - protein, 67 aa, Enterobacter cloacae
LMKGLCTVLAATSVVLATGCQAKEPPTQVVYRFDDHRYLELKGWGCDRKLWFPDTKPSIHSETPKFV

SEQ ID NO: 10560 - protein, 60 aa, Enterobacter cloacae
KRSIFERCVRIHLPVFTFQERQNSSALVMIFPPFYHSCRKPKRQPCSKFATYPEGANGVL

SEQ ID NO: 10561 - protein, 77 aa, Enterobacter cloacae
KRTPRSGLPKCPCALFVSLTKSCSKVGYQIILLLYRSDGIVQPRTIPSLTVIKNKDNIGPTIYLNILSLFLTPITYR

SEQ ID NO: 10562 - protein, 70 aa, Enterobacter cloacae
KSNGPLSPLFVTSSQFYYSRPLSLLSVVVISLPEPCLLFITHIAGHGIDINWLALGVHTGKTACQKIKIL

SEQ ID NO: 10563 - protein, 254 aa, Enterobacter cloacae
WRCCTCGWARTWMYVCSYALPGICCRMRGCPAMRNKSRRSGARQCCVPLIRNRTETTLSPFTLDAFSASGKTFSEGKTMKMAITAGKALAITLATLLTGCGLTQKVTDGTVAVTKSIFYRQVKTLHLDIQAREGVNNNAKGASLATVVRIYQLKERKAFDSTDYPSLFASDTQAIKADLVAEKDIRLRPGESVTLDMPMEESAQVVAVAGMFMAPDQVNDTWRITLTRDDLDPDKARVIEVSNNRLTLKPLEGE

SEQ ID NO: 10564 - protein, 70 aa, Enterobacter cloacae
IPVGPEPIMAIFFIESVPAFLNHTTSVAGERLSHSMKGEIKTFRRGDVAPLPEFMGKSIQLTLLIRYNSA

SEQ ID NO: 10565 - protein, 142 aa, Enterobacter cloacae
ARCRKRKRKAVAGMKIYRPLWEDGAFLAPQQFQQQARWDAHVADTVARMALANPWGVLCAEFDEGALALSRLNATRLCVRFADGTLVDTDLADTRLRSGSRYAAVAISGAAAGDDAAGTDGGGNGGAGAAAGTGYAHAGLSP

SEQ ID NO: 10566 - protein, 219 aa, Enterobacter cloacae
MPPGFACALRMVRWWTQIWRIPGCAQAAGTPLSRFLALLPVMMLPGRTAEGMGALVRLLAPDTRTQVYHHDRCRIPLKQPVAMSTCQPVSLKHRPVMGTHATDVNGQVLLRLSTDNPEEIRGWLPGGDLHADLMALLHVWLGAHLDVRMQLCVARHLLPDARLSCNAEQIAQVGRTAVLRPLNPQQNRNDIITIHPGRFQRVRENIQRRKNDEDGDYRW

SEQ ID NO: 10567 - protein, 158 aa, Enterobacter cloacae
SSDAETAGGGMMPRPSLYDMLYGNFAGGLDLHSVSEENQLILSVLDNMQRILNCRAGTLAHLPDYGLPDMTKILQGMPGTAHQLITTLSAVLLKYEPRLSRINVVMQEQIQPGELRYAIDAELKGVGLVRYGTEFMPEGRVLIRHLKQQQYLDNTARL

SEQ ID NO: 10568 - protein, 61 aa, Enterobacter cloacae
KLGERQPERPDIYFTLVGKDTLKSNFSMVYCRTCAVAGSEILIIDFFAVSHCILSGEKVNG

SEQ ID NO: 10569 - protein, 85 aa, Enterobacter cloacae
NVRENRLVRLNGLEPSTPTMSRWCSNQLSYRRKMVRSIGLEPTTPTMSRWCSNQLSYERIVLSVTTGTNISGTAVFTTGLEGTAL

SEQ ID NO: 10570 - protein, 234 aa, Enterobacter cloacae
VTLCVGSSARSWSKTIHSHLSSACPINQNECSNHISQFSIDIKVQDWLSRSRVAFIDFHNLRNTDKTTLITVEHLEALLTVMSTTLVAYAPYSKKRLNFSFLNSFTLSKTSQSYTLTFPVVLSPLLDALGGFIQECITEKLLKRRNSNFMVYEYLKRSGQSSHKVEDINNDLQLKTLNIRLMSVLTGLSQQGLISFICDGKRGDRRIEELQFIPYVQRTHPEVLTFQEWISPVD

SEQ ID NO: 10571 - protein, 78 aa, Enterobacter cloacae
KHDRFGSHPVRRTYSTRGSPMSNQPTSLPEEDIEFVMDTFQRSMGKSKPVRDTQIEGEKPQSKESANSTENPGYEEFF

SEQ ID NO: 10572 - protein, 152 aa, Enterobacter cloacae
GMGDIVIKRRNIRRSVYGLLIVLIAGNVWLGLRADKIHKVRYQDFWSPATVIKVTVMPSTNEIQLSGKIPKSVRVSNNYVEYSLPGTLSDKTIYRSVLEDEMLTLLNAGGQLEVKYTLDKQTNRTKVCTKCLRVIKDINHQYSATEVKHGQS

SEQ ID NO: 10573 - protein, 109 aa, Enterobacter cloacae
PTAGRRIIYFWQSVGFVRVIKDSGFLPAFFKPPCIVLAPFMRGFFFASFYELTSLSFIQRHKKLFRVTEPIRLQSDVAILVKVFSKGPVKCHLLILKLNPIMQVTAYWL

SEQ ID NO: 10574 - protein, 608 aa, Enterobacter cloacae
GYNLFPEHHMRKTLIGCMVATALATVSSAHAQVFSYSFTDTNKAVRNIKPATQTYLNPAGVLTLNLISGLDRYERVTVTRDSDKKVMYSSVSTKTSVADRIVAADGTEYYGKDMVLPALGEGTFTVVNETLDIRQTVVSTSTYHFIVDTTPPRYKSIYPSQNAGYDMVLSGPLWELGRGGSGQFSIFADGIEDASGIAKIRLVIKRSNGSVVSDNNLSYDTANKRAFYPWIKDMNTQAGMPSSDLDEEFTFNFIVTDLAGNTLNIPPQRFLYDDQMGEFTPFAVHDSRVSTSVVPGISSGYVPFKRGLTVLENPYKLVIRIPRTNWKPYRNGGMSITNNYGGVQVLSEDATYVYVEVKLPQGALDGNYYRPVNTYQWSGGDLGQYASWLNWDPASVKSPAWGSSPIERQKADGTWFNSVNWNLFKASDMPIKLTNIRFNVQARPYDQKITGGATCSIPAGSTTCTVSLPQDIINGTTGYLHSGYEVRSTTEATFFAPIWENIAWHTLGPSVTGFDYIETTNILQVYVNQPGDGSYFDHVYVNRVWLSDKNRNNAEISVTGKQTGRNMASGNYTYEFNMKEVPEGSYNVVINAQDTFNNTGNLPYQTVV

SEQ ID NO: 10575 - protein, 70 aa, Enterobacter cloacae
VDQVWIAICKQCILCKHVQKNGTTAYKGFYPPATMIVWVVMADERHQFRFSTSPFDYRHVSEMSSQSVYT

SEQ ID NO: 10576 - protein, 102 aa, Enterobacter cloacae
APKEKSVTVLDVILSLIVIIATMNGDAIPSVARTITDISDRFSLADPLLIADIALNITNVLLSIRKQHKSMYNIGFPQPISDGYPVILHKFDSTDAFKISLP

SEQ ID NO: 10577 - protein, 64 aa, Enterobacter cloacae
THTCSSQTPYFYLFVCRLRLFLRCYGFYLTTKLDLHKHGRNMNHLQVDSRKPGECWWFQCNQIQ

SEQ ID NO: 10578 - protein, 61 aa, Enterobacter cloacae
THTTLHVSFSLGTNFSSVVLSMILRPDVHPRDLSLWLYIPVILAAMAALEFTSIERVPSFS

SEQ ID NO: 10579 - protein, 126 aa, Enterobacter cloacae
EFGSGTFYGAPGLDKRDQCFSIILFQNVLLRIRYRPDIHHLTGKRNLYGTFTTDIQKAVFTGYNTVACDSISGSNGTKNQLTTINSQSTDMLGTISDYGCVISLRNKHCIRDALSIYSVEHKVTFS

SEQ ID NO: 10580 - protein, 184 aa, Enterobacter cloacae
IKRCSGAQFDRRFTINGNNVTTSGVINLRIGPLYVQRNAINSDTVTGIFEAAIIHQDTNIIGTRCKIDISVINEQTLITRYKTSRITKRGGYIRLVSKNRTRILTCDGTIEAVCITINLSHNSAVTYKVYANTLFKRCFSPPGNVQALSIIPQNLKITSRPGNDFASCTRDPDTAATGAGGFHL

SEQ ID NO: 10581 - protein, 74 aa, Enterobacter cloacae
TKCYSQQFRQCMSLPLDDKPCHHADPVQEQELELELVQVSDLVQVLVSYQARESYLVPGPVTALNADTSRRLRH

SEQ ID NO: 10582 - protein, 110 aa, Enterobacter cloacae
RWYENDKGKTDIVNFHKTKMNLFIYLLEHAFQREVTSDELLIMFWDKYGLKSSRRQLWYVLGQLKLSLYSLGIPYDFIQTKKGRGYHLEKVKIYLIIDSGTQCSHLDHSR

SEQ ID NO: 10583 - protein, 61 aa, Enterobacter cloacae
SIKQQAVQLIRLLIILLWGLWLFFLQPMEVPLHSLLRGDLLVFYQRMAMVQALWPVLVVLV

SEQ ID NO: 10584 - protein, 61 aa, Enterobacter cloacae
SALLGNRFFAQGVGDIQPGVTHVQALVQTLSATADKDHFLTQKEARAISKIIARQEAAKAQ

SEQ ID NO: 10585 - protein, 65 aa, Enterobacter cloacae
FHVIFRIRKSNLTIFMLRKFGPFFRMKYQHLLNPVRSLLILCGFNRIFPVNNSVGFSAIFGHKLM

SEQ ID NO: 10586 - protein, 75 aa, Enterobacter cloacae
VIVGIQRHKPGVAAIADVNGADGRRAVRYRLPDPNARKLLAGSLGQRDGAGIEAGMIGRLRRNRLNKMHRKLAFG

SEQ ID NO: 10587 - protein, 68 aa, Enterobacter cloacae
IAWYSARYRCNFITMHCTAFTRFLKPLALNVACDTVIFRRLGHYARLMTQQTSILCATGSEQNPTSIK

SEQ ID NO: 10588 - protein, 82 aa, Enterobacter cloacae
RASGVNVPLAGDKANEGEMDISVDSKTGSKPVMESNSRIILAADAALAAINEHFSDEFVKGEWADYAALRRAALRTALASLI

SEQ ID NO: 10589 - protein, 63 aa, Enterobacter cloacae
MPDASDYFSCNHIFGFTVRKVGDLDTVIVSNPIISLFHNSPLKLFHLEVYMTIQNPVVDKTFF

SEQ ID NO: 10590 - protein, 90 aa, Enterobacter cloacae
KTNIIKMIQSQLTQVIFWLGLIAALPAFYRFVYAGSSLIWHKYFPVKKIEIQLVNEDKALIENIVLDLDKQDAKRVIELIESSRKKGKVR

SEQ ID NO: 10591 - protein, 299 aa, Enterobacter cloacae
NRKVMEKTTSFKVFYDADDKELSKHAIDAETLGNSILSMANLISKADDLINEGGKSVKVLFSAPVEKGSVGVAYTVVQLLPDAIDVLKTIGIVGAVGTAVHASALSLIRHLGSKKVISVTRHTGKKKGIATLELDGEDIECSAPVAALVTDPAIRNALIAVVQKPLEGKDSPVFKIVDSKGKEIVRLEGDETEEIKPVPKGTLLEKDVEIKEVNVKFTQVNFHSEKGWRMEYKNEEHSVLLTDYEFLAKVRGAEGTITSEDLFSVSLEITKTTSARASAEKYVIKKVIRHRVAQGKKLI

SEQ ID NO: 10592 - protein, 65 aa, Enterobacter cloacae
TFFLFWYSWFISPVDFQCRTPLANLPTRCFGKILVALAVMLAGCAIQFDQMAYTALNSMNVVLWH

SEQ ID NO: 10593 - protein, 72 aa, Enterobacter cloacae
SNPHTEEIAMKEGFYWIQHNGLVQVAYYTDGITEDLETGQTITGVWHLTRGDDICHNGEAEVIEGPLSAPLK

SEQ ID NO: 10594 - protein, 138 aa, Enterobacter cloacae
EDSQQYEGGPMSDPFSGTGLAGLALTGASVYGLLTGTDYGVVFGAFAGAVFYIATAADLSVLRRLAYFFVSYIVGILCSGLLGSKLTSWTGYTEKPLDAIGAVIASALAVQILTFLNKQDIGSLVALITRRGGSGGTK

SEQ ID NO: 10595 - protein, 96 aa, Enterobacter cloacae
RAGEVQVVLNDPTATINALLCAGVVITLMFYRRGDSRHRPWISRLAWLITVTYSAVPLAYLCGIYPHSSWATIAANIIFLSVLVAVKGNVACLVVL

SEQ ID NO: 10596 - protein, 113 aa, Enterobacter cloacae
RMNSLNRLRPAKQFRCVPLVGKDSPFGYVERLNNQADENNYQPVNAMVEAFALMNEKGREEWLKLIGDSETTEASPSTSSDGSPRPDALYTFAKGTIMSASALLSNSSVNLQS

SEQ ID NO: 10597 - protein, 243 aa, Enterobacter cloacae
RTGRITVMNNSQRQLRLLNLVRKLLKLGRSNSNAHEAGLALQRAQKLMARYGISELDAGLTSVREASSRTAPSDAEKVPEWMVTLVRGVCHAFGCRAYYSWRQTSAGYRRSVTFYGFSEKPEIAAYAFDVLTRQLKDATNSYLKTQSKRLKLATRRARAEQFRDGWVCGVREVISATDISSEEQQVMSHWLESRSMKTVTTRELKACRGADTARYQGYEAGQNARLHQGVSGRGPAAIGYRQD

SEQ ID NO: 10598 - protein, 198 aa, Enterobacter cloacae
GGMMNSLSQAANGLLMQLVMDLRSGYLRRCESLGLNREEMQMLQGLSLEELHYLSGSEVSIISVGINHGNLVRMLQQARTEQKRLQRIDRALALGGSIELMANYFGLSSTDVAARRRIAGIDVRPGRGNALGDEENAALWRQWQKSDVEDAESADGLDVMMLAAEQMNVSLTSVWHAVRGWHKTRQPSPARTPVRKTA

SEQ ID NO: 10599 - protein, 125 aa, Enterobacter cloacae
RAGRDDAGCRTDERLADVGLACGPWLAQDPAAFSGTNAGKEDGMKYRMVAPGLRAPHGTPPQCCQKALRQVRRFRQGARNYTRLDEKGCGYYKIDLGPFWRLLSRNEGRTWLLLSHERYNSAIRK

SEQ ID NO: 10600 - protein, 72 aa, Enterobacter cloacae
QPRVEQQPAGNGIMHISGKQQAVTYPAIIPPGTGRKAGIHFIQRISNQAFCRQTHYFSFSAAITAVLNCQYA

SEQ ID NO: 10601 - protein, 84 aa, Enterobacter cloacae
ESRRAVSAPAPPLRLAASIHGQSFSLQALEKHAAQDSTFSSNMGMRVGFYEGASEKSRCGRTGQRDAYFMLLARVSTLWRNALT

SEQ ID NO: 10602 - protein, 143 aa, Enterobacter cloacae
NLFAFVIEMSFQPDDWLFRHCKSFVRYSVPAFISETFFNNAGYDRVVFSIFRSWHKDFKLCRCIRLKQNGIETRRIKQSAFRINELNPGAFVVRILKLLSKVIAKVNYLTGMLIRDCTDQVKTMRGHTQFPGSGLGIDRPGVK

SEQ ID NO: 10603 - protein, 88 aa, Enterobacter cloacae
IRLFQRSSDLVVRENDAVKSNFYTAIQKKVSISHITNNPAYFRMCVPLDVKVKPLRQTRRPLNSSLSHTLRCFQPTTRNIARNVTDNP

SEQ ID NO: 10604 - protein, 75 aa, Enterobacter cloacae
SGEQPMKIKLALVIAFAGFSAGVSAEIAEFSFKDTLNVKKTVSPASVWINPVTSFDVAGLFFRSGPLYYAQSAEK

SEQ ID NO: 10605 - protein, 174 aa, Enterobacter cloacae
PVDSFCHDYSRTNRRNHIMTKYYDRSGIEISSAKIRCVDSVKGTAEYTFRIVCDKCNGRGERKHFYRSRCMACKATGYSLETTRTAYTLNALYRINAQAARKVSASLQDERLRTESAHSSAFTAWCRSHQKMVDAITQQSSSNNFLESLKSSLTHQRQLSDKQLAVAARILGIH

SEQ ID NO: 10606 - protein, 401 aa, Enterobacter cloacae
IAHPLRLKMKLFSISSRDTSMDAMFYIQASTKQQASYIFSTLSPKPIANCQLTDLQNETVVPSISPISLSLNPWSINSQSRTRELRMATHGLNLICAVTDEHTRQIVDFCDNLGQQLKDPDDKSAWVKLINSECALLNSPRLYPVLLEPDTPAQFEIFVPAPEDGEHDTVIASVVKECFGDECRYRVTDKAFAMSEKPVIRLEAHFNDKREKVLELTFSCFNLSLSASVHENQLRQILLLCEDFGVRLQGRAGASCHVNMRSAYRRLAHVGTGSRPGDDSDVRVYTSLKEEKDVKRLLDKSTRGSELVPARHGQQFNGVLVNATPASATTGFIYLSHDFPEGQFMMTAEVLHVGITPGGIYYIETLDGYRFIVTAFEKGLMNGLREFIAANEEYFKYYRWS

SEQ ID NO: 10607 - protein, 93 aa, Enterobacter cloacae
PQTVLEAQMSEKHFIVKIQNRNGDHENSYVRLLVSDCEKNACQTALISECHGELEQLSFEDGGVYDYNGENHYSVRSCVEVAPEDVATLQRFL

SEQ ID NO: 10608 - protein, 146 aa, Enterobacter cloacae
SLSYTSKIFIIFSSDLLARILDSVSFTYGKSFENEVNGMHSQDPITKLTQTLQRDDGSQVRIVAQRGYGSGLTASLDVYVLRRDSSESNWSLCGKDPHPEWRKMSVDEYQKFGRSEMLRYATPGEILRVASAIGQPMSFLDGNPAF

SEQ ID NO: 10609 - protein, 238 aa, Enterobacter cloacae
IIKESTVADNYTQASFIIPCTQEQAKMAQEAITFVTEAEIAEGERLLDKPLTDCSLTEKLILSIIENHPEYDPSEPSFGQPSCPDCNYELLFATEVTSSGLAVFHGETIDLDHAICLTTAVLSVFDLSEMVTITAAFTCSKSRTDEFGGMTILVTKDTHYYQDGCQFSRLMNEAHKAGIQYALCKVTHYHGESSYVASYVLSCDVADSAQEVVNKRLKACAGKEPEESSPRGWKEPRY

SEQ ID NO: 10610 - protein, 544 aa, Enterobacter cloacae
RALTLPVYFSGLDRYITLSLLKSDGSLIWSTKSSLVTVDDRTTSSTGFDYYGKTLTVPAMGEDSFTLREVITDLQGKEVSRQDYPLAIDRTPPATGTISYTRNGWNFGSEAIFTSVPAGMQYASVQALVFNGLSDKGSGLANAEYFITDAAGVERKKPAEINTVEGSVTVQVADASSNALAPENRSEYKVGIYLYDKAGNRSELSRRSVIDRVKPDDIIQVQDATTGSWVSYQSGMTVFQNPISVRVLRKKSDFTAVNGSKYGWADSNFQTSDSTYNIYTFKYIYPNVGDTYHEFQTLAGGVRRIHHNSLNFTPAPAMEIAPKIVAKEMYRSDTSEWLTQASISVKTATISRIKVTAEPRPYVQKFRTVKNAAWFCTIPVGQSSCEMTVNFNYTSDKGFEYLHLYSGKDGDSIFDALAGNFTVIWDNNPPVVNVAQVNKASKTITMTATDNDRVNAWNISYWDTKVFEATLKNARGETFTLKPVTVSESDYKTKNATFSYAGLPDGDYTVVSVSATDLGGKLRNQTAYGPAENSLNASGYCVHL

SEQ ID NO: 10611 - protein, 96 aa, Enterobacter cloacae
NASVLHPAFNEGHWLFIAEQDNRYIEVVCILSLASESGEQHIDVFINMFEDPIDDVISRNIETKTFATLYKYIERIPFTPGVKKEFLSSIENINFS

SEQ ID NO: 10612 - protein, 110 aa, Enterobacter cloacae
RWTDMKSDTEMVSPIELHIGDHVQRHGALFEVMHIVESECDIPGGIRVAACISRVIGDVTGNIPRGWLETPKRMAERGVKWATSLPEGLYFNIQGNAHAKVSRVIRNVTN

SEQ ID NO: 10613 - protein, 266 aa, Enterobacter cloacae
LSVKAIIKPKTPLSHTLVYRTGIIRLLACLPRILVGNSGTKPLMAPLKIHSTLPVIAFTFNGADAERKLVKGLENLRISVTDASGDASLISLQLAGGPNSEKVTLAFTPLSKDVFIPEYPRIFPNTDESGQMYHLEALAIDESGNRTTKTLNFTYQPANLIMLDNLKTLATAVALKATDNTPLAIIRTSVLRRQDGSIITGQLNGTLTVQKNAQFGVTVAGVTVQPGETKSLSLDLGNGEERTYPVTPAVSGQSGTATFTIEFPQT

SEQ ID NO: 10614 - protein, 150 aa, Enterobacter cloacae
HEYERSRVMSNNTEVISCDLFSTLSSLNFSTEDITGLTPANFRKGAFLHAKISASQATRATDISIQLLTDRVSGEMNYVIVIGRHEGLLQSEAIDPNADKQYRENRYSRHFISVTDANTKALKKTCKVMKTYIKEQAFKPNTWGHSFIKG

SEQ ID NO: 10615 - protein, 215 aa, Enterobacter cloacae
VQRNNITGILVALMKSCFSDLPVKDGTSGTWKLDTFEITADKAMSLALRAEYTGNTDEFIPPGRYRRLSNGWDVVMSNTPMEIRTCQDFLERATGRVLINGLGLGMVLHAILQKEDVTHVTVIEKEQDVINLVAASFANDPRVEIIHADAMMYCPPAGVTYNACWHDIWPDFATANLSQMDKLEIKYRDICEWQGSWGREECEQKHIEFQNLGAD

SEQ ID NO: 10616 - protein, 129 aa, Enterobacter cloacae
NSQGGIRYWPANELPRWQPCVLARTLATPFKPASFFLRATDGEKMNLNERSTSAATPDLSRLYLISGRIMFDDDDQAYLVEADSPGDAEEAFRHHIADSADDLEKVIIVSSTSFASAHSSRVICRPAVK

SEQ ID NO: 10617 - protein, 79 aa, Enterobacter cloacae
NMRLTYEHQPTFWDFRSTRYTSFCLINHQMINERMNTMYTLCIPENKVYMAYYTDLSINYLLDVYHVYLSPYLSELHSL

SEQ ID NO: 10618 - protein, 73 aa, Enterobacter cloacae
CVITHKHITSGVIDVSTHKNERRGNPPFQFRLDPELREMMERAQQQDGDESLAAWLKRIIRKELQQRGIEPKG

SEQ ID NO: 10619 - protein, 95 aa, Enterobacter cloacae
NGKLSCRGGSQPGQSGIGISGESQGGQAMTAIYNLVRCSDGKTVFSFPAGGRYLVDTSNGLQSMRPLMDNEILFTVESAARFLKKIGYQVIPPAS

SEQ ID NO: 10620 - protein, 98 aa, Enterobacter cloacae
PGNHPNLSPAGEQGRGYPDTPRYGGKRMKKPTQNESIAMLTTSAGQALEYSRQALAVLDMWIDTLAPDDEMESFRVAAVHSLVSQASEYLVKVREVRP

SEQ ID NO: 10621 - protein, 79 aa, Enterobacter cloacae
IAINCSIVAINGILTIAITGGIMTKVNVKPVLLNREQIQALKTIQERERQKSGMGIAPSIHAVARKVFDAGLSKMEAGQ

SEQ ID NO: 10622 - protein, 477 aa, Enterobacter cloacae
RKMAMNKKAERRRDFYPAESMLNQPFGSIPRCWSSLRIILLSHAARDSSPSCCCARSIISRSSGSSLNWNGGLPRLSFLCVDTSITPDVMCLCVMTHYTQEMKKTTPRSAGTLSGRLTKTLVEVTLWLALSLPKHALNLHGVFSPWVNSQIRSSMLLLPPSAKPAKKRQKDVSVFWRVDFVLRRCSMFNLQTLTAKARELRGNVVKATTTKGTRTMTPVYEREEQRKLRERIQQTQPDWVLLWWDIATVTGWRTSDVCNFRYSCINWETGIATIIVAKQTKAAEARATRKGIEIVRQQRKDAARLAGDHIGYMHWDSVSCDELAAGMTEEEQAIVFELVAKAEVKHDTKQLPPGIIKRLRERMERNLIGDDLVFSRSQIESNRCQSLEGSVSRQTIWKKLHNVMVWFTRVVNKRLRLSAYSSRKIAAFNLMSAGGEQGLLVASEMLGHSNPAITRTYLQLGSKAAAIQTRLAMEVNA

SEQ ID NO: 10623 - protein, 123 aa, Enterobacter cloacae
TQNEKKAAISKKLSAAFVDEFYLWQAGNLSCDSSRLLCPSLRKYFHHFVIAIFLLLEFKMKRTLNQLTLVIQQPLPADNNGTIIAAMESRHVNIQSVLIASQRLRGNDPTGELAAQIRHQRIA

SEQ ID NO: 10624 - protein, 98 aa, Enterobacter cloacae
NRRDAARCVRYCTGILMSRRKFLILWHIYAFSYLCIFIAFFAVVPEVKLFDYLSIKYGFIDIERWDIYYSIFAMSTTVIINFLFILLTFRFTSKTKKK

SEQ ID NO: 10625 - protein, 70 aa, Enterobacter cloacae
SINEPEFMGVADHHESSFEPPSPVKEPDIHVILDGKERANVTVTSGLEVELLEIPVAVISMIVEPLIVAH

SEQ ID NO: 10626 - protein, 77 aa, Enterobacter cloacae
PTVIVKRDIDKALSHFFSNIRIAYRYKKIGEPRLLSCVYARIIHSHNCVASTIGSDDISGKTISLPAGKTAHISTTP

SEQ ID NO: 10627 - protein, 63 aa, Enterobacter cloacae
HQDDPGVSENTKSTRWYHYRLAAGKLYINVEFAPKSPCQSVIITYRINNDYTVEQFAELLQAA

SEQ ID NO: 10628 - protein, 164 aa, Enterobacter cloacae
SWPADCTWRFGRYVRYSGVKMAESETDGSSDVMMGLGESFIFCISTVAYNSLQRSDEWRWVEQTRFGKNDSLQCTGRPKPTITLAGKTHALFLDGAGVGQIELLRQLGNTYEPQQLVMGTGEVMGYWTITALSENQTSFLAKGAPKVQEFSLSLKYYGETLTAS

SEQ ID NO: 10629 - protein, 103 aa, Enterobacter cloacae
LLLRFKMTDSLLETIEIPLSRPYEIDGVAHDKLTMFEPKLRDKILYSKDKGTEDEKSARMIARLLNVKDTDLMNLPSCDFARLEDAFNEMVKDPVDRNMKLFS

SEQ ID NO: 10630 - protein, 355 aa, Enterobacter cloacae
GYAIMGVNDSRINTGEQPWLPNFFISVGDTDITEKVRKGLINISLDDYGGSNKQTDQIKVAIVSESLRIPARGVKVTLGLGFGTQIVNKGVYVVDGGSSGGEPRIVEFTAKAAPMNSAKGLSTVQSKKTRSWTGNTLGDILAKVANDNGLTARVSAQFAGKVIEQLDQVGESDANLVSRLADRFDAVSKVAGGYWMFLPRGAGESASGKPLKQYTLVRTGNSQWNYSRNGRSGDSGDNSDGSKDTSTFVIKYHDQSTGTIKELRSGSGEPVIEAPFVEPSLAAAQELLPGASSSSKKKEITMSHSMPATQDLLSLTAECKITTKGFGPDEDRSWTINTLNMTLGESGFSVRLQLE

SEQ ID NO: 10631 - protein, 65 aa, Enterobacter cloacae
CHSHISSLLSIKNNVYIGFFYGRRWFKRRFMVVGNPHKFRLVYASYAKHERDIFFYYKRSLSVLF

SEQ ID NO: 10632 - protein, 93 aa, Enterobacter cloacae
GLVAEGHSSYLIIRNIRCILNASLSGYYNPLEARVKTRKGSQKKHAFNLLIECRKGLSKVFKGGETVNNPPRVPIDTGQTLPVYKKGNACLNV

SEQ ID NO: 10633 - protein, 68 aa, Enterobacter cloacae
RNSNKQTAFQRYILRSVKIDDLFTGVLMSLPALIAKKCDRTQIFSEQISQISCLTVLFVRTAHPNRLP

SEQ ID NO: 10634 - protein, 80 aa, Enterobacter cloacae
RRASATRFLSTKTSRKTASGGGYVLPDLNTPQARVSEAPSGKKKAGDIASGFFVPAIQTISCAYWNSAFSSACFSAFPSY

SEQ ID NO: 10635 - protein, 70 aa, Enterobacter cloacae
SWNKKVGRAAESDTSNLILLKVDVSMVNDWGEQSEQKAPSGKKFARFVPKKSAFCHIFLQLRQVTTSELP

SEQ ID NO: 10636 - protein, 74 aa, Enterobacter cloacae
AFIMQKFPFKGINLCLNEGINGTLATPRRRKNLVLRQFVEDRYEKTGVVTFSGTGFFQRHRGIRSNSAENSYWN

SEQ ID NO: 10637 - protein, 67 aa, Enterobacter cloacae
DNMERNAHRLTLHSPAGVILHLTWSEFIDFAQLKCRFEADSASEKRKFTAIYYDATTMQHPQSKPLT

SEQ ID NO: 10638 - protein, 112 aa, Enterobacter cloacae
FNGLTGNMLMSVNTETASAQGQTTVLEKEGVYASLFEKINLTPASSLGDINAFLDDAALSDAPAGERLTAAMQVFMDCIRKSGYQCCRSGMADDACARFGANAAGRVPGSYT

SEQ ID NO: 10639 - protein, 217 aa, Enterobacter cloacae
RRRCRCLWTASANPVTSVVAVGWQMMHAPDSAQMQLAASLAPIPEGLSTAQLQALQQTSPPPEPGISKTQQMLAQLLHLKPDWAVSYGDRLVQQALTLWPEEAKSLAQQWHTQISVAGLAESDLNGWHQGMTQLQQLTNRLNALDEQKGKYMTVSELKSAVFAMSQSFSHTVPLEEQLRLLSILPAGQPLSAAQLKQTEQHLQQLIASYALLKHQKE

SEQ ID NO: 10640 - protein, 107 aa, Enterobacter cloacae
MQRQAMGVALHIVLLPFFELLHSTIDSYDADFIVGFFLPPDYLRLPFRGQHPNLEEKMSILLALQRLNTWQSDPVPTDPTPIPDPVPRPQPMPDPPPDEEPIKLSHR

SEQ ID NO: 10641 - protein, 177 aa, Enterobacter cloacae
STKKNNETGEKHGVDMSARERFFKKVQQSIGDKPIYVNTAEAEVRAFCERMEDLAQQIITWFEGSGIEIFLSKKHITDLSTVGYSLSSGICRYAITTIILQNGDRSVTIMPEQVIRGSEKGCVTMSINVPDSLSGARIFHLSMAPETGWYIRRGHQSAKENILMTEDCFFQAIDCLA

SEQ ID NO: 10642 - protein, 102 aa, Enterobacter cloacae
SKYPFKSWKIFDLNCVKMSKLTFRRVNKRRKIDEYRSEVFAVYHHCCSCSDCCRWFNRCTALIQAEGEPSPSLAAIVTSPAKIFCQNVNFSFFVIDVMLLTS

SEQ ID NO: 10643 - protein, 76 aa, Enterobacter cloacae
HHAKDPSLQEIKMKAISFVEAKDIIGGALNPFAGLVKGAQLGYDTGASIMGMVGGVVGGVLGGAMGFLGALVGSYN

SEQ ID NO: 10644 - protein, 162 aa, Enterobacter cloacae
NMSRTKMSVLFSIVLALSVIALLWIYFTRTQDEGFGCQSDTISWKTYSTGESTDMSLTTLFLFNNKDVVTVIHKGVLKKEGKSYLIDRNYTLIVEEVDGSNIFYIKDKKLNKSEDDAAPDGVVNEMLLDNINFFYITSVKKHAWLIKGLVLPVMMCVAVPTS

SEQ ID NO: 10645 - protein, 72 aa, Enterobacter cloacae
LQLIHVNRKSIMQVIDFKKAQAIIGGWDPFAAAIQGASAGYNAGSQMLGALGGTIGGVFGLVGGFIGGFFSA

SEQ ID NO: 10646 - protein, 77 aa, Enterobacter cloacae
ILPRNSSARDLSISITLTRQKVPMVFPSSTVAAGASIFAGCVEESHAVRSKKVARTLARKKVISIGYYPHARAARVH

SEQ ID NO: 10647 - protein, 90 aa, Enterobacter cloacae
RSHGVAIYSHEKYLSTDPGAESSILSAAQRIIVSCRKESRKAEETQKGKSCPFSGGERAYAGGTSVTGSAGKRVLPVSVTAAPERPPASF

SEQ ID NO: 10648 - protein, 82 aa, Enterobacter cloacae
FNPHSSVIGRCPAEQIIQIPCQLFILLILLNVIDIYPSSGYSHLVNITKEWLISSWLNIKIICLAKPTASWKCLNRFRASRR

SEQ ID NO: 10649 - protein, 113 aa, Enterobacter cloacae
KPLRPSTATSLMYVALVPYSPPTDSPWNRRASNSNAGAHVPIVSYPGKQAITSEPTHIMHTEMSMDVLRPFLSAILPNSHPPMGRIRNPAAKTPAVCRSCVVVFPDGKKICAK

SEQ ID NO: 10650 - protein, 158 aa, Enterobacter cloacae
NNFNNGAALTRPFDYQQDFANINFREHPERYQVGRGEQGVLMVEPYKSEILPHWRYKNAEVAARSAEEIYALFEEYRRNNDFVGMDMARKFIQMGYTRARRYANHKGGKKYDEKRQVKPLDHDPVKAEAAAVFKTCWDKIRADEDYLQRKKAHQQAWG

SEQ ID NO: 10651 - protein, 154 aa, Enterobacter cloacae
YRKRKCCMSDKNHHTTWEELLEEYFFARNLRAATEWSYTKVVKGFLKFMGAGKTPLMVTHHEILRWRRHVLREKQQSAQTWNNKIAHLRALYNYAMESGLLPEGRNPFNNCTVQRDRKKKRTLTRSQLTRLYLIMQQAEIESNRSAHQRQRSAS

SEQ ID NO: 10652 - protein, 80 aa, Enterobacter cloacae
EFFSPKTQFSPLGGGLKLGPKGYGCSPFKVVRELGLERRETVRSISAVGAGELRGVAPSTRGPEWTHHWCSGCHANGTAR

SEQ ID NO: 10653 - protein, 65 aa, Enterobacter cloacae
  UNSURE (45)
GIKAMPLSAQQLAAQKNLSYVLAEKLAQLILAGKYAPGSILAPKXGKRWSWEISLALAVQPFAKR

SEQ ID NO: 10654 - protein, 113 aa, Enterobacter cloacae
KNSNNVIANGGIMNVHLKYDTIKHYHFDWLTPAGDYPNSAVMLVGFRDGRWIIVQEFGNDYSCFEGVLKNGDDLNTEPKFYSDLESVAVAAFGMMKQIYPQYQDSTLEEFLAG

SEQ ID NO: 10655 - protein, 135 aa, Enterobacter cloacae
EDNTRSDNKVVSMIVGSNGSTFEKGRQHYKIHQQCTQINYWYLKMKVKELIAMLNERDPEAIVLISGYETIGGTEVAEADLLIDMQSICLEQADNLTGNRKVVSSGGEDSVWLGWKDDYRTKVFLEDAQIPDQDE

SEQ ID NO: 10656 - protein, 118 aa, Enterobacter cloacae
VKITYNQYLLEQLMADTYLPPGFKKCKSCQQVKPFEQFGKELKGKFGLKSKCRACISEKNKTYAAGPGAEVKTQNNRTYQAENKTELAEKMRVKRAKEKFGDRYNSYLASLESMKKLK

SEQ ID NO: 10657 - protein, 486 aa, Enterobacter cloacae
NMKVTIDGVSYAPVCNAGARIGIAITTHNRADALKRALAQHQQFLPQGALVVVIDDGSKPPAEVFEDVQLLRHETSLGIVASKNASLTALMDAGCEHLFLWDDDAWPIADNWHLPYIESPEPHLAYQFLDLAGTNKLKDMAILYRDDKHIAYTGQRGVMLYYHRSAIEKVGGFDPVYRRRMYEHSDLALRIHNAGLTTWAYGDVVGSEKLIHSLDEHEAVERSVPRPDRQALVERNVKIHNERRDAGFTGYAEYRQQRDVVITTLLTSQPDPQRGTKMAASPDMLSKWAASLRQCGRIALVDELLTAPADVELYLVPDVKMNVYFRRWLHIWQHLRDHPEYRFVWCTDGTDVEMLRAPWEEMQPGTVYVGSEPKTYADTWAKQNHPERIYQEFIESHRGDVMLNAGLLGGTRADVMAFAHGIIRLYYRIESYRFWKKEQAGAAVGDMLAFGIVAHSFAGKVITGPQVHTVFKTDGIGKDNAWWKHK

SEQ ID NO: 10658 - protein, 270 aa, Enterobacter cloacae
ASIQLNQFSYQYDNEFLFLTSLDTPYRLKSVDSGRCALTNPFSISLNVWSRVMGILTFDITCPHCLRENAVLEGWAELRINAGPLVNVAFSCRSCFQAGIAMVKMNNPVGFSPLSKSKQNKDVNVIIPGNLEYQLIDVFPKPITLSAPDHTPSRAAMAFVEAKDNLGRGRFDTSVMLCRKVLDIATRELLGNDSKDEKLVKRISMLHGKGLITDQMKEWAHIVRIDSNGAVHSDEEFSKEDAQEMIGFTEVFLLYAFTLPDMVDNKKQNQ

SEQ ID NO: 10659 - protein, 67 aa, Enterobacter cloacae
KSRTMAATVCISGCNFALTRVNVSIQPVSGGTLTHSGTEEWLITSDKEMKCLFCTKECILIKVIPLL

SEQ ID NO: 10660 - protein, 63 aa, Enterobacter cloacae
TMRFYAYYWFLDKTMTNLPERQKTPEIRLIWTGALTLAPMEIFARANLCVYKLVLLYNPFTLS

SEQ ID NO: 10661 - protein, 67 aa, Enterobacter cloacae
GRHCPRIKPTHQRRRFRVLETGFEESFGEIRLRHCVASMDTSYEDHCNAWQGKKNNARHNRACKVTY

SEQ ID NO: 10662 - protein, 92 aa, Enterobacter cloacae
SRSSAWADAAHSNTPALSALAQSRGLTDNRSGFMTHVIEKIAFPLMGSDYSTMNSGLPVISSGISIPISDNMVGAMSESLPPSTAFTDLSPT

SEQ ID NO: 10663 - protein, 66 aa, Enterobacter cloacae
KNQDRSIPVRCGKYSQRHKANLFSAACHVKKASKWPENSLAPALSLIFCGYFIDSAVVKLRKIFVS

SEQ ID NO: 10664 - protein, 213 aa, Enterobacter cloacae
VIFYTLSRYGGEMETLTVQAYLNETWTDIALIKYPGSEKNDWNTTQLDYLTEYAINFLDYDDFHAVSVNHPVSLFFDDHGQPGWLRFIDDIIPAGASRRYWINALDISELPVGQQNFLLLKFGTMSPVGNLRIKESVPEWNKFASTKTFTVADVIDRAADFLDYAQERGAAAGGATGAGGEAPKLLLRCSETDAIWIDTWQNEPDNRGPLLFG

SEQ ID NO: 10665 - protein, 60 aa, Enterobacter cloacae
RRNLRLLTFRFLVTRGNPHIVIHFHIRKFIPQDNELISCIHANYELTATLTSTDIRRRGE

SEQ ID NO: 10666 - protein, 68 aa, Enterobacter cloacae
PDSGFNQLLAGLLSLFFLFARHYLLLVTYKIDTLSKDIAVVVSDKVLTKIRVSFAQKKSIRLIYKPRE

SEQ ID NO: 10667 - protein, 61 aa, Enterobacter cloacae
AKRHPAKKPGPHREGFFISALLKIAAIADKIITLDSHASYTLELFSLWLGLSVAAGTVTAI

SEQ ID NO: 10668 - protein, 73 aa, Enterobacter cloacae
SATSPIRKHGIRVVRLNPNQSRHLPAALSAITVNSKSINAVKIPIIIVKIVKSIVSDIQLTEPLQSPKKRDKR

SEQ ID NO: 10669 - protein, 178 aa, Enterobacter cloacae
QKALRQPGCRKLQECNKAYNMKQLTFNDLRKQSAQAANSPRLRAHHNFHPELSDPVQRLAIAMEPGTYVRPHRHPHTFELLTSLTGRFLVLNFDDLGNLTQRVVLGEDCKVLEMDAGTWHTVLSLDEGGVIFEVKHGRYQPVADQDAAPWAPAENEPGTAELMKWYTQAQVGDGGYPR

SEQ ID NO: 10670 - protein, 130 aa, Enterobacter cloacae
DEASMTSTLDPSHKQIEMWRRATGSEGGLNEYRNWVLENSMRFTAYGIHTVIVEGEAKHITALDDVTLCNEWAKLKRENNRLYAANEKICSGWRGFVLRLLGITLPCRKPVILLGVDGKNQNDAVKGADL

SEQ ID NO: 10671 - protein, 121 aa, Enterobacter cloacae
FSGEPTVLRKLFYGYVRKIMFSERSVHLITSCTKGKNHQGHVWPTLDIDPKQTPDDAAYAWSNIVDDARSNQAVPALSLYSGNHWSTAKEILNSTRNLELWIISAGMGFLNSRDRALLMRF

SEQ ID NO: 10672 - protein, 77 aa, Enterobacter cloacae
VCHATNNGYLTFIYSPTMLIVRHAIRSFSLSRATFNLMEECMYGLSLIRLGLFIALAIIASTAIGLFTYVVVSALAE

SEQ ID NO: 10673 - protein, 323 aa, Enterobacter cloacae
TTMNATGLNIIKTLGCMTAVTFFTIYNTWDHYDYDYHWILGFLTFISTIATPLFFVVAGYLDGQSRHGTRWQLDKIKRLVIVFLFWVTIYYLWEPYQRGYLIQPWFVFAFIVIYTFHPVVERLGQRRMLFCGVITALLLFSYGYDLLSALYPDAHVLSLSPQYRLWTWLLFYLTGQLFCDPQIAAWIGRKNVVRAAVIAIPFIYLFTWFYERHFFFALFKADRNAFILTGSQIYILIIALVIAANGVRFRRNAEFKESVLAAISKTMTGVYIMHYSVFHLLTALIPVTSLSTKLALIVLTFVTSVLFSLLILSNTVAKKVITL

SEQ ID NO: 10674 - protein, 74 aa, Enterobacter cloacae
DTLQRQYPCLGIVSTVNYARLRFKTDGYGFCTFRLMTERIKGISWLNGAANISAHTLSTVRRVSKSRKSRCPFL

SEQ ID NO: 10675 - protein, 117 aa, Enterobacter cloacae
SMAAATGWISAASCLTWRNQFWYEVNVGIETIIGLAALVISAIAGAFGLGHIRGTSKAEAKADQQRTEDNAAAMVAAAERRVETTKEASNVQQTVNHMPGDDVDRELRDEWKRPGGG

SEQ ID NO: 10676 - protein, 168 aa, Enterobacter cloacae
WTRGRKMGISPTLNIPQARFLAMQHKFKAYVAGFGSGKTWVGCGGICKGMWEHPKINQGYFAPTYPQIRDIFYPTIEEVAFDWGLNVKINEGNKEVHFYEGRRYRGTTICRSMEKPGSIVGFKIGNAMVDELDVMAAAKAQQAWRKIIARMRYKIDGLRNGIPLTGPG

SEQ ID NO: 10677 - protein, 309 aa, Enterobacter cloacae
TMKECKKDRLPEYKSLSVLLFIISIFIVIFIPVASLLILVILVVTIKKQKARTKPQENIYHFVKDMNAFGSILESRCLMSLTGGRCYATSIFNPYLGLSLFDTDNIKYVLVMKGKATDVFKPIISSYREVFLPWKWWKFFRGEYVSKALKDLEFNCDVKSVRNEYKEYNRFVCGSRKRVLFCYLYIDNLTELENDLSIYRIQKFLFWIGDIFLSVLGWIGIVCGNLIFLGLCGCEFVNSLMNYISKNNDSFATHFSIYWVIYISGVFFAVFLIACLYFILRKKSITSRVARQKKKYKSNYKFMLSISEK

SEQ ID NO: 10678 - protein, 131 aa, Enterobacter cloacae
GGAMSDPFSGTGLAGLALTGASVYGLLTGTDYGVVFGAFAGAVFYIATATDLSMLRRLAYFVVSYIVGILGYGLVGSKLASWTEYSDKPLDAIGAVIVSALAVQILTFLNKQDIGSLVALITRRGGSGGTK

SEQ ID NO: 10679 - protein, 77 aa, Enterobacter cloacae
KQRKRPAMYSRLLIICLATMLIASCVTNGSVPAVVDTGCDWVKPIFLTDQDIDVLDRQTKKDILAHNKAWKANCGKN

SEQ ID NO: 10680 - protein, 151 aa, Enterobacter cloacae
QPMKIHFITIALLATISSPSYAAFQEREYNTWYQKDAVLYDITQTSEGLPVMISISQPGRESANMLVSYMSDGGCGDEKVRLNANGKDVPATYTCVSVGADRIEHFAVNDASKVNEMVNHLKSDFTLLLQNDIKVWAANIKTPKYGLAPKF

SEQ ID NO: 10681 - protein, 468 aa, Enterobacter cloacae
LDLGERQHIHQHHLPITHSVSKQTPLRRGFLLPGENMLYNTGTIAINGNTATGTGTNWTAPASQIRVGQTLFVLSNPVQMFQITAINSATSLTVTPAASQALSGQKYGILVTDSLSVDGLAQSMSQLINEYDENIGAWETFATTSANQNITVTINGARVTIPAIGKLVQKGSNGAVGVSDGGTGATNAADARTNLGLGTSATRNVGGAPGNVMEVGAFGVGLTNFTANSVADANDITFNGFSGGGGASSVNFFDQYAGLLAITRSGGGDGNGFIAQLQISGSGAMAVRGRAGTTWSSWMQVYNTGNTTKASDGTLKAASPVARIVASADTCLRSDIAEDGFSWCGCGTANTEAEGIKILRLDVGVYVLTGSSGLASEGWQLLPPMDPGGMGELGVVEAEQTADGELTIRLFKRKYMLSDEGEIVKTKGEPMDVPVNSWIDVRLDMPDDSVFNQRMRQEPQLEPHSPAL

SEQ ID NO: 10682 - protein, 63 aa, Enterobacter cloacae
PVRVWRSRCFTGACPLIYPHNGLLYLLAITRLGAASLLLHGLMAAVNPLTVSRSLAHPPVKTI

SEQ ID NO: 10683 - protein, 78 aa, Enterobacter cloacae
YPTLTLVVICLAARLYMTLMRRMPTPGNINKKSNETETPVALAERAFFSKKSQLGQNWLGLAVSRYYFALISTCTLFL

SEQ ID NO: 10684 - protein, 91 aa, Enterobacter cloacae
GMLSVGLIPIFRPRVHYIDIDLNWGRFVIITITGQLFAEFFHLQQPAVDFDLLETLSELAIRQAEPLHYRFKHSLTADGCDFDTILANLHA

SEQ ID NO: 10685 - protein, 75 aa, Enterobacter cloacae
VKANSMVTKKICNHLSIHYQHSTASTLFLVSFFEWRTGCYVSSMMSNNKESLIKQISEYARLNEQEEIQLRKIIS

SEQ ID NO: 10686 - protein, 89 aa, Enterobacter cloacae
MPNASDYFSCNHIFSFTVRKVGDLDTVIVSNPIISLFHNSPLKLFHLEVYMTIQNLVVDKTFFLRMWRRVPPGDLSLVVKVACIPAHSS

SEQ ID NO: 10687 - protein, 61 aa, Enterobacter cloacae
KKIFFEHRFQNGFPFMPGAAGAVALNIRHVSKLIYTHLIVNTNKKTNHVYYFINDAILKSV

SEQ ID NO: 10688 - protein, 89 aa, Enterobacter cloacae
TEMTHTAVSQANSALQLPTVEHVYALLKANCKPDRFDGRDGPVWGQEYSWNLAKDRLQDLEKYGKAYVSRHEDRMGEGFSFGPDLLIIR

SEQ ID NO: 10689 - protein, 810 aa, Enterobacter cloacae
RGIRMKHLAFITAVAGLGMSVQAPAQIYESAFKDTNGIEIHAPSSRLMLNPASPVTLTLISGLDRFVNVKVTKDTGTVILNTTTTRTGVSDRLTAADGSEFYGKKVTLPALGEGKFVVQINVLDLNQKPVATYNYNWLIDVTPPAANALTANTGSGSTAGDVWKLGLEATGQYDFTSSGVSDANGIDKGLIYIYRQDGSLYSTTQMQYDVSGQKMYHTYSKNSVKGTGIPDSNLDEDFTAKVVIFDNAGNSRTLPTQKFRYDNTLGEMTLWAVHDPNTSSSVVPGVSNYPAYKAGMVVNENPIRLVYRIPKSNYRAYSEGGLQFINQYSAPKEIAVDSTYAYVEMTLPYGSINGDMARMANFGQWGGYYPSYSLVLNPSANQTPAFAGTWVDFLDDKGNWVKWKDFESVASSRLPIKISRLRFNVEARPFAQEIGGKATCTIPAGKTSCEAPETFDMALGTQGYNRILYFVRSISNPILRSEQWIMTRWNNKQLPVINSISYDETNKQLDVLASLEGDGNWFDSVSLREFYLSDKNTGTRMSPTGVIKSRISGNYTIAYDLSRQSEGKYNVEVNIRDFFQNQTNKTFGEIALDNTPPTVAITFDGKPVKDDTVVYGLENLRIALADNLTTPRITRLQLVGGPTADNVELTWSPAGKDTYMPEYPRLFPNFEPSENYSISVTVADSQSNTKTYTQKFSYLPNNLVQLHNLRTLSVSSPLKTTDGVPLAYLSTNVLRKTNGEIAKGVQNATLTVRKDAAFGIKFNGAQAAPGESVEVQIDMGQGDNLLLPVYPSENGKVGTSEFMIQIDELK

SEQ ID NO: 10690 - protein, 264 aa, Enterobacter cloacae
  UNSURE (212)
YKANTEKENKMYKLVSPRELTEIITGLLLKPELLGELDSPEKHRMFMADLGRVVAEHCGGLVNSVVLPGTEVTVSDGLPLNGQPVRYLGIKENIPHLLVEPDASLPSLAKNVWMYADPEGWKEHFGAEEDCLTPEMMQLFRKGIQALQKEHDTPEISLTLQDWRLEEETLPEEDSQAYQVSVTGQHNIHCEVVNKEGNPCLGVMFEIDQGVXALHINTGGDMLLHIHCAHNGLVLTPDASGQRFDKAPVDRFSYNSPSLLLSAD

SEQ ID NO: 10691 - protein, 203 aa, Enterobacter cloacae
YGKHNWKNMFSKPMTTFTPERIEQILEFAEGSNPSEAMSLRADEVAVLARIGKAVMSIAPVYQCEFCHHDATGQLQWHWEDVNKAFYDKYDPDRRGRRRILYTAPPMPLVSADLLNMASSAIEDLLTNKDRSGAGMWNDIPEQLRRAAELVMDNSRAAETEAMLMRLYVECDTGERRGNGTQSGVAMPSWQTVEEARVLLGVK

SEQ ID NO: 10692 - protein, 65 aa, Enterobacter cloacae
AFPKGHYVRKSIKNFSIWCSKLQIYNLPFDKPYCAFRTEIFLFGITSDISVVSKLATIAKLITLA

SEQ ID NO: 10693 - protein, 78 aa, Enterobacter cloacae
ATSLSEHCDGMHDMFNVRAFKEWWIHNDNIKSFIGLVPKKVGMHQLDSCAKDTIVLHCKESLIVQFDPGNQCIRSRQF

SEQ ID NO: 10694 - protein, 188 aa, Enterobacter cloacae
RHRPGGTGHKRKTILKPMLKKDFFSAIENLLKAGFQPRFYTVNSGRIGLITFTDKNGTKQVEQVYSCTSLAANTFGKRFTTWLEEIFQKHNEEKVADSGFEVGSRVWDKLMYTLRTISEIRAGGVLVLDNGAQRTLDEVQKTAPETNQVEPKEISSLQELLNASKNLEPTSPELIAALNEALSTAIKR

SEQ ID NO: 10695 - protein, 71 aa, Enterobacter cloacae
PCTKMMEKQVAKNNNSLKQHVFNMLSAGSELKEVKRFLTSKRVKARLAVSMIHEQAIAVQNTEYQNYPAYS

SEQ ID NO: 10696 - protein, 241 aa, Enterobacter cloacae
CVPYWHCHCPPSVRSALGGHRNLMRRVTAIVNLDWIGEYGFRLGQMSMVMLHPAHYCSHCRSAELMLLSFYVATTVVSPESDYRCHGRPVERVNLLNHRVTTVLSPESHYRCHGRLVKRIYLSIHRVTMVVSPASHYRCHSRPVEQINLLTYRMTTVVSLLSHYRCHCHPEERMILSIHTATMALSPASHFRCHSLPEEQMSLLINRVTTVVSSLSHYYCHGRTAELIILSIHTPTMVVSY

SEQ ID NO: 10697 - protein, 143 aa, Enterobacter cloacae
MAMNKKEQAAYDELVAQARINRALRWSDYGVERDMPVPEVSGEYQNGWSFNTATGTVYPTWSGTTVHGTREEGEVVDATSRRMRGMNGSQNGIPQYSTKERALKALRCSLEIKFAMQLDAIDKAIAKEIELSTARRESDTSDA

SEQ ID NO: 10698 - protein, 210 aa, Enterobacter cloacae
LLLDLPPSGEDVTVDGLENVRIQLTDALTKPSLSRMTLRGGPVSDAVELSWVNLGNNLYAPNYPKIFPSLNEGETYTLTVQAKDEMNNVKESSVEFNYLPNNLVRLENLKTLAVNASLKTSDNTPLAVLYASQLRKKDGSIATGLQDAVLTVRKDAAFGVTVNGVSAMPGESKELQLDLGLGDSRSFPIFPAVSGLTGRSEFMINIEELK

SEQ ID NO: 10699 - protein, 97 aa, Enterobacter cloacae
SCPPLAGRAIHQMPSGKPSIQARDQRGLNALKEAVPATAQLQMRVTPERKLRYVNQAKAEGLGLTDWVQKHMDNVCDLAGQPEITMYKDDGETSGQK

SEQ ID NO: 10700 - protein, 75 aa, Enterobacter cloacae
PLRTVTSLQFIKWIYIYKPATLKSIVGIFLFSCSVDNKIVVKRQYFLVEIAQNLVYFSYEFLVLWPVYIPRDQRL

SEQ ID NO: 10701 - protein, 109 aa, Enterobacter cloacae
IHLINCNEVTVRNGQREVWEMRMLPVLPDESLFSRFCRTTTVYGMSPSSLLTIIFNKPDMNVHPILNSGLKAISLHTSESADQLWHEQTLLPLFAWALPISRNEILDFN

SEQ ID NO: 10702 - protein, 92 aa, Enterobacter cloacae
SLSSGITPRLTTTDSPLSSSRMMFMLLSCQAAGKRVKEPSWRVYFISELGMIYSKNKIKSAKIYTANINYCLATQRNMIIRTLALSFFPQKL

SEQ ID NO: 10703 - protein, 64 aa, Enterobacter cloacae
LLVYWLVDMFSSNLWMSKYYEHQRVFSLLIYPPIFVLYDLFEKNHILTPTDPPTPAHSAHTGKG

SEQ ID NO: 10704 - protein, 182 aa, Enterobacter cloacae
LLALRFVHSGIKIMLNRITVQLPVEGLLFWKLSGREAMSESFALTLTVLGTDARIDRSRLLGQPVTVTIPTQNLLTSRYVNGKITRVAVSAVELTGTRYAVYQLTVEPDLWPMKRDRNLRIFQRPNGTQIVKTLLGEHQVKPPKTTHRQLPGVGLLRAVSGVEPGLHQPPDGAGGDCVLLPP

SEQ ID NO: 10705 - protein, 152 aa, Enterobacter cloacae
IIPSSLMKYTLQEGSFTLFPAAWQDNSMNIIRDDESGLSVVVSRGVIPDDSDYEQEFHRQWDVLRPQMGEIAQSEFQHVKAGPDGNISGLEVETTFDRNGQRLWQKQLAVQTPGKPVLMIFTLSALKAFTEEDEARWSALKQSLTLNDNRNV

SEQ ID NO: 10706 - protein, 175 aa, Enterobacter cloacae
PIHLFMLTEFYLMGGYKMIDFNADILSGRALGNVFLGDNISKYISELYAGYKVTYFDYFLPDDKKRLAYIVDDTMTIATLEDGTIISIGCNVNYKGRYNKILQTGQTMGEIIGLTYKQRIFNGCIIINDDFGFSFELPAPYDEIADSIAHVPLDLVLNEIRVADYSDWNPQKIKR

SEQ ID NO: 10707 - protein, 181 aa, Enterobacter cloacae
IIMITMEDSMESRMIKATFLIVLPLFSIFTYAGHNKMNQDSLWQMIKEMKSVWGKQVEDVSKLFNQPLINNTQEKEDRYTSAPFTLTDGTRISNVDVRLWGNGDNSVSLVSFVVNQPCITLDQVKSHFPDLKLSNIPRGNTPGQSVGYRTPTDERGLAWAFSFPVLNQECLGRVVMSRYEQ

SEQ ID NO: 10708 - protein, 61 aa, Enterobacter cloacae
NTQRPSQRRWDYYYRNNLVREERDDNPFKWYRWQYDRQCRASPGSGRHAGRRGAGGLGCSR

SEQ ID NO: 10709 - protein, 104 aa, Enterobacter cloacae
RPNPRNRKKPQTQVSFRYDPLGRRISKTRRQKLGGQPTGKPSPPGVSGNDCLLGEAHGDVLFTYVDESGQDNYDLLARVDSVDASYIFWVHCQSNGTAQLITDI

SEQ ID NO: 10710 - protein, 82 aa, Enterobacter cloacae
CFSITIIWNKNKSLGNIMSDKIMQTVDLLISHSQILLRSRDYDEKLSQWGKGNVSQGAVLHKDYAVFVLLPQGTGIRAMQCE

SEQ ID NO: 10711 - protein, 82 aa, Enterobacter cloacae
LPFWVNSLGGPVNREETGLFREIFMKARESVIPFPIGIKGLLFQWEMRPVFALPDKLGGIQNSFIELMNVYAEKTGSDQYHL

SEQ ID NO: 10712 - protein, 62 aa, Enterobacter cloacae
TLMGFLRRWFKSQAQFFFWTYVPIILTFIFGYVLDVYFPEVSQGFILLFYLVTLGLAYWIWH

SEQ ID NO: 10713 - protein, 114 aa, Enterobacter cloacae
LIGCWTGRRRLIDSVRSGALILTLSHRAEGSPQNNACTDGPLSLEGEGWGEGEHTALVVIPFTLCSLLLCHDMTGERARVAQSPPPWRPGLPAENRRFAVPSAYSFRLIGDGRR

SEQ ID NO: 10714 - protein, 251 aa, Enterobacter cloacae
CYFTLLTETMTHAVSPSELSKLPTNKTKRLYRLPARFYGYQLFVLIVLALLFTWLSRDESLDRWITGFWYDAATHHFPLQQNPLLDLLNHRLAKYVAIALAVIALVYGTYRRNARLVTAALLMGLGALVVGALKSMSHHSCPWDLVEYGGKAVSYPLFSAIPADSGPGRCFPGGHASSGFMVMGLFFAFWRERPRLAWTFVALGVVMGLLMGFGQVMRGAHFFSHNLWAGWWVWFSQVLVYGLVSAWFAKE

SEQ ID NO: 10715 - protein, 241 aa, Enterobacter cloacae
SARSVSMYHSEEIIRQLQSQKILAMKLDRAVRDVGEEVKSHLNNIGAGAQRLLYYTSCFTDEYYDVCTRQNLEDARFRKGIFHLISRWNIVFDLINTYVEELVKDYSPAELSAIQHALMRANVYISTSTLTSYSFSAGVASTVCLYVTLPPSGLKVVSGLTGAAIGGLGIYGVVQKAADSAHRLQVMHPAYYQALYLQELEMMYFLVEPAFMRAGVLTQQWTDSQSPYDAADTILKLMGRH

SEQ ID NO: 10716 - protein, 638 aa, Enterobacter cloacae
SITDKDLTPMKKMLTLSLLALCVSHGAAAANYALSNDNIALSFDDANATVVVTDSKSNHPLTPQELFFLTLPDETKIHTADFKIKHVEKQDNAIVIDFTHPDFNVTVKLNLVKGKYASIGYTIAAVGQPRDVAKITFFPTKKQSQAPYVDGAINSSPIVADSFFILPDKPIVNTYAYEATTNLNVELKTPILPETPVSFTTWFGTFPETNQLRRSVNQFIDAVRPRPYKPYLHYNSWMDIGFFTPYSEQDVIGRMDEWNKEFIAGRGVALDAFLLDDGWDDRTGRWLFGPAFSNGFGKVREKADSLHSSVGLWLSPWGGYNKPRDIRVSHAKEYGFETVDGKLALSGPNYFKNFNDQIIKLIKNEHITSFKLDGMGNANSHIKGSPFASDFDASIALLHNMRSANPNLFINLTTGTDASPSWLFYADSIWRQGDDINLYGPGTPVQQWMTYRDAETWRSIVRKGPLFPLNSLMYHGIVSAENAYYGLEKVQTDSDFADQVWSYFATGTQLQELYITPSMLNKAKWDTLAQAAKWSRENASVLVDTHWIGGDPTSLQVYGWASWSKDKAIFGLRNPSDKPQRYYLDLTKDFEIPAGERSQFTLKAVYGSNSTVPEEYKNAVVITLQPLETLVFEAMPGK

SEQ ID NO: 10717 - protein, 98 aa, Enterobacter cloacae
TSTCIARLLPPPVVKIYPGRTGAGGRTRLAVPACGWRYRQHADVGDCDGGGRLPVRDPNRGGDPDYSDHDDGRYGDRTSAGAAHHAAGGEPAVAYHAA

SEQ ID NO: 10718 - protein, 123 aa, Enterobacter cloacae
AWALGFKAINHAGSKMLCVGGGRAIATTEDFVAVEQRLNQCHRCTRDRVRKGFRRGNLRLNAFCEAHFNSFEHGIPLKSYLCVFAKRVFKPVDRISGEGYHIETAIHSIKTPIMAGKPQVGSL

SEQ ID NO: 10719 - protein, 134 aa, Enterobacter cloacae
VDNVLHQHSWKRAAALTALFAILLIVVAPLISVSLQKDPMSAMPGMHHDMSMMSVDEHHGDMPHSMPVDHAEACGYCVLLAHVPGVMLALIVLLSVVLQRLRVKPPRQAVSHWHFFPWLYPDTRAPPRRSAFSL

SEQ ID NO: 10720 - protein, 92 aa, Enterobacter cloacae
RGSINWLSCPSARDWASARASWNLLVRRSRRITPPITGQICYWRLNEVIPQLFKVNNLNYVKRKRRVPDRLDSLGYISQMKLAIRPVVLSRR

SEQ ID NO: 10721 - protein, 96 aa, Enterobacter cloacae
LLKCKFMSALRIELEKGFTNEGVVHELSWIPGVQTGRGLCAIPPGKGIDLWQKKPRKTQSFTYRFASYAFFCIHPEDKSFSGITTQCHTPENCYEC

SEQ ID NO: 10722 - protein, 60 aa, Enterobacter cloacae
SGFNKSLNRVYSGVVYCTKRSRERMLQRTYDSIRFSGSAYVAGYRRVQAAYAASRVSPLS

SEQ ID NO: 10723 - protein, 126 aa, Enterobacter cloacae
TSLGTGGSTVMQVPELTDDAVVELAREGGVAFIPKLSGQRTIALSTLNEAQRQRVVNILEQAIPRGQPPGQASSPGSGDQRYFRIQIIWTRHNQAQYTDIIVLVPEQEAPESLIELWQKGEGCVCD

SEQ ID NO: 10724 - protein, 104 aa, Enterobacter cloacae
RFIKGILRVDIHDHTQISEQGVADLLADTEFAGNHSHLPGNITYTLCAGNISLFKLHDATGKPFQIQPFRVGSDHRVIGGLTELLYKLYITTRIYCGIGDDFLE

SEQ ID NO: 10725 - protein, 283 aa, Enterobacter cloacae
FPLRDSDHKFSIPIFSLEPVPSSVILSITLWSQEMSRKIMVVTAAYGADQVRQAGGQRAMLPVIAGAGADGVEIRRELFSHDELMALPALGESIELLGLLACYSAPAPLFMPDGTLNPDLPRYLSEASALNALWLKVSLGHFSDKQPLEALRALLDESGMTLVVENDQTDCGQLAPMQRFKAACRVMALPVTLTFDMGNWLWVGDSPEEAARQLAPAVSYIHVKAAVPHKAQFRAVAPDQTDSRWRDLLNQLPADAPRGIEFPLEGTDLTAVTRHYVNLLREE

SEQ ID NO: 10726 - protein, 95 aa, Enterobacter cloacae
MTSVIFIKHKKTPPKRGFFLFRSSDRCAPGLAKGLMLGRERTDQRVILARLLGGRELDTVRDKAHLRTLFTNKVTHLDQLLSKDLRRRDQRLQSV

SEQ ID NO: 10727 - protein, 248 aa, Enterobacter cloacae
GGTMNDAIITDNERINIEPKDVMVKGSNKKQGVNAQTSTQRRPEHQGMAKVIINPGTPDFNRFLTARNGAVIRGFDDVSIAISSLFKTVDAVKHPDLVQAIQDWFNELHEENNKMKENLVAYIKSIEFDKNDSFMSSTQFVPFSFEPVQLNFNNHNTMRFYKYIFEMNQLMNTMYEYNSLGLLAVSDYPVMSHNIIKSINLYVENVKKTLNVSRRKDGPYSPAEFITKVMQYKSVQAYIAAELSGKRR

SEQ ID NO: 10728 - protein, 307 aa, Enterobacter cloacae
GMMMNFRALYLCIKRILGIFSSQENDATSVMIEDISSLSPFAQILGDQKYTVPDHPNPEVLKFIEYPTRPTGIQTFNEQSILSLYREKLHSISMMLAISDSDIRDDAYTFTNLVLKPLVEYVRWIHLLPASENHHHNGIGGLLSHSLEVAILSLKNAHHSELRPIGYQDEEVVRRKVYLYAAFICGLVHDAGKVYDLDIVSLNLASPIIWTPSSQSLLDWARENDVVEYEIHWRKRIHNQHNIWSSVFLERILNPVCLAFLDRVNKERVYSKMITALNVYTDGNDFLSKCVRTADFYSTGTDLNVLR

SEQ ID NO: 10729 - protein, 207 aa, Enterobacter cloacae
RPLPNGGNSECITSVQFPHQRAFKNLLFVKKNGNFLRYSNFTSGGVMSNSNLISSIELTRKNLRAQIEGLRVEAEDLITKYWIKWKERNHQEINLTRHSKVPKREYLGSYAPKVELIGNARKVTITWHQFSPYKTRAPSHMSKRVQPMKSGKYSKNCFVNHASWEYEMISETEALLEPYREMLELYHSAYIELGRKIRQYSKTKVAQ

SEQ ID NO: 10730 - protein, 60 aa, Enterobacter cloacae
LNISNKIFFHLIVFFMQLVEPILNSLNKVRMFNCINRFKERGNSDTHIIKTSDDCSISGS

SEQ ID NO: 10731 - protein, 63 aa, Enterobacter cloacae
SSKISIAFGTLSKVKGRSVIDTRCEEVMKPPAIFNKSFFDSKSKSKLLTFITSLSDLAFKTKE

SEQ ID NO: 10732 - protein, 111 aa, Enterobacter cloacae
LEQFQRVSLFAFPWLFPITVCRVNKSLWGEIVCSADAFNADDQWYDVVRRADNAVIYSFPAEGRYLVYRVNGIVSLRPLLEEEEIFTLNGFMQFAKRLGYRITPPSDIILS

SEQ ID NO: 10733 - protein, 206 aa, Enterobacter cloacae
CATERTMALELQLIKHHSGILIPATPETSDILQSKTRLGDVLVAEFRRVRKPAFHRRFFALLNLGFEYWEPTGGAISSNERKLITGYAKLLASYGGNEGALIDAAEQYLEQVAYRRVTNGISLCKSFDAYRSWVIVEAGHFDAIQLPDGTLKKHPRSISFANMDEFEFQQLYKAALDVLWRWVLSRSFRSRDEAENVAAQLLGFAG

SEQ ID NO: 10734 - protein, 65 aa, Enterobacter cloacae
AEGRFSRTFLQSVQPARGNECCDHFHREAPGTTPSVIANLAIYACFSEQAFFSFINHPFDLLPVD

SEQ ID NO: 10735 - protein, 62 aa, Enterobacter cloacae
KQMAGHSEEMVCYEREADSTVDFINTQGLLLKIVIQFYCMRYPIIVLPFYSFIVSFIYDING

SEQ ID NO: 10736 - protein, 98 aa, Enterobacter cloacae
IYILAILSRVACPSKRLYCACSGENLPILFSGYRASLPFSWAEEVTRVSETHASDEAYSAALSVFGEKDLVELTIVIATMNAINRMGISFRMKPLAKA

SEQ ID NO: 10737 - protein, 86 aa, Enterobacter cloacae
ASLKSPPLAVKRHLMKLRITRAIGLSKFSPRWVKVICLRLTKNDIERSLNALLATIDESELTPEQVKALRECIDRINIARGKGMQA

SEQ ID NO: 10738 - protein, 273 aa, Enterobacter cloacae
WRKDNQHTSESDNLSRSLLGKLFRSEISLISSYRACLMLLLVHGYSAYQTGTPLLQRRLFGKGFSTAADLAFEVETRPGSFLVPRTLGKEITWERFFSAVLDGDSNVIREYDTNDIDYGIYDAGEKVTFLNGTVDIYNPKKIHELRSKCVDIQNDYFMQVFFISMLAPEFVSIFFGLKPTTADAIKDIGYSSLKTINDVVLFPRTIAFSQGHIEESVSLKTKVFAWAYELSADIRLGKVSDDLMELLRYDTMFTSHRQDVFNTLTNKVMLKDY

SEQ ID NO: 10739 - protein, 150 aa, Enterobacter cloacae
GNKMKKLMMLVISGTVLAGCVSPAHAINAHYRAQLERSGCTQISAGNGSCDVSKTKAENTAQHEPTASVHDPLREASFSSDTVNATLSNGFFSATVNGKKASVKRLNANFYEIHGNGFVISISLDENGITDASWNKTKGREHGVLRVSQK

SEQ ID NO: 10740 - protein, 74 aa, Enterobacter cloacae
GVVLEWKESFRYVFDNQYYKKIFLLNEKHNSLFDIVFNYYAIIWLRIFTGSASGSCWKTGDDHRKCKRSSGEAD

SEQ ID NO: 10741 - protein, 91 aa, Enterobacter cloacae
KVKKQMGPEKNAANIEPFVTGLNGLFVYCFVTQGTGQGRTPFVWGRLHFMLNKNSSLRMICQHCKIRQKSVTNRAIGRRKGGREPPYAVYF

SEQ ID NO: 10742 - protein, 96 aa, Enterobacter cloacae
IYHFHLWTLVIAFYTFSFESIFCIIDNINFSLQGELMSNIDATAVAQRIDTVLDILVAGDYHSAIRNLEILKSELLAENGADNAPESTQPKAPWEV

SEQ ID NO: 10743 - protein, 73 aa, Enterobacter cloacae
QLVAKHMPIGIVHFFKIIQIEVNYANLRVTPSGDGIRDQLMDGISVRQTGNRIRIGENAQALLGPTLLGYVGT

SEQ ID NO: 10744 - protein, 111 aa, Enterobacter cloacae
RELIMSQELEFSLHPPVWPAIVYFVVSVAIFFLLYLGKLKVNRLHKYPLFIAYLVFVIAVAAVQINIFANGYEFVRSFLHIDFDPYRYDSVYWGSLFFSIIYLLALPRNKF

SEQ ID NO: 10745 - protein, 63 aa, Enterobacter cloacae
KAACWPLPFREAIATGDGYYLVWPKNSLKRESIQHLLAWLQNHTPVVPALDIDYLEYDDSRVY

SEQ ID NO: 10746 - protein, 239 aa, Enterobacter cloacae
KCVCLIVRLSGKSIHSGIARHAFRRDKMKIALMMENSQAAKNPIILNELKAVADEKGFPVYNVGMSDENDHHLTYIHLGIMASILLNAKAVDFVVTGCGTGQGALMSLNIHPGVICGYCIDPADAFLFAQINNGNALSLPFAKGFGWGAELNVRFIFEKAFTGRNGEGYPPERKEPQVRNAGILNQVKAAVVKENYLDTLRAIDPELVKTAVSGQRFQQCFFENCQDKEIEAFVRGIVG

SEQ ID NO: 10747 - protein, 166 aa, Enterobacter cloacae
IVIMRGTGANMTLDALFQLMKIISPSETPSDGNLANFMTMLISTKNHSDALLPFSQRAYMLSVAYSDPQKAAALLSSCQPGAGNPLPLLNFSGWPDVRYATSGELQTPESEDYFHKISSAATLLRAAIIDAEQQKNTPAFYILDKVLSLNSALPERYKKMANISYS

SEQ ID NO: 10748 - protein, 269 aa, Enterobacter cloacae
ETIAVMENVKQSAPPPDFVVEAMGEYVEKYITAIHFIPRDDDRDPPGDHWGTGWLVEECNRPLLATCEHVASKQLQGILGYSCHGSESGISVGGKFTVYPFELDFARADISKTFNMVDHKGECTNKEHYADSHSPVADEYLYVYGFPGVDAQAGFGQHEIRGMGVFLREVEFDPSAFTEAPVPVLGEHISCAWSTNLASPLMGTTGNLSLPDGMSGSPLWNTRYTEVTNAGGIWTPCDSRITGIVWGHSAKMTRLFATPVESFKDLLFK

SEQ ID NO: 10749 - protein, 60 aa, Enterobacter cloacae
SIHVVYPRQKHRGRLYLQSPCDSKSKGGHHRLTFIKLTFGKRICATALQWDPGKRCIDFA

SEQ ID NO: 10750 - protein, 671 aa, Enterobacter cloacae
GTKMRGSKEKSMPDVLDSAQLVRIEAVHRGFLYQHLYAVGCLLLAQKASVETVTVELDEDIELNSRQERIYVQVKTRLKPIILSDVSGALARFAELRNEHTDGRRQGSASFVIVANQAPGPHLQKMIEDKTLPADVRFIWPQSTAERYPVLPPAWDTVADAAAWCIAQAEQLNFSLLSPESLIWKLAGLVQLAATGGDADGQHAFYTRDLPALFEQLIVQLQDFPAPPTLYRPQREEPSFVSDERIRIICGLSGAGKTAWAAQAAQHSTQVCAYYDAGDLPGPALASTLVRELAARFATQEQGGLRRILLPGASGVEALRTFDTFLQQRNDNLLLVLDNAHRIPVENLRDVLHATTRIHFVLLCQPHDNVRQLEAMTGLQRESLQGWDIDTVAAAVADLGGHASALGYEQLRSYTGGLPLYVESAARVAAEEYKGDIDTLCAELRQQENSTETAQEVILSRVYQGFEPLVQNALALFSLSDVGLSRDEVSGYLARSLNIPPNGAATLIKKMRATGTIENYGNQTLKVHDAVRALGLQHLTMMDVDIVNNALLALKDLLIESLQQERDTSRFSLLTQIYIKLNDVMTLIGLSGEELFYEMGITVDIMESLKQATASDSLAPLQKFWALDGLVFSELKDGVSEQIAQWLEAMGALLTEHEFGCPDSYLCKSED

SEQ ID NO: 10751 - protein, 107 aa, Enterobacter cloacae
VQETMMRILCLDIPAPGASLEKYAPHLNAEALHAWGLYKSGFIRDIYFRQDRPGVAIFLECDSVDEAMNVMAEFPLAKAGLLSFECIPLGSFINWENLFAAEFKNKE

SEQ ID NO: 10752 - protein, 184 aa, Enterobacter cloacae
NLHSWEWHDFDQESTEVEADEFDQYNFDVEKNDVVTREFWAGSVATGHRYAIGFVKSENHSMLNSFLGNAQHNGKSLTIPESGAWVVSFDLADGENSYEHVELDPRALRNLVDGVARALYDHYNVSKAGLYFWIAAREELVSIYDKALGLVPEKTLKLKPLPLTENLNQLGENGRGYAIITKYY

SEQ ID NO: 10753 - protein, 201 aa, Enterobacter cloacae
ARTGGVMPSSRNTTENPTADQLYEEVTRKLKTASSNIAKRKLESGEYVMHNGRIIPASVLEEANAENAISKRRSHGAIPLPSFTRKSEEARPLVPVWIGGDEQDNGEWKGSRKSIAAASVQTSLRPPMRVRAAAHFRGKTQTVDVHLDHSGIAPKHGQIFAYDAKSGQFIPVISGSGTMAQDNRRAKDRKHAGLLAARKSK

SEQ ID NO: 10754 - protein, 89 aa, Enterobacter cloacae
RQGRSVMLNRNLEVLTSYFNDLLESAPQHRDNVVAILAQIEIMKSRPVFSLEPSILLARKEIDKCTICKKQVLCDEWPETLFCGLPVSD

SEQ ID NO: 10755 - protein, 69 aa, Enterobacter cloacae
ARACSLSTGGVYGHNHDLHLNLRKKLLTITDTQNRTNDLFNQVRQELSLYGIEFEDITVTQHLNVRAGQ

SEQ ID NO: 10756 - protein, 274 aa, Enterobacter cloacae
SRDLFSHWSPQSCWPVKKSISAQYVRSRCSVMSGQKRYFVVSRYPTDSEPKGIGFSPVGDGKVPEEYLTFRLDVEHVIQTINALFENDKVKRLEAYEQVFQSAQVRFSGRETDFVPASQALNELKKTILSSSWVFVRNRIMGVYGLYALLLIIILGMTQYFFTAELKNVPAVLIGTCTGSWLFVSIKTKNIVFDEIYENMSQHRSLLMRLIYCCTLSSAVTACLLAGFFEIKIGEVSTALIPDNAIIALAAGIFFGLGESSLATRLSGKVKNSI

SEQ ID NO: 10757 - protein, 120 aa, Enterobacter cloacae
RHSPKTIPLNTFQKWFDLLYNIIYMLRKQNEFICSECINEKIGSRVGWVIGGLNIYGIVQRAADSADNLKNFCPIFYNALYREGLEMMYFLIEPMIMKSCYLNISTASDEEIVRALKRMM

SEQ ID NO: 10758 - protein, 168 aa, Enterobacter cloacae
FTPQIKTMNSFMDTFKSEINITLLGKDMFDDRMNIAREHVMYYSEEIIKQPGTDKELAVRLDKALIGVKEGVQYYVNGLGDATTRLLYYTSCLTENYQDVCKKLGSEDVRFICALYELVKHRNVIFRMLNIYIETLLKNKSDVEKKTILENLTPFAKNYPIKYISKMV

SEQ ID NO: 10759 - protein, 60 aa, Enterobacter cloacae
PISPGECDLICKWQIIIADIHLNAFSPASSLLIPQNYKKFFFGHLKADNGCLLSFGHPYC

SEQ ID NO: 10760 - protein, 67 aa, Enterobacter cloacae
VEHRTDGKGFQGMGVVTFYLANLVGQFGEANSARERGELHQVKVLANDGLPGVSESLWQKNVAKQTP

SEQ ID NO: 10761 - protein, 78 aa, Enterobacter cloacae
VTSNERAEESVPECQPNEGEEKLYVVFCIPSAETIHQGFGAHYTLIYSKKENGNSVSKTICADSHKFVIKALRPNVIL

SEQ ID NO: 10762 - protein, 61 aa, Enterobacter cloacae
ARRVMTMKKWISTLRRFFAPRPVNAENSAQRVLESILPVASLYGVDVANIDPEWFHDKTSR

SEQ ID NO: 10763 - protein, 440 aa, Enterobacter cloacae
  UNSURE (440)
WPFCYHYLLSQMEMIMKRTVLTPALSATALLLTMQAAHAGPQAHVVCSYSHTLGDDAIMMFSMPNEAMLHDFFGNVHTDAYSSRESLRTQEKTTCDNKADSSAYWAPSLKLPDGTVVKPAYQKTYYQASNVDAWPLHPFQAGLSLLAGDHHGTAPNPHITFLCANGKGYTTRTGEVCGLRKAKDAVQFNIGIQFPNCWDGVNLKPAHGLANATYDTKGQCPSAFPVKIPTVNMNIAYVLPTISSLDTSKVQLSLDPIMHGSEREERWGSLYTAHADFMNGWTEDAARFMTDLCMNRGMDCGTTVPYGYSKAKANVWLSSMEPALSQPDPQVLLVQDNWKNGGRTKNSETLSLVKFHIPPLPAGQDPAQFKYRVRIFGGKVETNGADQIFFYPASNDWDPATVSWHSRPSCNYRSDAVLYLNHSREYRSSPQGPKDPRIGX

SEQ ID NO: 10764 - protein, 190 aa, Enterobacter cloacae
TDSESADTASLLSIGLTHTYLTNSQLIGPPSKAGFFYFRLKETSSTRLLVKSSRGPDLINQHQAGANMKKTTMQDRPDTWAVMLAWLVNHKNEAGYSVLAFVMSILATSRGAKSKWKDRIAGATMCGILCFFAQPTLTAIWAIFNWNFPPELCWPISAGVGYVGVDSLFAYARRRLGLNEPGDKANADPQ

SEQ ID NO: 10765 - protein, 157 aa, Enterobacter cloacae
WRVFFFQETAMSALYEKSQLTKILISSLPATKETMDSATFLDLSCTIKEIQFTGGQKQDIDVTTLCSTEQENINGLPSPSEISLSGNFYKNPAQDALREAYDNDTTYAFQVIFPSGKGFKFLAEIRQHTWSSGTNGVVAATFSLRLKGKPENIESGS

SEQ ID NO: 10766 - protein, 146 aa, Enterobacter cloacae
GLKMTIWLGALKNLLAPLTGKTLSCLKSQNNGLSRPSRTECSRARLSATWRQISALLLLFLMPLLSGCAQQQKPPVEYRVIKHPALNLPAELTSRLDVPDLPDNPSYGDSVSMNATLYGIVGQCNIDREAIRKIEKGRNDENQPVQ

SEQ ID NO: 10767 - protein, 233 aa, Enterobacter cloacae
SQDSTRTPEQKLSNEVKMTESKYGSGLPHAHAACIVDGCELSVRSRNSHYCEKHYMRVRRHGTTEKLSTRKDGKLEHTGGYLLVYAPDHPLACGSPRVYEHRKVYYDKHGAGPFRCHWCAKTVGWDTLHIDHLDDCKTNNEPDNLVPSCPVCNQKRGVDKMRKTMRENSDRRYTAHGKTMCLNEWADYLGISRNSIEYRLKAGWDISMVFSPRIGNSGPPSRKLAKIVHESVK

SEQ ID NO: 10768 - protein, 154 aa, Enterobacter cloacae
AGDRKMIETSLDFSGLNDIAKDLEALSRAENNKVLRDATRAGAEVLKDEVIARAPVRTGKLKKNVVVVTQKSRRRGEISSGVHIRGVNLRTGNSDNTMKANNPRNAFYWRFVELGTANMPAHPFVRPAYDTREEEAASVAIARMNQAIDEVLSK

SEQ ID NO: 10769 - protein, 96 aa, Enterobacter cloacae
KHRVWLLRGRMKNIKNLALAKMSGFRHKTVAVPEWEGVKVVLREPSGEAWLRWQEVVKAGADDENVSVSEKAHRNLCADVCSSLTFDHGGWIDPRS

SEQ ID NO: 10770 - protein, 76 aa, Enterobacter cloacae
VEKGNCREVFQRGIALFHQCPENPFTFQLNEFIYDCVLLIRNNNDKGHLRVALFNGVNQREGSGTNGATEIISVVT

SEQ ID NO: 10771 - protein, 60 aa, Enterobacter cloacae
TFNGGIFRAVTDDNRMAKVEKVMGEADATACASDQYWALLRVSHRNLLFSSTMGQATLSH

SEQ ID NO: 10772 - protein, 63 aa, Enterobacter cloacae
LLQVNLMLMSCSIMALYHVFTASLARFIGPEGEFKVNISVSNPDRLFFTDKVIFTTRSTVNER

SEQ ID NO: 10773 - protein, 93 aa, Enterobacter cloacae
GIHIHSIQKVLIKGNDTRREKIQTEAGERRVTGNPVTQNDYSRSPIIFSSFSWSIANLRIPSASLSTAIGSWLCCHRNSDSVMRSGRAFTSPV

SEQ ID NO: 10774 - protein, 65 aa, Enterobacter cloacae
PVLYLYVMQSPFTDRRDHESGGLMNEFKRCMNVFTHSPFKVRLMLLNMLCDMFNAKPQQDDNSSH

SEQ ID NO: 10775 - protein, 174 aa, Enterobacter cloacae
NLQDALMKRIFLSVAMLLVGCSSAASQEQSAKDTTVSFYKSYLCAFGSNEARPYPADELRKYVSADTIARIGAIQEIPEQELIESDYFTYTQDYAREWIPALRVENARPFLNGEVVQVMEGAGGGRSIHLEVFLRREDDAWKIYRVRDLTNNHEHPIFNAGAIAQAKIAAESGL

SEQ ID NO: 10776 - protein, 146 aa, Enterobacter cloacae
ALFNQHQVNDWHNNSVLTYLRELRMSWNKDVAVSYLRSHALGHSHSECAKFTRLAILAGGVKVPNTDYAKDYGAELLRAGFRELPPGSTLIAGDVAVIQPYPGGNGIGHMTMYDGTQWISDFVQKSMYPGPGYRKMQPSFKIYRMH

SEQ ID NO: 10777 - protein, 63 aa, Enterobacter cloacae
KRGRATGWYYATHPALKTGWMRFAPVCSVEADVVFHHPFEEAHTGTHEAVFKPKTCMFIHTNT

SEQ ID NO: 10778 - protein, 69 aa, Enterobacter cloacae
GLKFSGDPSEQYTSVFAATVELTVSAASASVIIVNVLFIIYSCLFNSTANYFFCHFINNIKVMAQTHEK

SEQ ID NO: 10779 - protein, 173 aa, Enterobacter cloacae
GCSHYVCLCLRLFYGAKLDLHKMCQKSSIFTRQNSNIASKEGFMEWKVVETIASPESGTIFCKVETQYGLNYILWLKGDYYVRTGEIITTSNQGILINDRRRRVWIAQAMPFTSIGWMGFKQKNACPGNRQEMDRPCTAETPCQFKLCPFGLKRYIPESYSTTKINNHPDGRL

SEQ ID NO: 10780 - protein, 60 aa, Enterobacter cloacae
IVEQITQVFSTTLLTLLPVFLAHFLVGFFFCLNPPKSGVFSVEVKRYSLLLLNNQKALIT

SEQ ID NO: 10781 - protein, 280 aa, Enterobacter cloacae
RGGFLMANSFKQMTRDGTIKRTDTGMFISLDQIHVREGFNKREDDERTRQADDDLFNYLMNGGSVPPLEVIARDEGGVWVVEGHRRRRCYARCAEAGKPVDRIHIMPFNGNDVQRLARIMTSNNQLPLSDMEQAAVIQELHNAFNQTTSEIAKLVNKSVPTVEKLLLLSTANHDVQKEVKSGTVSVDVAVDRVKEFGEKAGEVLQKDKASAAAKGKKKVTRSVIAPEISVKKARRLVELISLAGISDTGVIYLEGLVHAEVVEIIDEHKAIAVQRHGEAS

SEQ ID NO: 10782 - protein, 93 aa, Enterobacter cloacae
SARSPLVNLPLEEASDIIRESLRTEVRHELEYEYDDRISSAEEEASDWESRADSYECDAISFARAIEKALLAPTLDEAKIILERVRSDNREYF

SEQ ID NO: 10783 - protein, 153 aa, Enterobacter cloacae
YLMNIYEFGSIQVPGFVQPKFSAVQSAHNTEKLSMTNTQNVTELQPRMTREQLIDAARKAAPLLPPAYRGIMTELANRLDYTSVALCEAMAQRKELAVQNATLREDVASWAKECDRIVERHTKSRTNMHLLEAQRELRELSPIVISQNNEVAF

SEQ ID NO: 10784 - protein, 112 aa, Enterobacter cloacae
PVSGSTFARRSMFQLKPGSMAMIVGARTAAGRRNIGKSVELFGLCQPGQRFVNPVNGVMTQLPDTSARALWLVTGDVYAFDNQHGFAFVRPEHLMPLTPDEMPHNVDELAIG

SEQ ID NO: 10785 - protein, 72 aa, Enterobacter cloacae
VFSPYAIPGHGYELADSEHHRRDNYNFDWRHYSSSSRPRYERELIAFGLKSSPEINSFNLSKSACDFMRKVS

SEQ ID NO: 10786 - protein, 65 aa, Enterobacter cloacae
ILLKADEGEAKKSPDVEIGAKHLDYGMMFSGQCENRYHYKRESCRFNGEIMEKTAMTRYSDVFTP

SEQ ID NO: 10787 - protein, 93 aa, Enterobacter cloacae
NNYWHRHADDQPAEFGYFVGLLHDSGVQVRGFTFPPGNVGFKAAQAPLFKFSHHMPYPVMDMSWQIANITAVITTTLTGGIIRPPLDQGMKES

SEQ ID NO: 10788 - protein, 61 aa, Enterobacter cloacae
WVVVPVTSSDITISPVICQYVACYISTGRRGLKENSQRERWLLGHALLVDDCFWSNSLKFN

SEQ ID NO: 10789 - protein, 69 aa, Enterobacter cloacae
PSSSRLRRRSAAISWSSSTSRICFMGKPSIICYVVSLPDFERGKSSHFVEHCVGFMPGGGFALPGLRFG

SEQ ID NO: 10790 - protein, 132 aa, Enterobacter cloacae
ACIMSSKNQSQYFSIAVYIPEELKQTFVEECSIVGIDAKRVQCFSSNPGIREYLSILVERGQKFAPYLLKVLNLLQSKSKIRIEVAADRKIIDLQGVSVDDALKLIQAADAIRVIDQQEPEDMNSDSAKHTI

SEQ ID NO: 10791 - protein, 104 aa, Enterobacter cloacae
NDNKNRGNVMNDKKIQIVELLISHSQMLLRSRDYDEKLNYWGKGNVSQGAVLHKDYVIFDPLPEDAFGANVNIKIDNSFILDETAQRCIVVPFFITNKNKLQVA

SEQ ID NO: 10792 - protein, 229 aa, Enterobacter cloacae
TLQKESSMNQFTEDLHNVVAQILAGAEISDSEIFKELTIEPDFYKVQDQYYGGNGIYFNSESETRFSLRSKSKGVLYLATTAFTGLKEFYQDAPLVETEDLEKNCMAVIQAARTIKIIDLAALAPHLKTPLGYLMGSKAVYEDTQWLAEVLSHYADGIEYLSRHTGKTCIALWSDTVDGNGMLKNISVTPLIQFSLNGQSTQAILKSKLGILTVFTTGGRANRAKQGGE

SEQ ID NO: 10793 - protein, 61 aa, Enterobacter cloacae
TPIEAIKGTEIYPGGLYALVFRAQGFYMDDFPSLSGRNSAPGFMPVNRDLVSRCSYFPSFE

SEQ ID NO: 10794 - protein, 101 aa, Enterobacter cloacae
GPKMKRTLCTVLTALTLATALPAIGATTEAGSTSAATTGTTTGATVGTTAGTTGGLAAGAIGTTAVVTTAAIAGVATLAVVAASDSGDDSSNGTSTTTVTR

SEQ ID NO: 10795 - protein, 61 aa, Enterobacter cloacae
CSAKKIAPHFSLLPGQTETSILASISRHDGERMQNYYGSLTFISRKNFPPQQCAGKRPLRA

SEQ ID NO: 10796 - protein, 84 aa, Enterobacter cloacae
WNLCKACEGSADFAIPRAIKTVGRGHGCRLYRSLRRCLAIADLGGRHNVAPLYIMSYHSFLFKKAAIAEWFDFAIVKSAFPHAS

SEQ ID NO: 10797 - protein, 112 aa, Enterobacter cloacae
KAKFKADKASNSNKEERETFFRFFYSPALKAASDFLNTVLHKENRMTVFLILTAIAYGIFKAGCFILLVVKGYQGWTLFWKNYDRLPHIIRSRCRYQRRFIFRRIWKRIFSH

SEQ ID NO: 10798 - protein, 107 aa, Enterobacter cloacae
LFLDIINLVMDRQIQREHIEQQIDMSLGDGIKAAFRRSIMTTSNAHFCRKTGSLMFQHRIKIYTTSFHLTKYIHGRRFETRIILVYKLLIGYAGIFKSLIPDGVQYL

SEQ ID NO: 10799 - protein, 93 aa, Enterobacter cloacae
VSFRVFNHNPSSTARKLARPMVIAGKIMWKETVNANCTLAKWKASNPNIVHLNPDNTLIINYFLSNQSLDEKFRLLKTIIFLYEIKTHLQVHC

SEQ ID NO: 10800 - protein, 189 aa, Enterobacter cloacae
AMTQARRPSPLQRRVLIVLAALDSKRPGPVATRDIERVLEQGGDAPVYGPNLRASCRRMEAAGWLRTLRAPNQQLAVELTGAGRDVAEPLYQAARDDEISRQRQLKVHSLPLRESTTGEAVEVFLGDSLHRICQAAYVIRLDGSTCLQVTNAGGIRQIMEGDPLQVADLYQTCYDAGLPVHIQINESQD

SEQ ID NO: 10801 - protein, 101 aa, Enterobacter cloacae
CACKGDFIPDLGLLTNNHKLFRRQTVNKNPILYTGDGGVLKTFPHGRGQMKGDACVIVLRTRDGEIFHQYFAIAVLVGPLLPLYFGQRVMSGGLRDVSYLF

SEQ ID NO: 10802 - protein, 98 aa, Enterobacter cloacae
LNRTLSDGACRMDEKEVNFSLSYEQLTRIAEERIRECELDSQGAKYISESSMASTLLQFWYELAITGAPMKNYEQTKALIDVDHQRLRKLIWPETDKQ

SEQ ID NO: 10803 - protein, 138 aa, Enterobacter cloacae
VPMKKTKYRFESDDDPFVSKDVLTLIDNGLVFLDKAREELQDSMPKFSIVSFWTAVEILLKVPLLHEHWSLVCSGRKIERARYLAGDFQSVTYDETCQRLADVLEHPLPKETIDVFKKVKDHRNRVVHFYHSDWHCCK

SEQ ID NO: 10804 - protein, 193 aa, Enterobacter cloacae
NVRPLNKTKGCLIANFATVPDIDPKQTPDDAAYAWSNIVDDARSNQAVPALSLYSGNHWSTAKEILNSTRNLELWIISAGMGFLNCRDRVPSYEATFHQVPFRHDLWWKAITKSLGKHNRCATISQLMQSSPNDEYLIAASPVYIAAVQNDILKGIESLTHPLTQLTIVTSGAYAGPLEEYLIKSSSVMTPTY

SEQ ID NO: 10805 - protein, 70 aa, Enterobacter cloacae
VNAAMLSLTNKEDNHMNIKTLKNDTVETVSFLVKALFFVVRKIYLKPAVAVCPLPQTLAECRIYAARSIC

SEQ ID NO: 10806 - protein, 355 aa, Enterobacter cloacae
YSKPTQRERGMSQQLRKRSDIEKKVAAGEAVKEQPRQLIRDTITGKIISNERVPETLPACLIAMQSNTLVYNDVDVEAFQREVRQQVSQILDAIRDERFENAGIAYQQFIDQYDACFETPSVDVLGEVKRRGIDLYAVLEHQGTRLTAEMCVGGSHDRASERSFNAVTEAHINLLFYMLTLNLAIHNKIDNVQKQLRTKLGFLEERLRTLLNEYIYANQLGRIVLDGLHASETLYGWILLEKNDLDAARLIYKNDLKLNNEMKFAELHAEVMSIYQKRYTSETPEDLRNRAFSRCGLSEDRAQFAFKLCYYLHQTGQIRKYIDELTLGADNNDTSDATVDVRSLLVPSASGLATQ

SEQ ID NO: 10807 - protein, 61 aa, Enterobacter cloacae
NNCLVRKTPQGSGYSGITSMGSFACRAWNSSMQLILNTSRGLSTVVSSLSIIYSFVCDIYF

SEQ ID NO: 10808 - protein, 124 aa, Enterobacter cloacae
HTMKRTIFFALSTFLLAMTASSVYASTEHTGMSDLRVQKTANASYCNPGSHRCEAPFTIGRDNIAKPDGSDKNYCNPGSHRCEAPFSTGRDNIAKPDGTDKNYCNPNSRKCNAPFTTGHDNINQ

SEQ ID NO: 10809 - protein, 60 aa, Enterobacter cloacae
ARQGCSMNTKLQASLVKVPQITLTFWIVKIAVTTLGETGGDAVSMSMGIGYAGRVMTPTY

SEQ ID NO: 10810 - protein, 78 aa, Enterobacter cloacae
SPKFFSKLHITPPTIKNYSQHYLYRAVSGMIVVADTITKILHFCNRPHLSLHYCNLLDTFNHVLNNVLASEFLSHTKK

SEQ ID NO: 10811 - protein, 278 aa, Enterobacter cloacae
SAVEADSPDEYGNSHPRQETMRPQQNTSPAFPMNKVPEVTLFFWLIKMMSTTVGETAADFLNMDLNWGLTNTSLLTGILFAVVLTFQLRANRYIPALYWSTVLLISVFGTLITDNMTDHFGVPLALSTSVFGGLLVLTFGLWYAKEKTLSIHSINSLKRETYYWIAILFTFSLGTAAGDWAAESLGLGYLNAAIVFGALIALTAVSRYLFKANSVLCFWIAYILTRPLGASCGDLLSQPLTSGGLGLGTTGTSILFLLTITSLIGYLTYKMKLEEINR

SEQ ID NO: 10812 - protein, 72 aa, Enterobacter cloacae
KRNHHFAGCNKRGASVFVFAFSKNQTPCIQNHSYHFLKNDFTIFISKAGHSLSFYGQHTPDEPAYPIVNIWH

SEQ ID NO: 10813 - protein, 107 aa, Enterobacter cloacae
PPGTDVDPRPQVCILAVAAGACPASCPAVCPAQAVVEHGRGNAFIPHIRRNVTSRWQVYGRLWDADRQALGAKLEIRAGLWNRPEIGAFSFPGVELREKRRFHAPRF

SEQ ID NO: 10814 - protein, 161 aa, Enterobacter cloacae
SQHMQFTGMTDMKKKILAILLLPTLASAAQKFPPEVSAALQFNKWYISQIIIGKEPLKNYEALRPYVTRETISKLKAMDKLDPDEYDVPDVDMFIKAQGYEDDWDIVSARALDYDAACMQVYISFGKKRDHTVIDCMVKEDGVWKVESVASMNISDNLMME

SEQ ID NO: 10815 - protein, 81 aa, Enterobacter cloacae
KALFINALNKSNHPIRIPSQGLCLMKVAKKGGLAQSPCSQGVEVIIVITNMVLCPGGLSDEVDLWNCIQKPSIRPILPGVA

SEQ ID NO: 10816 - protein, 159 aa, Enterobacter cloacae
TMLNILIQETDLFFQAGLQSFFEDFFKHNFHRSITFHLALTNENVSQADIIVLSLCQGETLTCFPELLARQKGIVIGLVDDELRFSALPSCFQDIIFLPRRASLDRISGVLFIAWFTTQLPGYTWNKKTCFDCQHKGLSRQQIRILVNFYRGLSVVQTA

SEQ ID NO: 10817 - protein, 76 aa, Enterobacter cloacae
KSIARLATVAFTATVELLRTGKGYSDQIAIMPVGIKGMSFEMRLNCLNTCFCMLTQLKPVVCHTALLLPSALSHLA

SEQ ID NO: 10818 - protein, 145 aa, Enterobacter cloacae
SFNINEAHMRNFDMHGKGHGRGLGRHRMGKGIVIGAVLFVVLGLLVMSLWNALLPAILGVKAIGFWQALGILLLSRILFGGLGFRPGMFGAHRRMHEQWMNMSPEQREAFIQQRRAGFGRHGHCRWHDGRDEKRDDNGAKAPEAE

SEQ ID NO: 10819 - protein, 100 aa, Enterobacter cloacae
DYRTPMTAHVSNDPLHGVTLEMQVNALVARYGWNELGNRIKINCFRKDPSVKSSLKFLRRTPWARAEVEALYLDSLHDDGNGEQDEPAFNPWTDSRTPRS

SEQ ID NO: 10820 - protein, 76 aa, Enterobacter cloacae
FNQGLITVRIDLRRDIRGITVKPNLFQCITSEMSVRRHHSPDNKQFVNIILTQRTSLLIVQIAGCEARHSFFSFYP

SEQ ID NO: 10821 - protein, 66 aa, Enterobacter cloacae
AIHFFLSLSEFSIPDYLMVGFKYKTGQKILNQEAMLSHFFATFPTVAAAVFSDNSYSLTVNAGMGA

SEQ ID NO: 10822 - protein, 204 aa, Enterobacter cloacae
RMIRQGFILTTAMLLSGCGYHFANQVDAYDLMPRPVTNKRFQIVPPDESIQSRMFSGRFADGLAKKGVIISTHQPDYVLRFRISSSQENMQYSEQLLTGVTGYVVDKKTTRTDKHGELHTDYDYKPVDGVIGTETMSQMHYMRQLDVEVYPSAKGAKQVLKVSMQSNAPVPSDSIAYSAMIDAFTDKFDAPLRSGNYVAVIPWN

SEQ ID NO: 10823 - protein, 64 aa, Enterobacter cloacae
TTCAETELNIYLSVEQFNNTVRPNFLKSLSDHPDALATFEPNDLMKLCNRQGPLWVAGSPQDPS

SEQ ID NO: 10824 - protein, 189 aa, Enterobacter cloacae
NTINKLESLPSEVNHYYEHCTVPVIDWFFKQATEALHHGLWLPACTSFLNGIETSLRVTLKLKSTVNVQQSVPVLVDLDGTSVMSNALMRKAKQEGMPIELLSFPAEKNMLAKIDAGKKPEADIVRLRNSLCHGNILEFIMSVKVGSPDPIRIFTPGNCCGLALLLSALSKKWTVGLHQYWIDNNLTSC

SEQ ID NO: 10825 - protein, 118 aa, Enterobacter cloacae
TMKLKNILLCAMMSVAFGSSANTTHKVENEPIPNIILDGKVDDICKDASIRTELNHDKAKELVTTNLKQALPLNTVPDKLDEVAEAFVNRDKGASETADHCLVNVRNKYWEMYPSEDK

SEQ ID NO: 10826 - protein, 133 aa, Enterobacter cloacae
EVCMKSTLLSTLMLVAVGVQPVFAAQCQYGACGTENDPGIGFLMSSVQMDKGEHLKELSGVATTGDTISKKMESYLGNKKLKVNTDSTRKGPGNTTIRPTDELAPTRQLKVIRPELVKNPDSQLVVAFNERLA

SEQ ID NO: 10827 - protein, 147 aa, Enterobacter cloacae
ERPEGKKMSILSSFVIRATGIPDKKYLRDPVIKRCYKRLSRRVPALMTGWLLCILGSGYVSMALEQPDSTVLLSLLLLYVMSGILLMQFQYMYSERSIGYKFYLEVLMNAAASTQHKEQLQYLFINKPNSITMGDLYRLYDFNGGGR

SEQ ID NO: 10828 - protein, 373 aa, Enterobacter cloacae
KRPCYTSSNLFFVCHHNRIRKGERSMTRIALAPSKMVLLMSLVITGAHASPEQPLIKDTPFVSGQAYKKGFFWYDDPAKKSEAEEEEVLPPTGAASSPSKEEMVDLNSKWLKENMPRLLTQAMDNPTAENLSRYYTAQRLMLDISTRFSDKSKDYFLKNPMMSEKRRQPVEKVALDAHRTVVEKNQQTVMKDIFTKSGLFFFFQSTCQFCHEESQILQFMQNYYSVDILPISMDGRPLHNGLFQDFNIPNAQIIDQFKIREVPTIFLVSKDGTSAQRISEGMISADELKNTIILAAKGMNLIDDASFQSTLDIKRQYTIGDDGVITVNKSEMESDPFLLQKIMDQKLEGYDMPTADPVNYLNAGGSFGGTYAQ

SEQ ID NO: 10829 - protein, 63 aa, Enterobacter cloacae
TNAAKIRQTSRQTRCADFIETSFESHMLPLKYIVTFINAIQAKSMNLRILRAVSDRQCNAIAY

SEQ ID NO: 10830 - protein, 104 aa, Enterobacter cloacae
LSKEVSMKSAHLVCLLVCLIFAAFVHAQEKSAPEKEAQIKQQVLKDVKKTCTPQKKQSDKAWQAMILSSEANQLLIKNAITAVKRDNLDAYWDAVSQVDCMEDY

SEQ ID NO: 10831 - protein, 155 aa, Enterobacter cloacae
FSLSTVFAWRSWCGNTVPKPEGTRMYDVHVIFRDGPGELARFGQLLGRNGVGLEGGGVFGTDAHFLVEDGEKARRVLLDAGFTVQALRKPVIRKLKQERPGELGEIAAALAARGVSILTQYSDHANHLILLTDDDKLAAEITTPWATNVKDELTL

SEQ ID NO: 10832 - protein, 362 aa, Enterobacter cloacae
ACFTMSISTLARVFTPHGNIVYTANDFRQTLRIVFAGMIALSISSFYNTSYGVFFVVYPIMLLSLVPVFNRHVAKQFIFSASLNCVEMVLIIGYLSQWPVIMTLVVFALYVMRFRFMSKGPLFLFGSMGVVCQSVMLNFMSYPTTNWHTLLFSNIEASVMAVCLSALMNYLLPDVEPRKPPPLIEKDDARVRHESLLSGTVATLIFVVFQISDLSDSLSALMAGILILFPMHYRGSVISSIWRVVGVVLGCLYILVVQLILYDHSSHMLLMMPLIGLGLAFGARLHVMEKVGAGVGFASITTIGIMFGQNMHPDSDLVFSDLYRITSVTFALVVTLTMVFLVHLILNRFEATRYVIAPPKAD

SEQ ID NO: 10833 - protein, 82 aa, Enterobacter cloacae
FIKGPQHGRRGAGIINYKVDHSCSWRRAVSRTAGAGNCVQCAPVNGLIPFFRRNLEGDKIVIIQSRDKQRRFFIIIHKSGAE

SEQ ID NO: 10834 - protein, 90 aa, Enterobacter cloacae
  UNSURE (90)
RSGFIYPQHRLIQEVTYDSFRSNFLFFYYFLGSLLPVYPAPITKKVGMLVVPLTLTFGCYIYAIHLDDSAQQTNLLVVTTGDKSTRAKRX

SEQ ID NO: 10835 - protein, 61 aa, Enterobacter cloacae
IEAVLVLIAIPVRPVSTAGISIPFAREKTFTTDGIKSASQSTYPCKQIDKAKVPVLIISRS

SEQ ID NO: 10836 - protein, 336 aa, Enterobacter cloacae
IRSTKGGKRVMGRHQPCPTMAVETGKRKAQKGEREEITMMKEPHPLLQLVLNDSGRLTMPVYYRDQQYCPTCLTKVLKSEDGSLAHLGEINQNTCRPSISVVVTKAIIEMLCDGEKIFVNPIRYRGRVLAPSVIFSPDTHTFKPFINTDYQPVGANWKSEKGYKLGLFYLKDRANSINKEEFDFIAVIDPKAMQKEFISAWSEVDEKNPLETLKQILRSKNNSSLWVKWPGKIEHAQKGNCNENYWFDYQSDNQEVNCTVSVVGIEGNSSGETIYRLQTLLKRKLNEYQLVRSLGTIMLLDNTGNMIPSNHPYFEVISKACINGVRDFVRQNPWVV

SEQ ID NO: 10837 - protein, 119 aa, Enterobacter cloacae
LVSPARYGILFMFGRLQYRPGTMDKQGPQIGITSLAYPEQDLFTPTGVLTWNQSEPGSQLSAILEIVGFTNGRNQRAGGNRANTRDLADTLAESILPIALLNLLVECSDDIEQVRHVVL

SEQ ID NO: 10838 - protein, 442 aa, Enterobacter cloacae
ETTMSQKFAVMIAYDDDPNVKRYSPDFQTQDEFAKGWQSALKKAHHTSGQKSVITCGCRGKGEKRLYVRALPNGDAFILVKAANTGIEHDPSCVFFSLDARHTGLKGYASGVVRITTEGDMAVRLGIGMTEKDPPEKSEVPPLPHVQRPEGGQASMTLLGLLSLLWTESGLNVWYPKMAGKRNDSLVRYRLLETAKQIRTGRACIGDHLFIGVPDPKQPVAQSQIQRLSSQAMSDKRLMLLSVLPRYDAEKHEKPLKFLPLRNFGGLPLIFFNSEGHWDSVKKRFSSEYAAWKSGAKIVVFALTSPAAVTGRGPSVRAHQIVLMHVSENWIPLDSSYEAVVAEKLDAEHRQYVKPMRYDASISEVFPDFYLLDTKSDKPFPMEVFGMATPAYLARKQLKKDYYNREYGPYGWWHWDATTASETMVLPHFPESRKPLSTGTPA

SEQ ID NO: 10839 - protein, 71 aa, Enterobacter cloacae
NGEKMSYMLSLSEQTKLNAFLSGILDDYKTGVITQIQAVGKIGNVFSALESGDSKKVVHLLTEGRKLLRTG

SEQ ID NO: 10840 - protein, 82 aa, Enterobacter cloacae
ASNAVMVSPSTILTTFASKVVEFPQDATGNTTIMMGKSNFVKKNIISPEFVEYRHVSTSLFTGSILTSHYFMGGLKTNLFAT

SEQ ID NO: 10841 - protein, 60 aa, Enterobacter cloacae
CQRSTMTYFESAEGETVSKERALQELSRHCVPETDFEEFFSDMGVKEQYDAQEVLLWLGY

SEQ ID NO: 10842 - protein, 122 aa, Enterobacter cloacae
FKATMNMKKPKAALQNAMKEDVPAVTQIQMRSTVSRKVRYVKQANREGLKLSEWMSRHLDAVCDTADEIHKGKRSTPVAPGKIPPEVYQVIYDQCGGFVECDANAQVIWEACRDAILNGDKG

SEQ ID NO: 10843 - protein, 109 aa, Enterobacter cloacae
GNRMCDFCRADENYFHMAECVYDQLVKEYPVMWLRDSTRIGACYLCRELLSPEGMVLAMQSAFPAKGWRLRIWYNETIDEEIEPQRGDCIELSSRADALLSFMSFQEKV

SEQ ID NO: 10844 - protein, 75 aa, Enterobacter cloacae
ARIADTSLVPSFIRNSQSEFRVSQVNINSVKQTINMHKTMGWFGIFMAFFSCQRKAEVSPSVRNRDVMLWFRECV

SEQ ID NO: 10845 - protein, 74 aa, Enterobacter cloacae
FTSDMATCEMGMVTVITMCLLAVLVTQPLKHITFKYDFLLGLNMCLSIVRQPIFTPTHELNKNHKLNERFNSLA

SEQ ID NO: 10846 - protein, 66 aa, Enterobacter cloacae
ICALVSFWAELLKPDIPSRPYIKQSASSSTGGQCLTGNSKDILFADKFDIGFTHSKSKLLKTLLYR

SEQ ID NO: 10847 - protein, 207 aa, Enterobacter cloacae
ICLIRLSMMNKEQLIDKLERVVCGQYSYEMQELAYSALCCIKGTPDDCAKFPVTRPLPDTLVDVWDEIGQYLGTGKAIETRSCGVSLLLHGHCYDSNHVLYWRNAGALPAACDTPLAGGSRKLFTCSACGVDGLDEPPETSCHCCTEGAHWIESRLFTSGQADPEEFRPVAVVKECAGSTPDDRLIWSVIEQLNGELAEGDKLFKQR

SEQ ID NO: 10848 - protein, 98 aa, Enterobacter cloacae
SGKPAVMPFLTETKGKRQVSPVIFTLVRKILMNHESRTVYLNTAIEALLKAEAALNELALAYVLKPGEKASACHPRTGTLSTASQVRKLRRVLEKNKL

SEQ ID NO: 10849 - protein, 307 aa, Enterobacter cloacae
LSQPRRISPLIRTFLKSSDDFSRELSFLFHRSIKIRNSGFAIFGAGLLIMIFGLCLWLLSLHLSPSVLDFDIDVPLSFFNSSEGEDKLVVSDFGDAFGGFLTTYSKLLLGIMGLLVVSSTAFKILKGEEIGEIFPMLLIAGAFLIGLSVFTSALGSEETDATSASTVKVIKKYVKHEKYDKLVAYLNDSNWPSGEEVSVNYLKAQLHIKLGKPDVKLTQNVVRAYMSGVLQSNIPVKVRYALEKTALDKSVSPLAIRYEQKRMSKSHTFSKASVNCLKVGSPVAFVGVLFALLGIKIRRRVRFLESN

SEQ ID NO: 10850 - protein, 78 aa, Enterobacter cloacae
GYMMCNFTPVQIIADYILRFLKNNTDAKLYEAMQRLEKKIGQFVADGVDEHQLRSSLSKVCRSRSRAALKEECEQLIP

SEQ ID NO: 10851 - protein, 101 aa, Enterobacter cloacae
GREGMSGLSSSAQKLTRAQIYVLRRMASGTIYDISGNFRRARERRTFMGNPDDVTCRSSPVLFRLGLVELCQPVRHLEPGLYYRLKLSSSGHEALKANAHL

SEQ ID NO: 10852 - protein, 92 aa, Enterobacter cloacae
ETEPDTSLLSGKAGQQMERQELNPLVLIMIEENKMKDNKTRPVDSYAHADFMESVFSNLRAFCDAECQRLTAGYPPTVKPEQQSTDGQLSAA

SEQ ID NO: 10853 - protein, 64 aa, Enterobacter cloacae
IITCQFVQISASLSPGQKPGSIQKLNVPVYLYISSIPCDLQETRTGLAIPVLPLSHHWPRQPEK

SEQ ID NO: 10854 - protein, 122 aa, Enterobacter cloacae
WATHSVSTSLTIKVLFMSNSFDKPQTLPVHNSDAEPFFPKNLGPFIEQVSGRDLAMLTESEKEKLAHLIRTGRKYGVSVAIVPDTDSAELHELLSNADSIERQFSIYERIQTKIAFTRCQEA

SEQ ID NO: 10855 - protein, 117 aa, Enterobacter cloacae
ATLLYLFHVNRGGDMQIEKVMSLLEVLSSWLEDNINMDSEIIFDNDEDNTNSEILYPAVEKANAVLRKMASLSSDSVHAIRQRLQLAVEGKAELSLKDVGELLLATKYLMLSTEEGE

SEQ ID NO: 10856 - protein, 62 aa, Enterobacter cloacae
KGDLMKPFGLAGKPRPEPCGCCWYTREDCPYVSAKQIYRRRQRKAERQRQRSTIVMAVSEFR

SEQ ID NO: 10857 - protein, 63 aa, Enterobacter cloacae
KNRYAGKRVIPPFSTHNFTVHLPLTLPVINGILSDWADPTHNLNCWLTVLQPNSLLYLAGVRP

SEQ ID NO: 10858 - protein, 173 aa, Enterobacter cloacae
CCPLKRESKPVTTLVFEMADINKLIEEIRTAKTFSVTPDQIYDPACYPGGALLNAEGQTEEEARKAGRVFFPSSSKIASTHLVPKVLLAHSHGVYLITNAELEGSPASRDTVAYAQGMNPKLDEDWDYACDAALGGSDCSYTIPVEWLELAVEQGFQEFRLRMSETNIKLVSK

SEQ ID NO: 10859 - protein, 76 aa, Enterobacter cloacae
EFSLNGRQPMKMFFTPYVRIVFYFCALIFIVYSFSDFFQGVPDSTFFSAVITLLVIGTIVARHLDRKKSLKYTSQI

SEQ ID NO: 10860 - protein, 80 aa, Enterobacter cloacae
FNKDRFMHNHEIQTIAIFSAQYKNIEDAENAGALYSVDIEYPMTLNDLSRLCDSIAEAVGVPGGVKYQFVSQPEAHETSF

SEQ ID NO: 10861 - protein, 78 aa, Enterobacter cloacae
PVTKLPKSRCKAMKQTKSSMSRIVQLYDGSRYGNCEQADNEGELFTVVLNKPSQIDDIRKIVDTTAEVLGKALPVLLF

SEQ ID NO: 10862 - protein, 108 aa, Enterobacter cloacae
SGESIMITSLMNFRDLTGEAVIQARQCVINAEIEAAREKVIHARSLFKAGIHNVVNGSSGIKAAAAHFLVIKRLQTDTRYLDAVITDNLCMFSPEGYLYLFMQQRYFL

SEQ ID NO: 10863 - protein, 96 aa, Enterobacter cloacae
GYNMKISQLESGMQVWSVTRTKMGNTTISTVIVHPVVIIEIHDNHVIARWNGNAPRRFGETAIRGWKKEKPLLVREPFGNVRLATRAEKTAMQEKE

SEQ ID NO: 10864 - protein, 205 aa, Enterobacter cloacae
QEWGMTELNKSPSGFSGADVSKEQAAIRALVERVVTNYRSRTAPDRVQKASVAFNGGLILTLMLALTLLGYLVAELLRGYVADSSPYVPGLSYSQFSMLMVVELCLCFLAWFLVVTGDYPRPWIFQVVPMEQYWFFDEVDDDDLARLSCNPYIKRWLLDEMSGIHRLTYTRLHDRLERICNIASHLEYSRIQAHKISLINGSSAS

SEQ ID NO: 10865 - protein, 116 aa, Enterobacter cloacae
FAKLRGISLMAELYITISVIFKSAGYSNNCTEQRFELQCIRRVCDNNKALPVLLKMEEFKTHTAGMSEARYIMPAYKGRHNLFFSRTRRSFLTWEAVESVPVRGWHALAFSPGLST

SEQ ID NO: 10866 - protein, 179 aa, Enterobacter cloacae
KKCRTWYCCVVAQLNNQPKERTKMSAIETEVKNNSNEISLRGYLERTGNGARKGNGLIIDPSVVVQQEGFNTRTAGMGELYYSMPHVVEHLNSLADAYMEDPFSVTPIVVQMVNGVPVLRQGACRIRSIAIANRQLEAEGRERITRIRCEQFRGSASKAELFTLTGNSNLALSVVTEAL

SEQ ID NO: 10867 - protein, 67 aa, Enterobacter cloacae
AGADKMEDAINVPITYYDSNGCLIVGHNLVGKIHPQLFDKLVRRSNDGSTRCQQAKITSYLEGLLNG

SEQ ID NO: 10868 - protein, 91 aa, Enterobacter cloacae
RGNRIMSIPMKGLSKRGWYNSLTDSVEYKYFNGQTEISESAYKLLASGNKPKPTVKPAKAVTTYKVKPKPTIEQQRDAALKEAIKQMVSGG

SEQ ID NO: 10869 - protein, 99 aa, Enterobacter cloacae
KLGAVPVRQGVVVGGVAPQPLTHRLTKNLGNSVRKPEFADRWGRPTGFYSGASGSKRAHWSWTWVLTAWKTAKWLATWCMKMPQRAHPILLRSRAALAR

SEQ ID NO: 10870 - protein, 306 aa, Enterobacter cloacae
PIASVKLFACLLSPLSLQEVSNMTHIFYEFSSLKPGVPDVETLMEVINSSELTRFVMGAEVVDFVKKALIVNTTIGSFKNCYFAFDDGAYFLEFDGKGKSRRFTEVPDWFVSPAEFARSQWLINHDLADVKATAFIDVLMSYPLKERRAHCNLLFGLDLHKVNVVPAPTAPAGKMGNKNGKTTKPRVTDLGSFELFTAFFARMKTAVNANEFPTLQVLTGQEDLTKAPHNLKQGIRTWFKAITGDLPPNNKRVGAGNAVLFCAPVREQIQQIEAIGLEKYYQGLSKAIADAGDGFITDFSYTWSEK

SEQ ID NO: 10871 - protein, 85 aa, Enterobacter cloacae
RSHDFQEGAFAAAGGTGYQFKFARRETKIDVLKDGVITHTKANIPDIQKIFFIIHSDSINRCDKKSLKHNPFRYAALIALTYSKC

SEQ ID NO: 10872 - protein, 61 aa, Enterobacter cloacae
RCWANVITVLSGEQHDSFKTSKRLIELILITNITGDSNIRIKMTLLFVEVSNIKISLGNLD

SEQ ID NO: 10873 - protein, 63 aa, Enterobacter cloacae
CFAGWRFAYPAYRTVGPVSASATGQQKGDHTVAFFYYNSSRAADTMSCAVRPYSFCKKSCVPT

SEQ ID NO: 10874 - protein, 60 aa, Enterobacter cloacae
FDELTLIVYGPIRLAQDTRYGVAMTKYFERCHSLLWFCTKILIFIREVEVQPCRHPKSRP

SEQ ID NO: 10875 - protein, 83 aa, Enterobacter cloacae
ASDKVIGLDVFADLVVVDGAITYQRVSDEHLPVLNNERKRNGRSGLVRYGEAVSHEDNLRLHAGRRILNADPHPCRVILTIAG

SEQ ID NO: 10876 - protein, 69 aa, Enterobacter cloacae
FLIKIKHEISGKPVLNLIAGKGCFVLKYIPTLDVLNGITFKLSVDNTFPLRPDSLIQFHQPGIIIHFVY

SEQ ID NO: 10877 - protein, 137 aa, Enterobacter cloacae
GIIMIRMEVKGLQEFERQLLSLGEKVGTQVLREAGKAALEPVLEDMKAHAGYDESAKDEHMRDSIKIRSSSSKAKGNAVVYLRVGPSKKHFIKALAQEMGTVKQVASPFIRPALDYQKAKVLRILAIEIRDRIENHR

SEQ ID NO: 10878 - protein, 134 aa, Enterobacter cloacae
RFYGTNLCANLCSKQRSKTMKIVLSVLLLTAFNSYAGTVDDYLERHSEIKSNSVAETYVSHYAFMIAMMEAQQKHNRSDNEFITGLLSNNGDVYARLAVKKLANDCLTQRSIGQSGELNNKECNIVIRADKSEQ

SEQ ID NO: 10879 - protein, 124 aa, Enterobacter cloacae
LITIAAFGPLFFRGKQMLDQNVVKQHCRIDTDFTGDDALLEIYTGAAARYVQTWTRRTLYEKESSPGYADDPDPILLNDDVKAAMLLLIGHWYANRESVVIGETVSQVPLAVEALLQPYRIYGL

SEQ ID NO: 10880 - protein, 126 aa, Enterobacter cloacae
GELREHGNGRPLTGPLFFQENWMAEYGVQTWDASGKVNNYGVKPVSVCGYLQLAQNQKTGSYTVALPPGCRLTYFQSMNGDQFGTSRRKITISGGTATVSAAGDTDYSAGTEPAAAAYLIFQIERA

SEQ ID NO: 10881 - protein, 472 aa, Enterobacter cloacae
APTRSPAPPATNPFSFEQTPLRRGFLLPGENMIYTTGTIAISGNTLTGTGTNFTAAGSLIRNGCTVIAMTSPVQVFQITTIGSATSLTVTPAANPAVPAGTRFAILLSDSLSVDGLAQDIAETFTMYQRYMSGFADVMNGTSDVTITINGTAVTVPGQKSLAKKGANSDITSLSGLKTALSIEQGGTGAKNAADARTNLGLGTSATLNARPNETYPTDGVLTVGQYGIGAQNPPLTTDFKTIDRGGIFAGAGSAGVNFYNAFAPVLVMSRYSSSAMQAIQADNSTLAFNIKDGNGWRGWVKLYSENNTTRASDGTLKVASPVVRIVRSQEECRRADVDKDGFSWCGCGTANAEAEGVTLFRLDVGVYVISGSAGLASEGWQLLPPMDPGGMGELGVVEAEQTESGGLTIRLFKRKYILSEEGEIVKTKGAPIDVPANSWIDVRLDMPEDSIWKTRASEASLELTEQPEDIQP

SEQ ID NO: 10882 - protein, 165 aa, Enterobacter cloacae
KPPVALAATFKEREIMADKTSPEYAMLPAGTVVMWGAAGSDVATMKPLINCKALGATGQTGSFVDCTTLIDTSKQFISDLPEGPEKSLGFIDDPANQDFADFLNAAENRETVQFYVELPNGRTANMILALSGWQMNEITAPASEVIQITVQGKQNNITWGTAAGS

SEQ ID NO: 10883 - protein, 125 aa, Enterobacter cloacae
FSGKTMSTIDVSALKSALLKPKSAVVTAEIFGTTVYLRRMTAGELIDHEEALRDSQIAEDARKASEISVQLIVDCLVHPDGSLIAAKDKPTAAELLQTHDNVALLDAIATVKKHALGKLEDAEKN

SEQ ID NO: 10884 - protein, 157 aa, Enterobacter cloacae
PSPRWGEGIVLHLCESSSMRIKTGLMVAAFVMLAGCNAPAQHVPVETCKADNQMQQTTLYFGLNRPAGAQITGSEWQQFVDQDVTPRFRDGLTVFDARGQWLGNDGKVAREPSKALMLIHGKDAQSEKNIEALRGIYKSRFAQESVMRVDQPVCVQF

SEQ ID NO: 10885 - protein, 80 aa, Enterobacter cloacae
QNSQKGLDLRLPGCGMFEAGAQEVNLLLRRKPDFIVYFHADKKRPNTIPVFGPGKWLLGESRALKVGINAGSIALPFKNR

SEQ ID NO: 10886 - protein, 77 aa, Enterobacter cloacae
LKAGQLSDQPHYMINIVPFLSLPFVFHILVGFIRFRDENKNTEANKNNEGNDDARNQFPDCWRIVLRQETDTIGNEG

SEQ ID NO: 10887 - protein, 460 aa, Enterobacter cloacae
RIYKQQPDPDSTVPVVMIVFLYVIAVAMGLAIRALTWPEQEHVTALFFVPSVILPICVVSLLVFTSFIFHDANIHYAETRKFIAKEQEINLKAYARKNIAIAAWSAITPLEEPALNMLKLEGEFPLAPKTPVNIQLEDRFDQTRNEQMFYRLLDPMAEKLKDYNYRIFETVVWVHGGSGSCIDELRRTLERLGIETASTCKIEYSTECPDYAIVSQWMNLSDYRVENRLIVIVDLHEESGESKSMENACAFLLTSHYVREEGEKPVYLYQPMSDVTDVEDKMAVFLETGSVLTPKNLWYTGLSRIEKYPLMQALDKKALTVERLDIDASLGAKSAGYRWLALAFAADAVKYAQGEQLAAYSDKNKFCITSLSSMKTAIPKKLTWCNWSNPLYPAGMAALFCVLSLIAYRISFLAQNDPPAIWELIASIIIPFVIFIGLGIFVFISKTNEAYEDMEYEWKR

SEQ ID NO: 10888 - protein, 108 aa, Enterobacter cloacae
MPAVSALFTLNPHDAIDDYRPRKIIEKQDITSFAQNKYGFTVSCCVLPCIQQLLSTFGTYNLISIPLNTKGIPGLKGVIHRRYPDAKTGIVYRIYGGIGDLFMERKQV

SEQ ID NO: 10889 - protein, 128 aa, Enterobacter cloacae
ISRGKKYRLSASAGMENNRTVWGPRLLSSLMIDFGSSPIVIMATRESFPCAAIVWFTRLMASSLRSVLTHQTPPTGMWRNSSHNDWMPIENMESTVSLFSSNFYVSQFTSESVEINLTLKLKNIRFSM

SEQ ID NO: 10890 - protein, 183 aa, Enterobacter cloacae
AVRRRRTRFRRLSLRIGPSFPGEAGVNILPLHAAPQFTQQVIDWIWYAFGEGMPRAFFQSIVEHSLTPGELPLTFIAVEDDQLLGTVGLWRCDLISRQDLHPWLAALYVDEAARGNGLAGKLQQHVIGYARRAGYHELHLWSACRDFYERYGWHYIGDALEYPDKTVHLYRCSLTASAGDTTE

SEQ ID NO: 10891 - protein, 65 aa, Enterobacter cloacae
PKQYLKLVASRQMHFLTLLRTCFLSISKQKSSVQRQWKKMLAQYLQAWLNLLLTPCSWISGKDPR

SEQ ID NO: 10892 - protein, 198 aa, Enterobacter cloacae
NVLILSTGLHFGGRIVMTVKKKKTALNHDDIADGRIVSSRHLVSERCAELSELEYALIMTSNAFNKWMVRCMTAAGEPDMGAFDVSLLHHVNHRNRKKKLADICFVLNVEDTHVVTYALKKLVKAGYVTSEKAGKELFFSTTEEGKALCMKYREVREACLINIRAESGIPGASIGETAQLLRAISSLYDTAARAAASL

SEQ ID NO: 10893 - protein, 128 aa, Enterobacter cloacae
GGRMIFKTVVATLFTLSGLASALAATPAYYIAEFQATDLDAIKPYSAQVESTFRPFGGRFIVRGGEPDVKEGFGAQGRLVVIKFESLKNAQDWYSSAAYQKIIPIRHRAGNSRTYIVEGLPELAPVTP

SEQ ID NO: 10894 - protein, 88 aa, Enterobacter cloacae
FSRREDMRGVVKIIIPFGGEKRRLTMLITRMQENHVATVFGGQMDMPIRKGVADPLRYLGKNMGLSVVMDLVDGVEAQTVKMILREPE

SEQ ID NO: 10895 - protein, 388 aa, Enterobacter cloacae
CVPERERDRGDRTAAYRPVGHSDRHCGTDHPYDASATPRCQHSSRRDGLESRAGYAGDRTMMTLITINRVYYLIGFVVMLLVVMTLRDRANPKRYTTALFWFLFGGIFLFGDLMVQELGKSLAYRIIGGAVIVIALLAGFGLVGKGRYKMSTEEERVASSNRLKNWLFLPALMIPVVTVIGTLFLKGVSIGGVYLLDQKQLTLAALCVACVAAILTGWWLTKGTPLHAVRQSRRLVDTIGWAVILPQMLAMLGGVFVVANTGESVQKVVSLFVNPDSRFMLVVIYCVGMALFTMIMGNAFAAFPVLSAGIALPFLINVHHGNPAPLLAIGMYAGYCGTLMTPMAANFNIVPAALLELKDKYQVIKIQIPTALTLLVVNVFLMYFLVFR

SEQ ID NO: 10896 - protein, 334 aa, Enterobacter cloacae
GAAMELTQHQADAFARMPLTYLRQEYPNHIMHLLNDDGDVLPPRELHPIFYGCFDWHSAVHGYWLLLRCLRLWPELPCREEIITLFEEHLTDEKVAKELAYFTAPFRASFERPYGYGWLLALAQELKQSSLPQAERWYQTLQPLTRDIRQRLVDYLSKLTYPIRVGTHYNTAFALALGLDYARAVNDDTLERAILDAATRFYLADTQYPAHYEPGGDEYISGALTEALLMSEVVEDFPAWFDAFLPEVGAVSALMNPAEVSDRTDPKIAHLDGLNLSRAWCMKHIARALPENHHARKPLHDAVARHLSASVEHVVGSHYSGGHWLASFALLALE

SEQ ID NO: 10897 - protein, 266 aa, Enterobacter cloacae
CTGFALLRSIKNSRRRATLTLDRVTFMDSSTLLPLIGIPVVVIGFALRFNPLLVVVVAGLATGLLVGMDFGMLLETFGEKFVNSRSLATFILILPVIGLLEYYGLKERAQAWVAKIASATSARILMLYFVAREGTAALGLMSLGGHAQTVRPLLAPMAEGAALNEYGELPQTIRDKIKAHAAACDNIAVFFGEDIFIAFGAVLLIDAFLKENGIEGIEPLHIGLWAIPTAIAALIIHMTRLLRLDASIRRDVMAWKAEQGTQEIAP

SEQ ID NO: 10898 - protein, 113 aa, Enterobacter cloacae
QDCKTLWCNRSQFWQSFYDIGSRIAGTVSDRNDLLVCGRAIPVLGIFETLKLDYNQSALCSKPFFNIGFTSSDDEASTKRSEGRFNLSAVRFDSVKIGRLKLCDVISRRCCQG

SEQ ID NO: 10899 - protein, 120 aa, Enterobacter cloacae
LLTERRRNKQRGEKMVHPGGLLGLRLALRAVAKATLSSLVLAINSHTLKQQHRCYPGEYGASGRIRTSDRSVRSRVLYPAELRMHRDLLLLLLILGIASKATQSKIWCIREDSNLRPLGS

SEQ ID NO: 10900 - protein, 129 aa, Enterobacter cloacae
NNGSSAVIICLFIAFIGIVISFYIDYRKNYRQVNQIYAILTNQQLLKKEDYQTWQNLGFWGFGFLTTILSRVLQGKRVRLTECRWLEPQSCNKFFSDFDLSWVKSYRRKILIATVIFLLLLILSSINSV

SEQ ID NO: 10901 - protein, 383 aa, Enterobacter cloacae
TKSFKRMPNRRAMLRITIPPWRCGWATLRTPLCCIRSLTQHNFFPAELIRHTRIDMKLWLSGLALLTVATTAQAENFRIVQSPAQKLDIWIDNIKDNTPQSWCKADVALRIVANGKKEVSVLENFVPRLGSLLEHQCSKLNTLNWTLNDPEGTTLARGTAAKAQDWALVVKQQETTAATTTTSGALLPPDQNPETHTVAADRTPWQEFTLQDGCHLRTFWEGGSSAPALFIPDSDTTRCGNGSWLSGHTVVTQNRNGAQKAIPVTYIHGFPVMGLNNAVDPEKALITSVNKERMVFSTPNSDQSWMILPYDSTLNGWKSNGTVAVEITREIASDDARLQARIAEVKKIWSAWVAPGAELNVVLIDTLRPQLRDPAVGAWRAAN

SEQ ID NO: 10902 - protein, 351 aa, Enterobacter cloacae
KGAGMSEVAPATLRVHRLTPLPDAFWRGVRETPWRYDLFQLLRRIDAQGGERYPLGRAPLPKFEPLRIGQKPSMGFAPSTVAEVRQREENGLHEVSILSFGLFGPNGPLPVHMTEYARERIHHHQDHSLSAFADLFHHRLTLLFYRAWADAQPAVSLDRDDNRRFEGYLASLIGMGQPAQMSKGSLSAHARFTHAGHLTRHGRDPEGLEKILRNYFNVPVRLVANVPQWMPLSTREQAQLGEGRRLPRMGESAFLGIAVRDVQHKFRLEIGPLSADDYNRFLPGEGWVTELRDWVRQYAGVEFEWETRVILRADAVQGATLGSAGRLGYNTWLGLQPQPVPRGDLVYRAER

SEQ ID NO: 10903 - protein, 499 aa, Enterobacter cloacae
IRKPAGNRTERMYNIKFVYLFHENVSPALFAKIIRPSVAGQWIMSVPDHSLRSLFTRYDLLRTITGANPYQSGRDTRTLIAQDLEMGRVVAIDESFRDWSSVTEIFYINAKGQLQAASLVGLGWYPVSTIVDRYETMVRTYGSRPAPTVLPKQVVKSKTAQVPDEPTPGKDGKTYAGQLQKMTKAERWQARKDLIAKGSNSLYPDAQIAAKRLAANNIAVEKAKLAENIYKTVNPLETTPGVPEGWTDISNDDALLGKFGLNKSMLFDDDTSPNFLARVYQPKPEVFGADMNPTLVFRGSREPGFASLSENVSSLLTKGELAPVVNGADWSNNFSQGMGMASDYYKKAVSIGKELARSGQNIDIAGHSLGGGLASATSMGSGKAGWTFNAAGLNAGTVEKYGGKILGSTDNIQAYRVEGELLTKIQEVNPWEDLKTMKGHVPSWILKEEISALSPNAAGIPHDLPGGTGSALDRHGINQAIDCIEQQKDEDISIIGSRL

SEQ ID NO: 10904 - protein, 173 aa, Enterobacter cloacae
KRSSSRRGANGHPRRLSDCSTVMNARDKVFVFWGCMDALAVVLYCAQSMRHDKIPFISDIHAFSTVVNALSAGGYSALVILFFILDFLLLLSFIASAWCFFARNLYASRLALYQEILRLVGFRYSVSLFPLVLSFTGVMNVWLNGFLFILSEFLKIYSLWIYKYEGERPPVKE

SEQ ID NO: 10905 - protein, 294 aa, Enterobacter cloacae
LTRCVRSCAIRQWAPGARRIKGGAMNTLYQRLAGESISDALLRLEAEIKARPADADLRAAFVQFLILSGNWARALTQLKSWLALMPQAKPTVTLLEQAIQGEQQRARVFAGEARPAMPEAQWPWLSTLAQALTERAGQAQTLRLAALEQAPASRGQVTLENEESHTFEWLMDGDARLGPVCETLVNGRYFWVPFCAIDAIRFQAPASVTDLVWRHALVRLTDGTEQVCQIPARYPFADGASDSVRLGRTTEWLPLDDDGVLYEGMGQKAWLSEQSESPLLTLSLVTFTSDGANE

SEQ ID NO: 10906 - protein, 630 aa, Enterobacter cloacae
TERCGVMMESKLLEYYNRELAYLREMGAEFAERYPKVAGRLGMRGIEVADPYIERLMEGFAFLTSRVQMKMDAEFPRFSQRMLEMIAPNYLAPTPSMAIAEIQPDSSRGDLSKGFIVPRGTMMDSLALKKTGVTCSYTTAHEVNLLPLKIERIELGGVPADLPLAQLGLSQRGISSALRVRIACDGPQHLGHLDFDRLEFFLSGPDIEALKLLELVMEHHAGIVCQTVSKQPQRQLLSSDALRQEGFDADQALLPDDLRNFDGYRLLQEYFAFPARFRFISLSGLGKLIQRCEDEKAFDIFILLDKSDDQLERVVDASHLALHCTPVINLFPKVAARQKLSESQHEYHLVVDNIRPLDYEIYAVKKIYASADGQRDDQTFRPFWSTWSGDAGNYGAYFSLRREQRVLSEHALRYGTRTGYIGSEVFVSLVDAQHAPWQENLRYISAEVLCTSRDLPLMLQQELGQFIMADSMPVKALTLRKGPTPPRPALAEGFSTWRLISQLQMNYLSLMDSENEEGAAALRQLLGLYANLAETPVARQVDGVRHCVLEPVHRRVPEPGPVVFARGIGITLTVDERAFSGASPWLFGSVLERLFARLVSINSFTEFTLKSQQRGEIGYWAPRMGKRALV

SEQ ID NO: 10907 - protein, 128 aa, Enterobacter cloacae
TILLSKKPLYGKQESMGLNKTVHILPLPHIKRPVSFDSLTFPRNNGMNVKSLLLCFIVEPVKDSISNLAVFLAGWRCAYPAYIEQRYQLIARLIVGPCKRSAAGRNSQNARSQQSDALTRPSSSATAV

SEQ ID NO: 10908 - protein, 195 aa, Enterobacter cloacae
CRWQQQSLQRQRERYLDPELNGFHEHIFMNNKNFHRMWFPFFALIFALIGGCTSSSHSDPSRYNLQFQAHPQINDSAPLKVRVLLLKSDADFMSSDFYSLQNNASATLGANLLNSDVFFLMPGQLSKTLSGQSSPEARYIGVMAEYQALDGKKWRVSLPLPVPGENAIYQFWKWSADELQASVFLDVNGIRVISQ

SEQ ID NO: 10909 - protein, 343 aa, Enterobacter cloacae
ISRDLMNIDEFLAPISPDNPCGENLEYDADFQAMGQASQGKAEQQFGDTIIPAEPADWNTVEKLATSLLGRTKDLRVMLALTHAWTRRRGLAGYADGLLLVQEALSRYWEQLYPLLEEYGETDPFYRINALAGLSDKSDLTVAVRNASLLRSNGDEISLRDAQALLDGSKTECPDYPGGRPRLIDELARGDQPGTEAVIVINERLLAIRELLTGYLGESGVPEMEQLLKTVGLVASACQVTDISKLLPNRDAQAEQHAEPQPAAAQPVQPVTDWRSVQVTSRADAQLMLEKAKQYFAQYEPSHPAPLMIERVQRLSELNFMDIIRDLAPDGVNQLENIFGRRE

SEQ ID NO: 10910 - protein, 209 aa, Enterobacter cloacae
NSSTGSRPLPVVKVLKAALAGTSKKTKKRNRSGPERAHFILYFLKGKIFMRPAFGAAWNRFREVNVNVETVGKLLGGKVQHNIEAGIFQNACPIRMSYVLNYCGVPIPSNSRYATVTGSDKKRYMYRVKDMIAFLPTVLGNADMTVTSPTPSQFAGKQGIIIFSGHGWSDATGHVTLWNGNICSDDCHFLGSPGNGSFIPGSATLWSLK

SEQ ID NO: 10911 - protein, 184 aa, Enterobacter cloacae
HLSQILSPSLHPLNIATEKHMKLRVLLSLLFVMAVAGCKAPQKPAITDDTIVTSQVNGITLTHRHAVTPPAEFTQVNEPYRAMYPASLMSRPDYGGKVIRTLETGKTYVVLGQVEHFWMALADEGSEQLIGYVPMRAVIKADQYEATVRKQALRPKARKKTTCVDVDGNSKACKDSANGTWILN

SEQ ID NO: 10912 - protein, 461 aa, Enterobacter cloacae
MVSGSSASNALHNRKEIIMTKAEKVVWTEGMFLRPHHFQRTESYLLNHVREWGALQRSYLWGFLDLELDEAMLRQGCIALSYCSGLLPDGTFFQVRSDRNGPAPLKIPDNLTNEKVVLALPVRRGGREEVIFSEEQSSLARFITFEQEVEDDNAMSVGEATVQFGRLRLTLMLEKDLTAEWTAIGVAYVAEKRNDNHVRLDNSYIPPMLNANNSPQLYGMINDLHGLLVQRSQQIGGRLRQPGRFNTSEMVEFTLLSLINRHLGDVSHLKTLPLFHPEALWRSWLPFATELATWTPQRTAESILPVYDHDHLAVCFSKLMLMLRQGLFLVMEDHAIQLPLHERSPGLNIVTEPGDQHGPRIWLRAGGKSQCPRRTPANPFSCPDEGCASLENPRSGSASAAGHHASGNARRAAADPVACRLQLFRTRKGQRTVARDGQVRGIRAASRRGIPGSRYGVLGHP

SEQ ID NO: 10913 - protein, 278 aa, Enterobacter cloacae
AVRPRSTSTDIRSRWSLPRTASATRSSFPVSHAHNRKDSRMTNTPAMNRYSWYGKLPSAGDFLQRRFPDTLQRQWSHWFQVGLLAWQQEEQRSGERPFSKAPVWNFVVPPMLGSQMIQMGCLLPGRDSVGRHYPVCLQLSFTPAEWSSRLLGQAESWYQQLGRLGLHAVRNSYSASQLDEMLMTIPAPQPVEPQKRSDILDVIGYDDEGQSTLGWPQAAECFDPLRQTSYWWTNRCDGYPLYTHVHSGNFTGQLFTLLFDPAGGARPGRHGLYPPMFE

SEQ ID NO: 10914 - protein, 118 aa, Enterobacter cloacae
TSSPSPETSMVREFGFVLAVKANVPGEHLQTHFPAQMKVAPVSKIRDLVQLQLPGIMLRAMPVAPPQIPWHAGYSYFELERGSELWHEMDKSGAFALHLAGEFPGLDMEFWAIRSPTE

SEQ ID NO: 10915 - protein, 131 aa, Enterobacter cloacae
WFVYSWQRYALEPEMRRLLAFVLALNTSYTIAHTLPDVNTFSQQQIFENWVQNRCIGKIADSATLKNDAKASAAAWLEVSNLPAENFEKADEVINSLLKQKLGGTAPANYEVLKCSLISHSDAIRQLNVQK

SEQ ID NO: 10916 - protein, 329 aa, Enterobacter cloacae
TFCKSYTLKIQGVYMASPSNVAPGYCVVQQPGTLDFQARQLFGTARNEKSEYFMQLNKDTAWLKPGQILIVADPLGDNQTQQINSLAIAKKKVTNALATLDGATAEFLKNNYDNIKAITGWGDTIVGGVSGTGESYFKQIENILIKIEATYQNQYRTQGALFGQQFYAERNALFAQLKPLLNKITKKQLKFKDYADLKRALGLSTKSIVHEWSTVGIGAIPGYSTYIDRAARISSYLKAGGWVALGFSFMNTSNEVYHACTTGREHECSRVAVTEYSKFGGGVAGAALGSSLAAPVCLALGVPTAGTGTFMVWSSGRTVGAGGKTKIVG

SEQ ID NO: 10917 - protein, 68 aa, Enterobacter cloacae
QALTQLNEVRNQRLSIIYCHVYALSLDEGDDSETGAAGFTSAVLTTGSSGGTCFFTSGSCGDCSGEAA

SEQ ID NO: 10918 - protein, 99 aa, Enterobacter cloacae
RPGGDFPVQGGDLLGKMLRKPRDLFLLFTLNRVAKLVEVGLRFSKVILNDGAAGAEELPVKARFQRGVAHQRCGLRPQRDQLILQPLKKQCCFQGALQW

SEQ ID NO: 10919 - protein, 85 aa, Enterobacter cloacae
CHKAFLSLPSANLSKSAFFHAYCLFIVFSTIIHKHKRKNCHKLLIGFLVFAPKMDHPSQKETECTTPHRLSPPLLVDLCSLLFSA

SEQ ID NO: 10920 - protein, 72 aa, Enterobacter cloacae
RPWRLSSGVMPLVISSGAGSGAQNAVSTGVMGGMVTATVLAIFFVPVFFVVVRRRFSRKNEDVEHNHSVEHH

SEQ ID NO: 10921 - protein, 63 aa, Enterobacter cloacae
PPEAGVLFCHSRNLARERSNPLCATLNILTRYWFFIQCFLLAILATTSKITHLPLILSSGRRP

SEQ ID NO: 10922 - protein, 345 aa, Enterobacter cloacae
CQEFPWKGLLLLSGVRNIALTILSCGLIMKKPAFIITIDTEGDNLWQNHRMIKTENARYLARFQALCERFGFKPVWLTNYEMAVEPVFIEFAKEVIARGQGEVGMHLHAWNSPPEHDLTGDDWRWQPYLIEFSDEVMREKVLFMTRLLEETFQTKMLSHRAGRWAFDSRYARLLIELGYQVDCSVTPRVNWRNAKGAPQGNGGTNYQHFPDRAYFLDVDDISRPGNSPLLEVPMSIQYKHPAWLNSLKQGYDRLRGKYRSPSVNWLRPSGGNAQEMIKVAQQCLAQGNDYVEFMLHSSEFMPGGSPTFKDQAAIEGLYQDLEQLFTWLSDKTVGMTLAEFYQYKK

SEQ ID NO: 10923 - protein, 108 aa, Enterobacter cloacae
TTLPHVRSRGRCLTVCKNHHALQFSRLGKFWHILPKPIVHDEMTQYLFSFLQHKSRVPLLHIGEWLKPEHCDDMIKRLAFGIFPDSYFKGYSYDHRYWRRGLYRQQYC

SEQ ID NO: 10924 - protein, 309 aa, Enterobacter cloacae
PNEKNMFKFLNARYRHITGRHNIPYASLPVTRDLVAVDSIVIPCTGADFVEEALLSATFAERYATDVSEIVIVSDQPESAFGELPLKTRVVTLTLPKREEGYRYKQIYLSRLVKLNAPLQARGEGVLMIDSDLNLLKMPEINMADMHIYSSFRQGKMIAKLDGAPAEKVPAYYKETVRPYLVDHVNGAFLAATKKTWRRICPLWLTLFQDTWELMDDTQPPTDQLPLAALLDMLDVKTVNLGDWMNWPVSKKIGGQEAVVPKEVIGAHGGFPLSEWQKYLESPDNKLLFKGQDYTRKVRYLTDEEKKNQ

SEQ ID NO: 10925 - protein, 81 aa, Enterobacter cloacae
FRHGSSVEMQNAKNPAVAGFFNTRRLKLFDFSFFVQYVLAYNWIEFFQFQFFRLSTFVLRGGVEVTCTSRRNQLDFLREYL

SEQ ID NO: 10926 - protein, 64 aa, Enterobacter cloacae
WYVAKVTMSGINVYGERWSQNISTLSPRRRNATCYRYTNLISPECCIKIAQYEVFIYDAPLITD

SEQ ID NO: 10927 - protein, 60 aa, Enterobacter cloacae
PVSSAMASCVESIADLNINAPAGLASQSGADNTVRMCQHHGHTYFSYGAAGRVNASALPG

SEQ ID NO: 10928 - protein, 60 aa, Enterobacter cloacae
LVGLITRRSSVQIRPPQPTLLKTINTLKGVFLYLAFVKMPGMIPGLMPYPRRASVSPSEK

SEQ ID NO: 10929 - protein, 85 aa, Enterobacter cloacae
NCSDRHVRDKAEEKGTTKNNQDIGLPGKWCTGLSESTLREGRLSMMHHRQPALIMVMYHWVTRQTSNASNIKLFFKKRQERSLTF

SEQ ID NO: 10930 - protein, 159 aa, Enterobacter cloacae
FMKHLKMIAAMLLLTPLTSFSQETDSVEALNKYSTALTELFMKELQKSQQAKNPGGMDLVAANDAVASALSKKFFIFKPADETSIKTSAEKLKALKDDTEALEKGYTIIQPDNIGSNNISYKVTTGSRICFVQVTRSKSSSNTRTVAVDSIDCTGPEQK

SEQ ID NO: 10931 - protein, 139 aa, Enterobacter cloacae
  UNSURE (13)
  UNSURE (15)
  UNSURE (36)
RKIIGYFSNHCSXRXGWYAYGFINTRELSALRKEMXLYVDRMEAAELDLHAIRSVAEHRLHGAGKQFADLYSRIDGATVTLTPEDQLLLATMPFNIQDVEDIVNERGPKTISGRPFWEVEPGPHNYEYGPQYPYFPDQR

SEQ ID NO: 10932 - protein, 128 aa, Enterobacter cloacae
MSCYGDKMFRHNTEREWLIHHLQELYMRKFKYIICHQCEGHGTMENPAFENGFTQSEMAEWEPEMREKYFAGAFDVRCDVCAGDGKLSVPNVAAMSFSERRVLAARRRDERLQAADERLSRQERAMGY

SEQ ID NO: 10933 - protein, 290 aa, Enterobacter cloacae
GATAKMKMTKPKPVSRMKRPFISELAELGLSGEILSIRTDGMQGTLIPDLTAGVSEAGRVKTGNWVISDKRTFDHVVLCVERQDENHDVFVGKFIQLHVAANKSLKIVEMGDVKLVAITSSIPTTFNGGIRRFKGVTYVSLSQTAQTTIDFPKRIYKEGQECTSVTSPDQGPFARDVRLNCYGRCVVTGVRSPWRTEAAHLTPRHEEGIPDVTNGILLRRDIHTLFDNDHCAINPDTMKIYFSREARELDDDLLKWHGDEIETTRMQVPVNIENLRIRWQKFKAKDRQRK

SEQ ID NO: 10934 - protein, 166 aa, Enterobacter cloacae
YCRAFVHWKSYREAHMDRIKYLKWIAEESPSTAQQLVAWLNRARHYTPDMKEHQAGVQIQEKGIVVGLRQSTNRYHGDCLTIHVVRLPEEIQNKGWFKSFLKLCCESNPWCDVVIEDVKNPYLLSFCKKLNFTVLDEFYPNTYIVNTDAIMSLPIPPLGRYETYLY

SEQ ID NO: 10935 - protein, 90 aa, Enterobacter cloacae
WVQKRQLLALGVSYPPKSGWIERLIGTEVSDEQYERFLGHSTSKQAEQILRGEQPAKGLQYAKRAKKLASERKATIDLDNEHLSEIEKYR

SEQ ID NO: 10936 - protein, 147 aa, Enterobacter cloacae
KPEAVITQTGPYSVRIVMDDKEQFTNLVAKHASGLTEEQLAGYDACSLDGECVTPSYEVFRGYRTRHTLDEFLEMAISLNAIHPDEYLTDMLLKPHEVIGALADEGDQLNNATPVYFFPDTGVYAAAVSETRVLDAWLCWPCYPANW

SEQ ID NO: 10937 - protein, 135 aa, Enterobacter cloacae
LFCALLAGGIVLACLNITQEGNLMATEIEVMTVAELHAQLQQLVDEGHGDIPVCASDLRARYPFKAYTVLSTAGYTEALLINVWPDAHFTRKEPLPTNWGKNRVAEWNSDADAVRQSCGAFADNPQSRQMTGDNL

SEQ ID NO: 10938 - protein, 190 aa, Enterobacter cloacae
VMISSSLLWCSFSPITQQVMNTRPVMDATETEELEKIRKKAMDEVTSALQALENKFPGITEGAAALAGSGVGAAASFGALYTLGTTGVSAAGITSGLATAGSIVGGGMVAGIAVLAAPVAVLGIGGYAVVKHRKNAKLTAALSQAIQKLYEVQERLMSNAEYFKAEIAGIKATIDMLTKKAPKGSLVAVR

SEQ ID NO: 10939 - protein, 150 aa, Enterobacter cloacae
RAKKDGFNYMNKTALVMILGILGCGKAFAATELQLQQKRVMHFCANASLPLLIAGTTYANTSDNGRPEKERVAILKNAVVSSTAYSMASPGVQRAMMSVVEDIADPKELALHQKEVRRLGASYLSDSGVTWASKTVSPFTAWCNFNRFES

SEQ ID NO: 10940 - protein, 67 aa, Enterobacter cloacae
MQTQKEITVGQIWEEVDPRLIRKVRVVEVASLEGPKGILIENVESGRKNWASSSRFNGKRGGYRLIS

SEQ ID NO: 10941 - protein, 153 aa, Enterobacter cloacae
ATASCAFTTTTTARKLPVSICLKMPQPKPLWSSVNCIVMALSGSLKLSVRALPVAWRLLPPSTALTSKITLNHTPAMPGFFLVAIRYQEGGGQKGFGNLRKQRDVNSDVSLLKAGNGFFSGCWLKPVFRALYQQHAPLIYVTFATYEGTGSGR

SEQ ID NO: 10942 - protein, 69 aa, Enterobacter cloacae
TSLFEPGYSDPFPGPFIKLSLAIPITLFFLLTKPVAINSEFSVSNKEPLYFGHDNIPVCLELFRQTCQG

SEQ ID NO: 10943 - protein, 74 aa, Enterobacter cloacae
VRLLRKLISFGRTRKTCGGDFKHTDFGKIILPFTLLRRLECALESTREASLDSQPATIEFLEAEFSVDFDALLS

SEQ ID NO: 10944 - protein, 68 aa, Enterobacter cloacae
RDEDMQHVTRLTPRWYDGLAFTFLSDRHYVLIIREEHGMSNEVTKGMLSAQVRGGIVRDCSVLCSPVG

SEQ ID NO: 10945 - protein, 465 aa, Enterobacter cloacae
GKHMSQSPYDDEFRAIRYIQLRGQDIANAHETISSDIESLKAQLTGLISGTELDEAEHLALKEHHLREMTPSDTAMHSTSLKTIYSEANQRVCGDIGLTTILSTDDLAVVDARIQNHIKEFNDRYALDAWDYAIACGCGLIASMLDLLCVRAPPKPTVSFTAEVDGIFNKQVQKAFNAILPEDLSKKLSEMFPIGAPDSSITSDLVGAAGGVLSPTNHRLRALSHDPILGIIIGIKDMLNGTCTVVQNGQIVVYPSSKGVTDETNIFRLIARMFGHLASDVNAPSAKGNRGMGLPAPFMGLLRMLEGIPVGSSNFGKQIEYMYVNGYDFRQFIVTSIPMTIMEVLMRVFYVAKQVSLGKGAFGETLLDTMPLRLNPRFRMMLALGYGTSSAVNAGKMYITGNILNANYASWMGLAWNGFHSLKWSLYQRHLKLWAGIEKAELERLQNNIDSIEALNIRAGNLPVK

SEQ ID NO: 10946 - protein, 69 aa, Enterobacter cloacae
YDRLKPRIALGLSMNKQPLVMKITDPWRKSESQQVHQGENMFSEACGIGVMLGNFQIAFMVQQAIKHVG

SEQ ID NO: 10947 - protein, 127 aa, Enterobacter cloacae
VQIVHQRCDFTAFKQLAHLNAWLKMNGQGGRIYTHKIGIKQRMHCWSHQDAIRRIVPGSMFNVCRIQDTTINPTGYRTTASEILDEQSFKFTLCHATTLRHYALAVLTLDIYVRFPHWFAGGRLNLF

SEQ ID NO: 10948 - protein, 74 aa, Enterobacter cloacae
IQHGCYEPTSAGNSIIPGVERVAIIKFFNMILDPGIYNSQVIRGEYCGQSNITAYTLVSLAIYSLETSRMHGSI

SEQ ID NO: 10949 - protein, 85 aa, Enterobacter cloacae
FVGDKTPPAAPTKSLVIELSGAPIGNISESFLLRSSGKMALKAFCTCLLKMPSTSAVKLTVGFGGALTQSKSSMDAMSPHPQAIA

SEQ ID NO: 10950 - protein, 64 aa, Enterobacter cloacae
IVEGIETLSLQLDENETMALAQLVKRLSWSDLRGCAVSDEEAWVMKSAIEKLQQALREEGYAPR

SEQ ID NO: 10951 - protein, 93 aa, Enterobacter cloacae
NVINLTPCRLTVKKDALHTSVAPFCTCKFLNTAMADEYAALSLSLFINRKTAIRVSTMLGWLAIDNDGNKHVRQCFENCHTPKSSCTLAGTLC

SEQ ID NO: 10952 - protein, 74 aa, Enterobacter cloacae
LLIIGLNGNFVSLRKPGLIISERENGPREHLRWLAFQYKTVSPGGINFAPDIIIVIPADHQESYLWVKLFYFFE

SEQ ID NO: 10953 - protein, 60 aa, Enterobacter cloacae
FQGRSGREPKIDYQQTWRAMISNLSVAIILIRHHTRLFKLAMCNQKIGDAACYQWMVIND

SEQ ID NO: 10954 - protein, 166 aa, Enterobacter cloacae
APFFLILKLPHDIVNESHPFSNPTLLKLKEIKMLPDNLVPAKYHITPVEQPSTEADKEANFTQGKRKLSDYEADILIGVSRTGKSRNMVLEEHDRHLKERLFRAIKIEALVHLLNDLQAEGEIDAQTLSQIMVEKTQQINEAGNEIWLNLITREKNNPIFYNLGED

SEQ ID NO: 10955 - protein, 105 aa, Enterobacter cloacae
FMKKPLIVLTVTLMLAGCSTLKTDQAIPLLQAETAKMLGLGSSDEITVTNVNGAQPDALGGQKLSYRATTEKGRIFDCSSMMMPGILGSAPTLSAPTCTPVVTHK

SEQ ID NO: 10956 - protein, 93 aa, Enterobacter cloacae
PSRRKRPVARILEEKIPEAKTLAVRILVVKTPEAKTLAVRILAVKTPEVKILAVRILVVKTPEVKTRAAASRAFSRPWPKAATSGIPLARSPR

SEQ ID NO: 10957 - protein, 158 aa, Enterobacter cloacae
LRVKKTIPFFITWGKINVNDDSGNNVYLTLDDKKSDEFILKQNLDALKKIKNDEMTRITQDLVSIPATLVRLKWQNRREIYALQAKEEIYGAVMNAIIEQRPELKEKILGRLEANYQYLLARETATLRLTRKLSEGNYRTSNVTCVALDEEAPTAPSE

SEQ ID NO: 10958 - protein, 175 aa, Enterobacter cloacae
NQKKWSLPMNSIFFTVITLLLLTAGVLLLMQEFNKTKVSKDVSEPPQPELMSKEEGEDHFSVLMNAVTPVWYWRVNHEYIDFLHATIKRMKMAEINDTPGLFDAQRRCSDLNSAVYKYYDNIKKRCLNGEKVSYSDLDVLNLRQCFREFSLEAYPELVALVWPEYARPDVDPNEV

SEQ ID NO: 10959 - protein, 86 aa, Enterobacter cloacae
RLRHQDPAQCPRLEKDIPVAKLKLPAYVDILCDHIRAPVPDIRQRLSAKGGDDAGDGKDPAIDPLRSLDEANNGRKLAHLNTTNQR

SEQ ID NO: 10960 - protein, 196 aa, Enterobacter cloacae
KGWLVATSIVLVTQDCFLVRGMRLFFPDIICLSSIDRNIFDTDANEYTVLIDSRTPLRLYDYLIRHPARTRKTICCVMLDMRPREEDLLSMKLFMNTSLTAPDMASLFNLVLDMKGRRLTTKWLLNLRLSRHEAIMIRLLKAGRSMEEIADKLNMSVKSLYRKRTVLSERLGAGNFNEACLFIFKNKLLDAVGNDP

SEQ ID NO: 10961 - protein, 71 aa, Enterobacter cloacae
SHHASAWQAGTVGMRFFQSLQNDGISAPAQIRLLNNTFLRLVFSFSAVPFVGIPFAIWIYMLGDDLGPTII

SEQ ID NO: 10962 - protein, 110 aa, Enterobacter cloacae
KRIFDVTLPGNVRPDALTPTLSLKGEGAVCAGIILWGSLSSQGEGANTKNGNGCYRFASTMVLNTSATATAPGSITPSRFSLFTYDERPAPAFAIFAVASAPCCAACAAA

SEQ ID NO: 10963 - protein, 120 aa, Enterobacter cloacae
AGRSSRKLPADFQLIGNWYTGQMAILFIQKCAKECLSSCFYCVFNYFYNRLKHRAGAGECDLTHYTKAVLSMQRAEMQIYSRILIWCCIQCRIKSLFFSPGAINEKNHQNIRKSNYVQGE

SEQ ID NO: 10964 - protein, 87 aa, Enterobacter cloacae
RFIRGPRIRPLFHPFAQVNKFEDLLQRESQLLHKYDEQAAHPESFQRISNLSGIGTQVKWQSYLYKNVLKSAYLVVFIVYLTIFTTA

SEQ ID NO: 10965 - protein, 112 aa, Enterobacter cloacae
KQYGVGKTTGGVNIGNYMLFIKNKKVTIDGQEGDEIFSNVDWNGSKWESGGAVRSDGISIISAATTGTTTPVAFTTAVFPLVTSLAIQGTDTLAITDDTSLDGQATITLKYL

SEQ ID NO: 10966 - protein, 222 aa, Enterobacter cloacae
LFRRLHYCSFECEKKHLEKQRYGVDCQMKRLICSLPLLVAVSSHVSASEMTGFATQYYDEDGSLTEISTIVPLSPTITIGKKTVQMEVTHLSQIFSTYVEKDSSAHWICLHDDDGTNYWFISDNEMGAGLLTALAISRDGIHKECVNTTERVSVSVSGVPLLNATHGDLVELFGKKTIGNRKKILLYQETPVQDGFVQNNTVSYYFDGEKLRGVIIGQITSN

SEQ ID NO: 10967 - protein, 114 aa, Enterobacter cloacae
RGGSMTYEELINSPAGEFVMFASKDGKVRIECRFESDTLWLSQATICELYGKAKATISGHIKNIFDEGELVENSVVRFYRTTASDGKVYNVQYFSLPVILTIGYRRLIKMGKAG

SEQ ID NO: 10968 - protein, 307 aa, Enterobacter cloacae
FPSVYTFGEFCARDRLSNLLLPVSDARIICKRWLSDEKIKMDIVLFPGQNARAWAETMINLEARKLINTANIVGGQHLSDGLARIKFMDDIRQFVMQQFSATRAARSDEECMECLKNIRAENESLLEQSRMLRSRTAQLFAQIELVKENNKVVGYVISSIKVVLSGLQIVAGVGAMMTMNPVGALAGAILVMDGANAISKEINRTLQHQPNSEGMLADGVMDIAQFMGFKRESALGVFNSVSLAASVYTVFGAIRKPESWRLFRYLPLDFYRKVDGMNRAALTMKIVGWGVSAKVSFDLISNASGQN

SEQ ID NO: 10969 - protein, 294 aa, Enterobacter cloacae
SSAKNTAKSTFRVNNMYKYLPSERIDILENNLICFNNPLNFNDPFEFNTSFNFSSFESNLYDSLSTVDLLKEFPAELLNQIEKLPKEIVSNILKDAKKAMLSMYKKEKENIIRAADTTMQSFNSKLIGITRILSLTETPTNILMWGHYAQAHSGFIIEFDINHPFFSQRRGQKGEFGYLRKVIYQKEYPFLDPFSGDQINHFLIKSKDWEYEHEWRMLLPQANSGKTINVCEKEFDLYELPSDAIKTIIFGCNTSEHFKTKMFRLISSRTDYEHISFIQAKKSNSRFEIVLDPL

SEQ ID NO: 10970 - protein, 62 aa, Enterobacter cloacae
LTIQNGNAEELCLLKKKVIVARYMWYELILKKYKVDLWLFFHFKNNNDIKNVSSIKMVNIVK

SEQ ID NO: 10971 - protein, 250 aa, Enterobacter cloacae
AMMLLPRLYARLCARQAGRTLLANRITQNYSQFMRCPEADVPADFLHQNAHELSGFNFVEQIFPPALWARNVRFDLHGYVAQWTREQAFYSSSRTLLLGMRWAGFGLIVDALLATAPADVRFQFITRHPALHKLMAAHEGRRASSFFAPHRLVTVLLMDERLPDAPLFSTQAGDQKAWLTDVSTRFLSRYGYSVRTLLPICSLHAAEFGLESQAYAPEDYRQAAADTLNALRKTPTLWSAWDDLSVIYHG

SEQ ID NO: 10972 - protein, 120 aa, Enterobacter cloacae
STLLSRRKGSGMNNIETQLLESGFTVKELAYLNRNISRYGSSLLEVVLELGKRFIMVLCITATVALIFLALLFFAEHYNIVSGGISLFIVLIIAWFFQPPIITYKAWRFRKKYISSVQTH

SEQ ID NO: 10973 - protein, 68 aa, Enterobacter cloacae
RYLALVGTYMSTAKRDPNQSKSGKAPTFQIRITPELKAQFEAAAKAEGMSLGNWLKNLGRNELNRLKK

SEQ ID NO: 10974 - protein, 63 aa, Enterobacter cloacae
ISNDACRLRLKNAFSRVHYRKYEMRMTNEKENIAQRGGSGSLPPADDRDASNHARHHCPSPAA

SEQ ID NO: 10975 - protein, 80 aa, Enterobacter cloacae
SDAPVRCVAAWRAVVRLACWALRGLHPEGAEAYLKWAASSKILKVKLCVTGRRYMPGGEIMAHLVGLLPLKQVLRRENPR

SEQ ID NO: 10976 - protein, 73 aa, Enterobacter cloacae
DVEFHRPSLSLQGVSCMQIGLRNVLPRGYVFSADFFSYNTGQKAPSSKNFPHALVWRWGWTALRAPSRQMPLY

SEQ ID NO: 10977 - protein, 117 aa, Enterobacter cloacae
GFRKGAPLTIHKINFPGRLATSSGAPLTLESLMAPSPRSRSAERLVDIIIALHRNGSVNRRDLMQKFGITERTVYRDLQALSPIIEHDGKGRYQLLPAYQTCRCVHCPEANDETPQG

SEQ ID NO: 10978 - protein, 65 aa, Enterobacter cloacae
RYPTPWAVQRSVIPTPCWRSSTSSNFCANSFIARKAILYAPDFNLIHRALFNSAYKRKMRNLPCL

SEQ ID NO: 10979 - protein, 67 aa, Enterobacter cloacae
SIALRAMKLLAQKFELVLERQHGVGITLRCTAHGVGYRHGLLLQRPTRVAQGDGDLTLILTGTLAED

SEQ ID NO: 10980 - protein, 541 aa, Enterobacter cloacae
CRFSGTHCLSRKTMMISSSHHTREQFEHCLAAIRQASVEILLLLNVHVSEGKDPRWFLEQLDSARLGLGGWGAVARKLNLNDAEMTAFTLQLRLLQQRVPQYESGQDVSENQLIAAMRFVTSLEYLRLQQPLLTYETGRVPEKESQLQAQKQVRAIELMIKGLIQQAWPDPVRLNNHLKTLFNAERVRRWLKNGEINDVLSGMLFSELAQLLVDKKEFSRYYAPLFNAPDMLTLLVEPRKTLQTFLEDIRQIRNSITVQQPLSGAQIQLLDCYYTQITRSVQRAFEEGRTRVNPAALMAVDESELHAFWEKAQKMDRTTGGDLFEVRDSIEKPTQRATRTPEQREQLISGVLWGAVGVMVIAIVVGGFWLVNSSKPQPAVASTASPAPVQEMRETPSSRETLTRMGVTWDENNFRSAISRNDTRVALLFLQGGMDWKMSWTEEALSAGYDDVLEVMLRYRLQMTEQKPCRRFINTLSHAMANGESLTPMRKQYLKAFCTVPAVVKRQQHDADMATRRAKTQPDASTKKWQSIQTAIYEVIR

SEQ ID NO: 10981 - protein, 142 aa, Enterobacter cloacae
  UNSURE (12)
  UNSURE (94)
HCVDYIYVRFDXNSIFQKHYLLKKRDVFKGKAHLDTEVMADWVDTQKEINLFTLDSLSNINNTDEFNRKGNERLNEIYESRRVHGKDIKKNRKXELDSLGRTHVANGRSEPILPSSSNVLLLPGREEKQRWLKGKKKTEDAE

SEQ ID NO: 10982 - protein, 110 aa, Enterobacter cloacae
KALRVRLLLRKKIRDMKMHVKITAKLMAKMHLVLALVWAILTIPTLLWWKNSILWVSLMSIYAIVISHLAAYSAAHAEKAASKAMDKSEGASQKANQTANSLQGNARQAH

SEQ ID NO: 10983 - protein, 80 aa, Enterobacter cloacae
MICYLLGKPERKEWELFPDINHRVIKLSQIEKVTFDRRKEMMVSKRLKAKDYRTVSTGFNVLSSKPGLITLAIAHSYAVT

SEQ ID NO: 10984 - protein, 67 aa, Enterobacter cloacae
GAIPSWIWHGRCIEKRLTRSRSKFRSGFPIAVRPREKPGRENRYPAAAVKNVNQSPYGHGSGPVPSL

SEQ ID NO: 10985 - protein, 103 aa, Enterobacter cloacae
CNICLTGDQHLCSVVHFWCSVQAEGYLFGEYVSLFTFFGKMKALGKKEGALHGEFALAGQRAPDGSRKKNSDGHRDHCARSAFGAGLSFAAGASPASLAHLAG

SEQ ID NO: 10986 - protein, 111 aa, Enterobacter cloacae
ICRFFIRHGRRPGDQFHNTAPGGLSIAESIPFTLLIRKRERLWRGKHLPAGSGESGYRLIKIININSKMLEAKVAGAGGHSLFRAMHFEKFNAGSMGHNKHANGVNFCAGK

SEQ ID NO: 10987 - protein, 177 aa, Enterobacter cloacae
QEFTMPSSVRGIDHIGITVPDIEKATLFFERAFGAQVLYHSVDAETDNIDQAAQQHTLKLFPGTKIHAIRMLVMPHGPGIELFEMHGPEQGMPARASDFGLQHFAVYVDDFDKAIAAFTAAGGEMFTAPKPLTFPDEQGEGNAFCYGQTPWGSIVELISWPTPMPYEKTTNLRRWKP

SEQ ID NO: 10988 - protein, 68 aa, Enterobacter cloacae
GVQFLTGNKHPNSHVPSRRYQFLPERVKGGPESVRFSTHIPENIDVQQVTFRQCHTPGEEYTHHSVCQ

SEQ ID NO: 10989 - protein, 83 aa, Enterobacter cloacae
RYVPYQMYPEKHHILTIAYIAFVSTLIFILRTCSQLVNYLEVTEICQILYCDYYCVGINDVVHYLNKKRLRDRYPENVVSPGG

SEQ ID NO: 10990 - protein, 282 aa, Enterobacter cloacae
DFGEKKMRYTRTSTATDVTDTLRQYQADLLTGPCWMSVWPLIERLLSRENEMQSVWQNIARQALTWQQCYCLLEQIILAGRFSRPDIVSRLKEDYRQLEELNRTISKEAGELAQKILVRDAILNRNAFTLERTTHIVELMEMAEDNDGLYRYYLHETLDGLTCRYDGKYWPGLPGVLQVIAREHPEIGCLSESDRAIINGRGKMLPDYLRELFSSIENVRQGPWGLPKEFTLTDSSLATLATVTLDHTEVFSADTVKVRRSEFSKRGERGAWPFKPLKAVDM

SEQ ID NO: 10991 - protein, 579 aa, Enterobacter cloacae
VDHFLPVVDSNPLSTIRELLFLYEMEDRFSADKKRLRVATELLELLETDQVLRREAFEDIPAQLVTLLDRDLLVDPTRSPVEKRPRLICSLCVQLADITEASYITEALEMLEQELFAWPPLDEHHARDIYSLTNGVMSVLLTRGMTLTECYLLYINIFRNVSTEPNAFRAAFHSFRQKLVTPTRDVTVRMFITSEKLHTLLNTQGPTLQFNGCVFMPLDEARQRFSLSVDIPVCSMSDTSARNMAGQMLRESLDVIAYMVGKGDITVQKQFMIIRDEDETEVPRFDNEIEANADRLTDEEFARFMVAMNRLFTDTPDVSRKKISSAFRFFRNGIESQVQESRFTAYWSALESLTLGVAPGTPSHEQHVIGVVAPCMVLDYVVKQLFSLRKVLRFILREPGHPLRTPEIASLPLGQLYALLKDADRVRELQTDLQHFPYVMYRVRKLAGICASPEKMADKLGQHAEKVTRHLHRLYLLRNTIVHNAGTSPHIDLLTVNLEHYLRATISALFNIVVIHPTVSTAEEAFTRCQFTSESVFRELNPLHGITEKKVYTAIDNQLKNGTLSRSDARLIAWLNAHH

SEQ ID NO: 10992 - protein, 74 aa, Enterobacter cloacae
AQQDLLNILRTIFFFFIPDWEFSMYPNESAIWIIYPQKNMSYKVRGFIDFIDFIDFIDFIIDEIGTTPYWKHGK

SEQ ID NO: 10993 - protein, 81 aa, Enterobacter cloacae
TLLMPLKHQRHSLFNHRRRRRQSAYCCINPFCHYSFLTNGSAHRLTPFNVTSVRSKVDLRITGLNYVKETFWCPPNPDRRQ

SEQ ID NO: 10994 - protein, 172 aa, Enterobacter cloacae
ETCCTRAQQKHQILSSVKHHCYAGGKENLMKLFTIGFTQSSAEDFFTRLKESGARRILDVRLNNRSQLAGFAKQDDLKFFARTLCDIDYAHMPDLAPTREMFERYKLQKGDWDIYSSDFIDLITKRHIETLEKSQFADACLLCSEHKPHHCHRRLVAEYLADKWPDVTIMHL

SEQ ID NO: 10995 - protein, 67 aa, Enterobacter cloacae
RVLCAVLTWDCAAVDATTEIKLVLRLAGTPIDIAIAGHAIVAGAVLVTNNALEFERISTLVPEDWVN

SEQ ID NO: 10996 - protein, 69 aa, Enterobacter cloacae
IMFNVARNFPTDRINPFCGFYNIIKKFDPDGLMFGIGREYINNVTANPEHRPSQSFVCTGILQTCQLMN

SEQ ID NO: 10997 - protein, 163 aa, Enterobacter cloacae
RTFKLNRMTGLAVLCLSLMGCSAVPSENSAQYLRTEMQSPVSGATIITVTADSLMKQDNTHNAILYALRPMPGKAFTSELDRKFAAATMYIDLSPGEKSRTAEISGEINYYDHERYVNARLVGDSIRTIPIAPKTIPLTLNKPFSINLPQGIHYSVMLTDSQP

SEQ ID NO: 10998 - protein, 136 aa, Enterobacter cloacae
RKQSMSNPVISGNGIFSHVFIGAVDVQKSAEFYDATLGALGINNLGPFGNGWVLFGRDKPAFIIARPGNGEAPSSNGVTIGFAAATPAEVDAFHAAGLAAGGTDEGQPGPRGHLPGAYAAYLRDPAGNKICSYTFI

SEQ ID NO: 10999 - protein, 64 aa, Enterobacter cloacae
TLTTAGRTFSSIGARLGMASCPGTCEGSAALAGKDAERDNPTLNAKALNSWFFFFIDADSRILE

SEQ ID NO: 11000 - protein, 71 aa, Enterobacter cloacae
CYERERFYQISLSENMPGQRRANNLKSKLNVIKMMLFWWRGRVYCNPLLIRCCLQPDSIQVKVKDVRPQIL

SEQ ID NO: 11001 - protein, 77 aa, Enterobacter cloacae
VVPPYAHVKRIKIQPAASLFPQQVLMRCLMQLPLAITAQGEMELSLQLMGAKRQLAGVAAQTVLRREDIRRLHLFQR

SEQ ID NO: 11002 - protein, 77 aa, Enterobacter cloacae
TSEEEKMKQQLSTASDYNEACNLLRSGYVKHVRLGWNVGSDEFFRIASDWCDTGAKIKKEGDNFIISLKGFPIPPQH

SEQ ID NO: 11003 - protein, 94 aa, Enterobacter cloacae
IKHVFRKDVTIMVTAVLNVKIDEALKERLRHYAEDNNENLSVTTEKLLLLAFEAVEEAGVSEEDVDNQHTEEESVTPFTPKEIKALRKLLKKRK

SEQ ID NO: 11004 - protein, 71 aa, Enterobacter cloacae
TVTKQLIKVATGGAFKHVHFQLRQHIHRAKRANMCNQVSSLWDDYRLSLLITIALAYDVSQHFGRNTARIL

SEQ ID NO: 11005 - protein, 86 aa, Enterobacter cloacae
SIFHHFGLMPQTTFPTPVNVVFLHGERTGHSFIYFSRHYKTASGRTKTKHKSLILITLQVLYRMNQAKAMFQECNNEYIKPRGEQR

SEQ ID NO: 11006 - protein, 80 aa, Enterobacter cloacae
RFTTLRAEYRPHIVKIFILLAHKSSGGRHKIGIGAPRVDIQTAATGVAGVNAQLFGLAETLDVVEDALHALLVEFVVMTE

SEQ ID NO: 11007 - protein, 60 aa, Enterobacter cloacae
GNQNERFVFGFGTARSRFIVTGKVYEGVTGSLTVQEHNIDGRGERGLGHKPKVVEDTSRN

SEQ ID NO: 11008 - protein, 77 aa, Enterobacter cloacae
STLLHPEAFLRRHPDVSLVRNAIILMFVSRVGILSTQIESAILLRLTTHLVSNVSQAKRGISFQKTTNLLKEKLILI

SEQ ID NO: 11009 - protein, 69 aa, Enterobacter cloacae
CPEADSPRNVNPSTHFTRACIFTHSNVAFFMTDYVYVTFLATEGDLRHAEARHQETRGESYAKTLWMLQ

SEQ ID NO: 11010 - protein, 80 aa, Enterobacter cloacae
QITCTLHFSQRKATCVMLKRDTRRHAAKAMLKHSGCYSNTLTLHMYAEDIKLYWLRNVTTADFPGMGKNSIATPESGCIL

SEQ ID NO: 11011 - protein, 68 aa, Enterobacter cloacae
RKMAVRKRFIAGAKCPSCQAQDTLAMWRENNIDIVECVKCGHQMREADKEARDHVRKEEQVIGIFHPD

SEQ ID NO: 11012 - protein, 87 aa, Enterobacter cloacae
IFFQDRIIFLATEILFSISAILAIKKKNLTVNFPELRPITPLFVLRVVTLRNKYGKYFYVGSRIRFAVRRHSGQSDRCTKSTADADL

SEQ ID NO: 11013 - protein, 73 aa, Enterobacter cloacae
MKQSSLINTTPGLWASQAAASSSTVCASLMSLFLTPLLAKYPVNPSRVYLHKSIMIVDMAYPHSMRNDNSPPA

SEQ ID NO: 11014 - protein, 154 aa, Enterobacter cloacae
GKWSMKTLISLTALLGLASASAFAATAPECVKADNQQIEALFDKWNASLQTGDAHKVADNYLSDAVLLPTISNQVRLTDKERVDYFEDFLKKKPFGKIDSRTIRLGCNKAIDTGTYTFTFADKTSVTARYTFTYAWDGKAWKISSHHSSAMPEG

SEQ ID NO: 11015 - protein, 264 aa, Enterobacter cloacae
NVGLGTSAILNARSNETYPADGVLTVGQFGIGADWLPLTTDFKTIEKGGIYAGGGATGVNFFNPYAPVLVMCRYATSAMQALQADNTTLAFNVKDANGWRGWVKLYSEYNTIRASDGTLKAASPVIKVFSDGTYQTNDESEGCTVTRLATGQYLVEGCQGLNSDAAWGGIDGGFDIPTDRNKQPLIWLDYEVNAVGSVLVKTYHRTHPDAPAFARNELEGVGDGDPVDIPRDQFVSVRVEMPADSLYNQKIRAAELAMTADAGE

SEQ ID NO: 11016 - protein, 61 aa, Enterobacter cloacae
CLENSSSFAAPYYWDDSQLITRAQKLKLFVSDIATIPENNKIQPLRPSFSQISIKAINGVR

SEQ ID NO: 11017 - protein, 112 aa, Enterobacter cloacae
PDQQRGRSAGKVSTPGVKFLMSLALRMGRTLSELRHNMTASELLMWIEYNRQSPVGDIRGDIQAAQIVSAIYGSQGAKVPLDDAILRWGGEEQSEPNDPFAGLEAALTAATQ

SEQ ID NO: 11018 - protein, 116 aa, Enterobacter cloacae
CWGTKMEILLVSIVIGLIPALIAQSKGRSFFAWWVYGALLFIIAFVHSLVIKKDVAAEEKDLIENDGMKKCPFCAELIKSEAIKCKHCGSDLAVDSPPVKTDEEYLEEARQKVWKQ

SEQ ID NO: 11019 - protein, 73 aa, Enterobacter cloacae
GGKSYCGSCCLTVVKRVLFIDVLCDTDKQPVFSVDEEEQVREIYGPVHSRLLKQALDLINNADEAREKSQPPA

SEQ ID NO: 11020 - protein, 148 aa, Enterobacter cloacae
QEDLLKGMMRDVWGLTVVEFIAIKRNLENISDTWSDLWAMLYLSQAKPGQLLGAKFDDVSHDILVLSATKGLRERCIALKPGVKRILHSRREKYPEDVFLFQSHSHRTKTTPRPVTLVAFNAALKRASIGVTAKTVSSKSAYYLTPLR

SEQ ID NO: 11021 - protein, 130 aa, Enterobacter cloacae
GFRSGESREHGNGRPLTEPLFFQEDWMAEYGVQTWDASGKVNNYGVKPVSVCGYLQLAQNQKTGSYTVALPPGCRLTYFQSMNGDQFGTSRRKITISGGTATVSAAGDTDYSAGTEPAAAAYLIFQIERA

SEQ ID NO: 11022 - protein, 223 aa, Enterobacter cloacae
MAEYGVLLTTTSGEVWVTANSSPIALQARKTAALQGTSGFNTKVTHTFPAGQPVVAFVHCTVEVEITQTISGNTITIDFLRPNATGTAYVYFFSIFPQTKPDYGLAVWDASGTLILTNETRTLSDVVTLGTAGVDASSGYNINTTLAGKWACMPAMLGLITGVVSAGGQPQPYSAIYKSMAKLEGSNTRIFARPQTTPGGNLQNVAYSNLRNVIMAINCANYD

SEQ ID NO: 11023 - protein, 448 aa, Enterobacter cloacae
APTRSPAPPATNPFNFEQTPLRRGFLLPGENMLYNTGTIAINGNTATGTGTNFTAAGSLIRNGCTVIAMTSPVQVFQITTIGSATSLTVTPAANPAVPAGTRFAILLSDSLSVDGLAQDIAETFTMYQRYMSGFADVMNGTSDVTITINGTVVTVPGQKSLAKKGANSDITSLSGLKTALSIGQGGTGATNAADARTNLGLDKTVNTEGNQSISGEKNFTGPLKITAAYPQITLWSTAQPNGTYGRVVTFGSEGNKTFIAARQWEGGNNTCVTYLPTFKDGYFTFWTTSNTTVTSDGTIKQASPIARIVKSQEENRRTDVENDGFTWCGCGTVNAEAEGVSISRLDTGVYELTGSAGLASDGWQLLPPMDPGGMGEMGVVEAEQTESGGLIIRLYKQKYMLSDGGEIVKTKGEPMDVPVSSWIDVRLDMPTDSVFKRSQQRLQSDEES

SEQ ID NO: 11024 - protein, 68 aa, Enterobacter cloacae
KSRHNSDNKGWVKIQCKSRVKFGCKSTDIDNLSRNQDIAVGLQVILKPRARPTPTWTSMPERTLDFEF

SEQ ID NO: 11025 - protein, 77 aa, Enterobacter cloacae
ATQVRVAVEPQLGAPLRSRGMAASLDQRGADTPARMCPSHRELVQICGLPLEGVGPELGILGRQGATADDAVAATRD

SEQ ID NO: 11026 - protein, 107 aa, Enterobacter cloacae
LANAVSRWVLRFNHLALQILANGVPGQAASSGYFPNRRTIAKMPASNCAQYRHVYHSLISPAISRRETVSYVGQISTQIFTLSWGADKILDYFRSSSCIRMKIAFEP

SEQ ID NO: 11027 - protein, 386 aa, Enterobacter cloacae
NCAAGLASRVRVSLQMPFHSEFLEKIKMQPHDTFTGSYQPGDVEFLLKPVVIEMTPVEQKEELIQSGKKHYSDMLSQEPAPTQWHLDLFHRALDRGAERLAKEVTQLAIALAERFGDEPIVLASLVRAGVPLGVMLHQALRDMGKTSWHYGISIIRDRGIDGAALDVIEERHGTSGIVFVDGWTGKGAITGELVRALKDRPGYPEQPRLVVLADPCGCSWLAASDDDWLIPFGIMGAPVSGLISRSVWSSEGLHGCMVCEHLSEFECSRMLVDTVAHFRKKLTPSSLATLSWNMESARVLWQTSRDVIAFLADEFKVDSVNRIKPGIAEATRAVLRRVPDHVFVRSIDDPDVALLVGLAREKGIVVTEMGGTLGQYRAVTIIKKVL

SEQ ID NO: 11028 - protein, 554 aa, Enterobacter cloacae
LRRKQRERLMSQNALLEEKIIRLVLSELGHPVEGERLLLLSQDPSLTEEIMRLKERIESLAQGLSARVSEGDNDAEIAASSASSLSDQQQTVVSVADNPGIDATDTSALQPLPENEPHPPFWKLMPYYEFDKPAQREDENLSSLVLKPGQIPTGQQRASLAVPPAVPPRAKITIPNARAGERFSSPVAIVLGEGQQATVRDVVFPRNIGLSFDKEQELLTGTPTESGDIELSVIWSCTSHDECETKQLFIINPDPRSLWKVVEPPADAPYPKSHLDAAGLVRGDIRIAAASRRGRSHEHAGSFRDDDFYINHCQETGWSVMLVADGAGSAVNSREGSRIAVKTAGDYLLNQLSGVKGVHLKQHITAWEGSDQQATINAMLHHFKQAATLAVNSIQNEAICAEQPVKSYSTTLLATVALRTDNELFAAAFWLGDGAIGAYSPSGKVRILGNPDSGEYAGQTRFLDQSIIADPSFSGRISVGKWNDVSHLILMTDGVSDPLFETDNGLRSDEKWTRLVDELNPVLTDASIAPERLGDWLNFFSTGNHDDRTIAVLW

SEQ ID NO: 11029 - protein, 75 aa, Enterobacter cloacae
FEKRGVCPELLPGICLSRGEPFFMFFCFKLPVCILFGPGRPLLLVPVLSKGILTLHINQLLLPPAKIFGVALSFS

SEQ ID NO: 11030 - protein, 246 aa, Enterobacter cloacae
RLHLFVKVNDLCVAVFLDRDRSISAKLTFDHLHPSERVAALRIDLPDIEYEISQVQLGRRKTTYSECIESLIIDETSSREWLYHPLMHELESEPLQEYRGREPSEEGPLLQRLADCKMKLPDILPGSHNALVRLQQDTIVCLCRLTVRAYDIAQTDEFPLFLRYFRLHCLENSEHVSYERLICWQEMISKTQEGQSLTQNELEYLHEIVRIALYNHRLNNVSISDVKNHDTGKESSRVEPQNYSLL

SEQ ID NO: 11031 - protein, 86 aa, Enterobacter cloacae
TRSFRSGLSSSAIRVFTFFAAASVNSSGNATSSLILCSHEYCDCYWAKITQFFLSLSNTLVIHSSILLQGLFSFLFRQGTGKNGGV

SEQ ID NO: 11032 - protein, 68 aa, Enterobacter cloacae
RGIVVEHLLCSLSGALGGRAEGREVTEGLRHLFDAHRVHPFNRYSQRRELVYLPFGITAAPGEYQIGL

SEQ ID NO: 11033 - protein, 323 aa, Enterobacter cloacae
ICISRGIMKIPKKKTGHFILSAQTKRENAMDNHISSRALLHRRDVIKNNPRFGEAITEHYRINDVIYKKQPLFYKTMLQESRFNIILSMCCFVFGNQAESVSEIKALCTRYNIASPNSVIAIITILKTTGRIKTWRCSEDRRKTKIAPTEKGLDELKRYMSGAFTPVSILYPAFNINVNLLDNDILRHNFFRRAAEYLFRGLTFRKVLPEVGLFIDKDGGRMIMLYLYLQAIKNKTAHGAIIAYSASTLAKEFFVSRIHVNRIIKSAQEAGYLKDRGDGRMSIYPAFIELVENYAGLYFAYVTHYINVVPKERRHAVNMTPTL

SEQ ID NO: 11034 - protein, 169 aa, Enterobacter cloacae
KEEANMRIILMLCCFLVQSLSWAGELPKPVGKPILTINGNIENTNENGNAVFDIASLEKLGMVSFQTTSPWYNGRTKFEGIPMRKLMEYVGAKGSVLNVIALNDYTTVIPLSDFQKYNAILALKVNGEYMRIRDKGPSFIVYPYDSLPELNNQIYYSRSAWQVSKMKIE

SEQ ID NO: 11035 - protein, 91 aa, Enterobacter cloacae
LNRFSSMNLSRQEQRTLHVLAKGGRIVHVRDTSGRVTAVECYSREGLLLADCTLAVFKKLKTKKLIKSVNGQPYRINTTGLNNVRAQPDNR

SEQ ID NO: 11036 - protein, 111 aa, Enterobacter cloacae
SSISSSTKIGNTRSFKVSVVSSNMARSAGDLRRRRGRAIKSVMVCLMFVEQRGIVYLKAGSGVLLKLSFRFSKSTNIRCMYLVYIINLILMFSVACNIGEASILVWDYKYK

SEQ ID NO: 11037 - protein, 255 aa, Enterobacter cloacae
RKANNIPRCPAGFAAFCHNILRDAEGGRVKGKGLFILIVIAGIVTVGYRWLPSQYNPFVPLTLDDPPGKITQFKLRRLTPQACESLLTQANQRRLIRTQAVADSAGECPLSNVVRVRDFGPVSLNSSFLASCPLALSSALFVSQQARPLTKTWTGSELARIEHLGSFACRNIYSRPDARRSEHATADALDISAFRLANGQRVTVLNGWKAEKTQPWLQALLSASCGYYGNGLGPDYNAAHANHFHLGMRGYGLCR

SEQ ID NO: 11038 - protein, 116 aa, Enterobacter cloacae
LSSAGANIFLLTGCPGPGDRMVDRESTTAFIKDNQVCVVSPLEPQERITAIQINSDNSDSLHNIFDDKPVYVPKGECLPVFGFKFTPGERYNFAYDVQSAKSGAYLVTAEFSYPKE

SEQ ID NO: 11039 - protein, 64 aa, Enterobacter cloacae
RPTLTMVKERLMFRWGIIFLVIALIAAALGFGGLAGTAAWAAKIVFVVGIILFLVSLFTGRRRP

SEQ ID NO: 11040 - protein, 70 aa, Enterobacter cloacae
RYRRDVKRVTLEAIPPKNTDKHMWIGFNLSQDLPNGIKNISVAHTAFRELDFKVLNTRRVMLEVKRADGS

SEQ ID NO: 11041 - protein, 62 aa, Enterobacter cloacae
MKHLGKHLLMTFSLMATLFTPASWSADECLLTLTPVLSDRQFNYVGDTVTLESNLMWEVLTK

SEQ ID NO: 11042 - protein, 68 aa, Enterobacter cloacae
VNSHHAKILRHLSCLVGKPDIHRISRNLLVKYSGIGELQSDIPFFYFVMFLHFSEFSFLPTEYILSTL

SEQ ID NO: 11043 - protein, 177 aa, Enterobacter cloacae
KAAIMSTRRFSTTALAVVLALTFATAPAMANPGNGNGGGHGNGGGQGNSGNHGNGNSGNHGNKHNNGQDNPGKSDKSFKNSKDVGNDVDARVSFDHARHLALNYGLTGYDSLPPGIAKNLARGKPLPPGIAKKTVPADMLGQLPSYPGYEWRVVGYDLVLIALSTAIVTSVINGVFK

SEQ ID NO: 11044 - protein, 84 aa, Enterobacter cloacae
AVIQGQMAGMIEAYASIHIITDIFAVFKALIRFPRVILTVIVLITMVTRVPVTMIAAITLSATVSVTTAIPVTRISHGRSRCKR

SEQ ID NO: 11045 - protein, 68 aa, Enterobacter cloacae
GSSDFVRIMPLAKTKSIHRFRRHARYAPCRFKKLILLMQSLLLILIIYLFLFISGNFYNETSVEKFHE

SEQ ID NO: 11046 - protein, 74 aa, Enterobacter cloacae
LKSRVKKRTIKAPRKWGLFNTLASSVSFVRYLYLMDNSQNRLDIAFELCIYIGPRMGQIRRYHRNVNYWSYSLL

SEQ ID NO: 11047 - protein, 64 aa, Enterobacter cloacae; identical to SEQ ID NO: 10478

SEQ ID NO: 11048 - protein, 65 aa, Enterobacter cloacae
GRSSVGRAPVSKTGCREFESLRPCHIESFASAKDFFLPAKQLNTFLKNKQPAFPQAFALIQYAGF

SEQ ID NO: 11049 - protein, 63 aa, Enterobacter cloacae
LHHLLLRTQENFRVNLKRCTAKFCSLKIWIKLKIETTHSSCVFESLKFSQSEVKHLRVVRLSD

SEQ ID NO: 11050 - protein, 120 aa, Enterobacter cloacae
VADPLYKRYAVTPRRCSHCLYVHGFRFFFTPLAGVLFAFPSRYWFTIGQSGVFSLGGWSPHIQTGYHVSRPTLRVHSKCVFVYGTITLYRRTFQTVPLTHKLIQTPGCSPFARRYWGNLG

SEQ ID NO: 11051 - protein, 74 aa, Enterobacter cloacae
LPFPVVIPLHQAVSQTLLTRPPLVSKAASCFLLPFDLHVLGLPPAFNLSHDQTLQFKSLMLNELNFVMNYVFTR

SEQ ID NO: 11052 - protein, 72 aa, Enterobacter cloacae
GGQGSASMKNKDEQTGLVGLAIGAAVIGLVSSQKIINRESIVDELVRLGRQKGDGVEDEVFLKAAELVRKGV

SEQ ID NO: 11053 - protein, 141 aa, Enterobacter cloacae
AMADIRHAQCHCGAVKFTVELTDGLNTARRCSCSFCRMRGAVVVSAPLTGIKVTQGADTLTEYRFNTGTARHFFCSICGIYTFHQRRSNPNEYGVNVACLENVTPFDFPEVAVMDGVNHPMDGDSGVFGYLSFRKEQTKQR

SEQ ID NO: 11054 - protein, 64 aa, Enterobacter cloacae
QHRRIGLTNNESLSGYSKAVHFAGFSITPQKPICLKVHYSSSTTITINAARNRPFYRLLRRLLA

SEQ ID NO: 11055 - protein, 452 aa, Enterobacter cloacae
RSLQDQIVAKTLLRSGNLDDFQAVGGGGQAVFESALQIREALRLRKQQAIVDCLAIPQVYDGGDRVDWYSPVEGTVSSWKAADEDDRYRALRYLENTLASVESLSKKCLQSPKTAQQLFGSLLSKAFQFPGENFVFLVDGKPVICFWGFVNLNENAREDVLDCLRESLVPEPEPVVINEPEPEQEQEPAPVVTFEHADAPLITPVASVRITEDELYTPEPVRMNAAPPEPAPVAMQKKRRSPLWLLPVAAVIIAAIATPLLWPKQAPTAAPVATPAPVPVAIAPAPVKTVEPLELKLPLHQAEVVEPKVKTPAPAAEPVVITAIPKDAMVMEANQVKAGLTRFLNGTWRAFLDVQDPLTGKPPSLRYQIQNNKGFARVVHGDNIVCRVDVFSGLHSKGELLIKTRGNARCTDGSRYPMPEVTCKAGASDVAECTARYDANTIVPLTFKKAGV

SEQ ID NO: 11056 - protein, 748 aa, Enterobacter cloacae
TEYSGRSPTQRQPLLDRQRERIPQMTATTATTQALIGWINETRQHAPMLDNEADALLARLNALSAREEALDRALVSQGSIGLYGHSQAAKAHLLAALCGSGDERLNVTPGQRTFDYFSHINPGHAPTNMAVRFSRASREVADDAFPLRLRLVTEAELVQLFIARTTLDPQIRAVDKSVIEARLEKWRALRQPQSVPGMTAREVATIARFWQSVVPGAKQHIDDALWHQFALLVPSLDLSTRASVWSLLWGEQQELTQQWLKFAQVLHQTSHASALAAPLSLLVDSFGLPCEGFLTHGAFTVPEAQETLLHPIKNGELLNAISLPVDVLASLTREVVLPVENCVLDNVDVIDIPAIPEENTPLMMQAKCLWLLEHYRQHIQPDVLVICNATAHHQQTAKTARLLQNWVKETQPVEESALPGLVWAITPHDARFTTKQNLDEAVQQLLGQPGLRWGTLQALDSHSMQRVIEWLSQATLPAQRQKRLRALKRLLQESLSTLMRPYVAPLTQEPGAGRAMAEKMVRTLQGSAARHGELLEGLLPPLNAFETLLTVHQPREEQVNGLFNDVIDLFAEETQENPGALQTKDKARLAHNVWVNHLRQWSRNDAAAARLGLDAEVLQQIADVLIVTSYRLDLPLQLQRIAEKDKSSAAQLHAATGNFISWLGYELTPVSERPASRIRKGEPIFVTPVVSSASPRLTRLGEQPVHAATAYVYDWLVALYTRAIENVDYQCPYDVQPAARKALSALLS

SEQ ID NO: 11057 - protein, 1002 aa, Enterobacter cloacae
RSRKQVSDPMLVNLCDYKQSVTLIANSGVQFLDFGLTPQDTSSNGRFVRKTANGPLLRLDFDLVNGRYTLPATDGGQPEVVKPESTIPLHNSLNVLDGVWLPLPFLRFNPPRTFVDGPDNWARVQVRKLSTPDAAGNTHRVTVALDSQIAEHATSALSPVENDILNGTRFALAWRDSEVESFLDQTWIDGWLREAFTQFADGVEKRSERELHQAMRSFEYQAHWLNLLSMLGEQLTVPEVKFVTHTLSTPAISVDLILDVGNTHTCGVIIEDHGDANDGLRQTAELQVRSLSEPQFLNEPLFTSRLEFSEARFGKQHFSVESGREDAFVWPSIVRVGDEARKLAMQRLGTEGNSGISSPRRYLWDETPVVQDWRFSQMNSKTQREPLATAFPLMNLMNDDGEPLFTLPQDERLPVFSPQYSRSTLMTHMLCELLAQALGQINSVATRLRLGFPASPRQLRTLILTLPSAMPKQEREIFRRRMFEAIAIVWKAMGWHPQDEDFASRKQQEKSVVPVPEIQMEWDEASCGQLVWLYNEAISHFGGQTEAFFASLARPDRAPEPGVLPGRALRVASIDIGGGTTDMAITHYQLDDGSGNNVKITPQLLFREGFKVAGDDTLLDVIQRYVLPALQTQLQKSGIADASQLMASLFGDSGRIDTQAVLRQQTALQLFMPIGHAILAAWESSDVDDPLAGLHATFGDLLTQKPTRNVMNYLQQAIDHALPAGSEHFDLFSVPLHVSFREMRDAMLAGQFTLAAPLHAVCEAISHYSCDILLITGRPGCLPGVQALIRHLQPVPVNRIVWLDKYQVHEWYPFSQQGRIGNPKSTAAVGAMLCSLALDLRLPRFNFKAADIGAYSTVRYLGVLDNTINTLRDENVWYHDIDLDKPGAKLDARLHFPLRGNVTLGFRQLANARWPATPLYTLSINSAELAKAIAGDGVLNVRLKLRGGTKQEGPESFELSDAWLQDGTPVPPDALTFKLNTLADRRHSGSHYWIDSGSVYLK

SEQ ID NO: 11058 - protein, 656 aa, Enterobacter cloacae
NSTFSCLIVFINHLFKFSQLEVYSSFMPVTWLTFLHLADSLCFAAVDYEGEPMWAANKEKSNPLSSRQEVVASLNALLQALDTQFPANRSRFPLGDTCAHYTADIAQMEGLSRALWGLFPLMASGESTPFSEKYLTAIKLGTDPQSSGYWGETGPYDQRLVEMAAYGLGLALMGETLTARFTGREVMNLHAWLNQITEAQMPDSNWNYFAIMVQLGFKRAGLPYDQDAIDHRFALMDAYYLGDGWYSDGPGRPKDYYISMAFHFYGLIYATLSNDEARANVLRERSRLFAEDFIYWSAADGASVPFGRSLTYRFAMVAFWSAVAFSQLDVFTPGIVKGIVLRHLRWWQQQSIVDRDGILTLGFAYPNLAMCEDYNSPGSPYWALKTYLILALPEAHPFWQAEEQPLPALDEKHVIPHAQQILMHSKDSQHVVMLTAGQLELNNYVNTEAKYTKFAYSSRFGFTLERGRFGLKHAACDSMLLLADGDDYFRGRRECEEVRVDENYIFSRWSPWRDVQIATWQIPFGEWHLRLHRINSTRTLQTVEGGFAVMKTAHQVRERGCYLLAENGSSVIVDLSPIIQRQPDSIVTPPNSSIMFAECASIPLLKADLPQGESWLCCAVLAGGRQLAAATPQLNITHSRVVISEPGSERKLSFTL

SEQ ID NO: 11059 - protein, 411 aa, Enterobacter cloacae
QKRQHDKLRRQRRNRNMLSRIKEERLPVIAAPVDSRAFSDELNSARSHVLDLISRHLTEFGDKFPAETCQNGFYPLTDNVEWTTSFWTGQLWLAWEMSGEEKFRAMAEKHVRSFGLRIAGRNDTNTHDLGFLYTLSCVAAWRLTGNREARGFSLLAAEALLERFHEKAKIIQAWGDLSDPEQAGRMIIDCNMNLPLLYWATEQTGDPRFADAAKAHVMQAATYLIRDDASTFHTYYMDVATGAPRYGNTQQGYADDSCWSRGQAWGIYGFLLSYIYTGDETMIALSKRLANYFLNRLPEDYVCHWDLALVGTDALRDSSSAAIAVCGLLELVKHLPVTDPDRERYLEWAKGIMSTLTKHYLMGKEEKGNGLLKHSVYHLASNKGVDECASWGDYFYVEALVRFTQSWKLYW

SEQ ID NO: 11060 - protein, 188 aa, Enterobacter cloacae
RLRLLVHVAQRNSMKIACLGWGSLIWKSGALPVAGEWQTDGPSLPVEFCRVSDGGELATAICMNAPAVPVLWAWLEATTLSVACRALREREAIPEDRCDGIGSLLITGRDTGILTTWAREKGIEAIIWTGLPPRSASQEGRVPAVDEAIAYLDGLSGETRSHARDYICRVPAQLDTPYRRAIKEVLGW

SEQ ID NO: 11061 - protein, 64 aa, Enterobacter cloacae
GRLPWRHHRQLTHLSRDIPLAIPGDLNKKLGKYARFRLDGNISAQILDLLTRKEQPNAAVFTFC

SEQ ID NO: 11062 - protein, 82 aa, Enterobacter cloacae
SCLSSALATVSRWLRWAGDISIFQYHNFAPGQESGKNQDNDKTEVNNQTGIATLMQPLQKRLFYNKGIVLHTHSLIVAHHPI

SEQ ID NO: 11063 - protein, 66 aa, Enterobacter cloacae
SGETRGRQALRHGKRVSGGWASPSERRSSCKRDGYQALHESSGVAPAGTAPPGKQEPYRVFERIAA

SEQ ID NO: 11064 - protein, 60 aa, Enterobacter cloacae
RLPGLHSPQQYLNVAKLFILCTLVRPAFSCLKPSFSSRNLYLPLTIETNPIDSKSWHAYY

SEQ ID NO: 11065 - protein, 71 aa, Enterobacter cloacae
KLCDGIKFGGEMRSDALTPTLSHGEREKGTNRRPGKAKPPPGKGLEARIYRRRQHLQQPFAVFPAQARVGD

SEQ ID NO: 11066 - protein, 93 aa, Enterobacter cloacae
TTSRSGWAKTTGYKMARVKTSLKLFGGDTVVVRCSERCRIHLISSKGQKQSQADILTVQDDKAWLTVPYTGTWDVLIDSHSQSLEHSVSYVAA

SEQ ID NO: 11067 - protein, 127 aa, Enterobacter cloacae
IMKLTNRLKKKLLVLDGIDNDFIEYGKEITCPECEGVIVYSIVNSYEFDTLTEEVKCFLVKKMRGVKLDSEHKKYSYDESQLDVSKNTCSKCLKEFSAILTYKEVQPARYRVYLVGLFEGDLKQIKL

SEQ ID NO: 11068 - protein, 60 aa, Enterobacter cloacae
VQKRQKNDNYNRWQKRNCISSYIKQFKKGYEEKDDYGLHCHIDVYKPLEEVDATIPSHVE

SEQ ID NO: 11069 - protein, 75 aa, Enterobacter cloacae
IPCIFYLVLPFIIIFMPEAYNGLSLLNINLITITCIFILFISFCWLAPSRIVVHTYLLAKREVNDAIQIEKRITR

SEQ ID NO: 11070 - protein, 61 aa, Enterobacter cloacae
KPTHGGYRPCAAYGEKFVEDTPWGVVAQSVGNSCLIEVRNTALFLQKPRNAGDEKLALPLH

SEQ ID NO: 11071 - protein, 111 aa, Enterobacter cloacae
GLPMIENLICIKEKDLLQWACGESNILVSVPFLSYALVDLTRQLVFVLSEPKPLSTVLTIFNVQGEKLFWSAPPEGATFYYLTFNLSKEVIVVCSYPAKKMAGMIGFIPGI

SEQ ID NO: 11072 - protein, 142 aa, Enterobacter cloacae
LMKPLYFLLFALSPLAAAENIYAPGQAALKFNQWYIAQLDQNKPPVLNPDIMNEYVASGTIAAIKEMYSGDSNDKDMPDADMFIKAQDWDDDWNQITVLHSDFDAVCTNVYVAFGKKQDHVIADCLVEEQGKWKVRSATLIK

SEQ ID NO: 11073 - protein, 114 aa, Enterobacter cloacae
VGVITAKSHAQPSSTGYCARYVTEAIRAGGRLKIPNTRLAKDMGRTLVNAGFHLVYDQPHAGDVAVIQNIVGHDSGHVCIYDGQQWISDFVQRTMYPGQAYRNIQPHYELFRHD

SEQ ID NO: 11074 - protein, 77 aa, Enterobacter cloacae
MRRFTADITSGGQSHRFAVILMRIVIINQLNVEYFFPSKPYIHEMCGYSFHNIYKGFNIYTQVPVDLVRIFLNRFTP

SEQ ID NO: 11075 - protein, 224 aa, Enterobacter cloacae
NYRIHIDGMPHMTGRVDYHLEKYLLTEAGEPERLTRQWAEVMRECHDQKSGAEERLRLALLNVDYVTSFELPFRLLLTRAPQLIDGIRNEFQLSQKNVLFNGKRFGCVYSLKQDLKGIPDEFTYHLNTRIQRIDASGGSEVPYRQIAQQVKAPRERLQLALEQGLAVTALDGLFWFGLQRIAADVQRLRKTGMRIVTSDTEVFDTLTGTTRRIPVYRLEDAAAT

SEQ ID NO: 11076 - protein, 82 aa, Enterobacter cloacae
CEVIMSDVVLLVPNDWVSEKVLIAVTGLKPGTILRARKECWMVGREYVHVSPDGNPKPSSECMYNRKAVDAWVASMKNKQPG

SEQ ID NO: 11077 - protein, 61 aa, Enterobacter cloacae
ILSNRAGECLSGANILNSMNKIWQADHYFFWRVVNEKKTSFYLRGYSADGGDCRSGAGSHQ

SEQ ID NO: 11078 - protein, 333 aa, Enterobacter cloacae
AANLRSADLSGGAVRRLLIALLLLCSGGSWAACTVSTVNASFGSVTSFALSGTGEVETTGTLVVTCDTVLNLLTNDSVTLNYTSASVFANSRATMKRTDNAAITDVIPTRLCGASGCGGNSEIQISKAYTWSGNTLLGLLGSRRYNIPLYFRTVMGQNVTAGPYQVLLTFSINYNVCAVGAVGACLTPQTGTATTSILLNMTVTNDCSTMTTPDVNFNSAPLVQNFPTVSQSVAVTCTKGSTYTIGINNGANALNNVRRMVSGSNFMSYDIYKEATSNRWGSSGSERWASASSSQVSTDGLLRTYNYTAKVLTSQATPPAGTYTDTLIVDVAF

SEQ ID NO: 11079 - protein, 61 aa, Enterobacter cloacae
KFSATRCSSTTANCLPFHQSSGISEGWLAKLTFPFDTKETLFYKSVTRVLTLFAFLPFTPL

SEQ ID NO: 11080 - protein, 77 aa, Enterobacter cloacae
ITYRVDFVDDPHLLTSSDQLRVENKCTLVALSSAVFAQLNIDLMLFSKPGHFRLIPQDADRRLNEVYHSVGTGLSFR

SEQ ID NO: 11081 - protein, 464 aa, Enterobacter cloacae
SRRRKMKWMNAVVYAALLAMAGPAFSEGAPAESPRDYAYGLSLDTSASSPWYRVMLPLAIYQQSTSPDLRDVRVFNQSGEPVPFSLVTTTRPQPAPTTTALRLFALNASPGGEEDSGDKIMLRARNGVEIVLEGQHAAAAGQHYLLTLPENATEVPLSQLQLFWDTPQGSWQGTASVYYSEDLKNWYTLREEMPLLDVMSGRERLKLDRIDTDLVLSPEANRYLLLVLNTGRSALTLTGVNAINAPAPPESEHISLAGEGERLSESEAVWRWKHPQPLSAIAFMLNGDGVLPAEIAWRGADKDRWHTLKKEVIYQLGGKTAEPVPLPGGLVEAVKIKTLNARLPENLPGVIGQRVRYDLVFNAQGKGPYLLAWGNGAAKPASVETDMLIPTELRKTYDLAALPMADTLEPVPLGGEARLTATSAAEQESRMKTLMVWGVLIAGVMVLAGMAWRIWREVKKDGAA

SEQ ID NO: 11082 - protein, 878 aa, Enterobacter cloacae
RIVYGEGGNMDELYILGCLFLVFALVVAPVLAVIGFNRSTAARQEIARLRQRIEALEQRSVAEKAPEQVQTAAPVKTPAPVSEAANAPVDPWRPEPPVTEAEPVPVPAAKRPSAFGGILSSLTRWFMQGNPLAKLGIVLLFLGLSFLLRYTVEHSLFPLELRLAATALFAMVLLAVGWRLRHRQRIYALILQGGATGVLYLTVFGAFRLWQMLPMTLAFVLLVVICAASVGLAVLQKALSLAMLASLGGYLAPLLLSTGGGSFVALFSFYLLLSIGILVISIWQHWRELNLLGLLFTFGVGGVWGLSDYQPEDYVICQLFLIANTLIFGVFSVALSLRAQEKGKQIIDGVLLFAPPLIGFGMQYGMTSHWTYGPALSALGYGAFYLSLAFLALRRYPSIGRPLVMAALAIGGGFATLAIPLALSARWTAMAWALEGLGILWLGVQQQQRRMSYSGTALLVLALGSAIWAQMDGVTSLSLLLIFAVLSLCWLAAAWLWQKIALPGSWALLAGGLLFWLVALLGASQLFLKQELSLLAGVLALTAASTWGWRQAAARLAWWELDASKWLLWPVMLLMVLYQVSHQQILAAGWANLAWAIALPAALMLLRRDEDKLLPRISMGLHLSLLWMILLALAAELYWFARSLPWGMAAWGSGIAMAVGGGVIMALSAAVRRRGWPFRVWPALYACLAAIPVVVALVVLLVVTNFQDGVVYRKTWLPLVNPLEEGAAFALLGLVVFYRAVDRYYPASLAQSRPWPAVVLMALGFWWLNGALLRALAWYGEVAWNMESLWHSRLIQTTFALFWMFCALVVMIRATRQASRHQWLGGAALLGVVMLKLMLVDSAGGGGLARAVAFIGVAILVLIVGYFSPLPPKAGEEK

SEQ ID NO: 11083 - protein, 72 aa, Enterobacter cloacae
TDLMLYSGPHSGGYLWLSAVVFTGGRDGIARLAFLEFTASFLVAVGRQKYDTSAGKRELGTASLRPAPDADA

SEQ ID NO: 11084 - protein, 67 aa, Enterobacter cloacae
CNLRRIELHLCILIQRDKMCGGCLRLSVLSIVEGQKVESPGKFSFTRGYSLNSNKLRVASYSFFDKE

SEQ ID NO: 11085 - protein, 260 aa, Enterobacter cloacae
SIKRTSARIRGGRLNDPFPSPAGRGNCFKGVTMKRSDINEILGHTRQFFSMHDVHLPPFASFPPTKWQQLDQAAWQEVFDLRLGWDVTAFGGNNFAAQGLTLFTLRNGSPNGVPYEKCYAEKILHVRDGQVTPMHFHWRKREDIINRGGGNLIIELWNAGAHEETENTDVTVTVDGCRQTHAPGSQLRLTPGESICLTPGLYHSFWGERGFGDVLVGEVSSVNDDEHDNHFLQPIDRYNTIEEDEPAVLVLCNEYNLFRI

SEQ ID NO: 11086 - protein, 116 aa, Enterobacter cloacae
GQFTCESGLMKRYSTALLLGLLTLTSQLAHADVIDDAIGNIQQAINDAYNPSSSRNDDDDDRYDRSRQIDSRQYDDRRRQLEDRRRRLDERQRQLDDDRRRLEEDERRLEDDYDRG

SEQ ID NO: 11087 - protein, 79 aa, Enterobacter cloacae
KSLPTSMTLKVESIAIFCKKCWTSANENDYYCSAFRKTSYGNLKARHCSHCFQYYFSQLLAGFFFVMVRLSNLRKRTEP

SEQ ID NO: 11088 - protein, 72 aa, Enterobacter cloacae
LDAVDAQPVVAHINHGANQRAGHAAVMPLCANAYTEIGNVAAAWSLGDINGEVAYHDIINAGNQLFNARLFA

SEQ ID NO: 11089 - protein, 78 aa, Enterobacter cloacae
RHRQALCPAQRRVCGCVLYGANEVVCCRVAASPYPAYVRVVVGPVSAAPPGNKINTPPLNHPPNAGPTRQTARHPVRP

SEQ ID NO: 11090 - protein, 64 aa, Enterobacter cloacae
GCRQQRRQENKGGQFHESGLRQTESPDSVPVVAQKSRIKFYIRNYKLIRWDDLLMSRFESVIYD

SEQ ID NO: 11091 - protein, 94 aa, Enterobacter cloacae
LNRPPGMSTVKMENVIRKNKRAPFPVPWGQCLNLQSSHLSPGKNPDAVFTECMRLTGQLVCNNFLPGLLRVNPVIVYLTAPWPAGHLCIKAWQQ

SEQ ID NO: 11092 - protein, 126 aa, Enterobacter cloacae
ENSTLNRGKMKMMNTVLKATLITALISGPVLAVDGTGKVQLSDLHFASAANGLQQIEGTGTNVSGGPVKTVIVKFNLLQNGAVIGNTAAMAENLEPGQQWKLQAPYDSITNKPDSFKVTELTVFNN

SEQ ID NO: 11093 - protein, 246 aa, Enterobacter cloacae
REALDMSDGKTKGGTTASRAGALQSSVNILLHTHYAIRLWEGRKRDAPDETGVKKKRPEIISMPQAIARAGNASRDSAADNPYADMALVRLEEALQRATLKINENVSSLDAILSAVPKGVTLSEVESADPLNVSVFSRSPLGYRCVWLLVGYDQLAMKAFQAFHYGLISRSQRDAILDNGGHAVRQVYGVIQPYRTLAVTRRDIAEKTTQGLVAIERNGEPDPDVLSGKKRSSFSPPLKNTIAEEE

SEQ ID NO: 11094 - protein, 182 aa, Enterobacter cloacae
PPTGNHSRQGRWFLRRTYFYLHGENIMSANNTSASAKSEYFNLTIKGIGYLSNIRQVNHQNGSFLSCVINALSGPTDNPAYVRFDISVAGKEATSLIARCQKAVDEDKKVLLGFNLSNPSTDIFTLNKGDHAGEQRVSLKARLIKVDWIKIGQEMVYKTEKSDSVPPQNGSVAQQNYAENSF

SEQ ID NO: 11095 - protein, 232 aa, Enterobacter cloacae
GLFYHCTGKIRMKRNTSHNVFSPGRLATVLPLLLLAGCVSQPQKLQQRAPADPTPGTTVTRNVQPVSPDEYARTPEVVRYDRYLLVSTDPQAAQRDPLSQIIDIRIPSSLHPTVVDALRYALRQSGYSLCATGSANGVLYRQALPAVQYQLGPMRLRTALQVLAGPAWQLEVDDVQRVVCHSLRDGYQLPVSQLPPPVSTWSAPAPSAVSQPAISAPQSVPVKPVSGGFLRK

SEQ ID NO: 11096 - protein, 211 aa, Enterobacter cloacae
MGNRSVLTGALALGLLMAAVPDGHADQTVPEGYVRVAMAHGVPPEALYSVSLSESSRKLPRGVRPWPWTINVAGKGYRYETRLQAWQALQVFMKRHALKRIDVGIAQVNLGWNGHHFASTWEAFDPYTNLNAAATILRECWARKPGSWLDAAGCYHHPAGGQPAARYRAIVRRHLAKISPTPRISAPAAEAPRSVAALTPDPGFVWTEPGR

SEQ ID NO: 11097 - protein, 136 aa, Enterobacter cloacae
TLSQEMNSMHHSESVVARLRRFASRTLTRAGTLALLGWLTCKPAFADLPSVEAPESGGGSGLSGQIKGYLQDGIVIGGLVVAAVAFINVAIAALHTFTEVRNEKATWTKFGAIVVVGVVLLVAVIWLLGKSADILL

SEQ ID NO: 11098 - protein, 122 aa, Enterobacter cloacae
EPATMQTIRFLPDRLNSEPVVFRGFTTHEMGLAALAGAGAGLLLSLPFIPLAGWVVVPTGLLVMPLLLVWFGGRWMARLKRGKPENWLWQRLETKKRRLGMGNPKLIVDARGWSVKRNRRAS

SEQ ID NO: 11099 - protein, 157 aa, Enterobacter cloacae
ISLQRTGGGKTRRAESGPSARSDGETTGACHGMMTLKYPEPAIHEHSGGALFTLSPQGEPGVLPATHQHLVRLRAMLRQRLTGPVKMTCHPHRVGLSSSVAIYLEGKLKQAVNILITVTGQTSWPQEEEYAHPRWYITVPDSADLVYLMLWINGLDV

SEQ ID NO: 11100 - protein, 64 aa, Enterobacter cloacae
RRFPMKHSPQRNAAILNLHARTMQINGTVDEKVEQLRKMFAQSSTRTKDDRKHRGDREKVYYEG

SEQ ID NO: 11101 - protein, 162 aa, Enterobacter cloacae
FVVPDIEFNAAFLSNHGHAVRRFSLTESRFMKLTSLVFLPALLPASLLAGTVVFTDSQHLPANLPPDVPVVLLDGPDRLQADMFGELPADPQQAEAQVRQVMTSPAWQQKQLQLNDSYRQVVRAWELGIKKVPAVVFDDRDVVYGTTDVAVATSLRNRGGGQ

SEQ ID NO: 11102 - protein, 108 aa, Enterobacter cloacae
RDDSHLGLSCFIHDGTEHFRDMEVIEGDFFYRVRQVDTGCADISLIHVHRQGFDGFDLTVTQALEVTRQAFNPAIIPELQGLSLCIRDNRDVLMTLFEGDLINTEVTC

SEQ ID NO: 11103 - protein, 189 aa, Enterobacter cloacae
QRRNDMIRPVFLLTSFFLLSGCATTDWAAINKQVSDTAANLKKTLGGNDSGESGGMPLMSPAGQQAMKSVDKTFSVPVDVDTAAARLKRHYKFISTQELEALRQATNDGDWKAAAEDDAHPVWDAMPGSYYKMGSDWNGRDHLDIEIEKNGSGSRLYVVYRSSSSQRLAGSGVTKLMNDVRAVAAGEKR

SEQ ID NO: 11104 - protein, 89 aa, Enterobacter cloacae
SGQHLRITDMPVILRINGFRFFFYSNEGNPLEPAHIHVMKAGSEAKFWLTPSVVLASNDGFNSRVLKELTGIVEDNQALFLEAWNDYFS

SEQ ID NO: 11105 - protein, 254 aa, Enterobacter cloacae
RPPDRAQSRITERIMKLKHTFLAAMLLSPPTLAATTSGQTDVSRQESTQRADSAQQNLQQQAGQWGLSTDDYQRYQQLMKGPRGIQSPGLDPLSTLGIEAQTPAERRKFAEKWVKEEFARTQKELDFQREVNAAWQRLYPGTLPVNMGNASGVAHDSGGRLALFVRSKDCATCDAKLSAVLADNRPVDIYLVDSQGSDDALRSWARDHHIPVEKVRKRQITLNHDGGRWMRFGNGLMPVLLQQAGDGKWVIAAF

SEQ ID NO: 11106 - protein, 260 aa, Enterobacter cloacae
TCRSQEGRMAEVKRPPQQQTLPERKHGILYNLLWGWPWALVGVVLSSLLLSLLIEYIGIAFFWPEAGAAHSEAVMNTELGWLSTEFTRSLLLSEPSVTVVRWVTTAYQWAFVDSGFLDWVRQQYAHQMHSDNAVTREINSWSGWLAGYLREYLLATVWISIITLVRVTILVLSVPLFVLVVVVALVEGLGRRDLRRYGAGYESSFVYHHAKKLVKPAAVVPAMLYLSWPTAVYPNLLLLPATVLLGIAVTVTTASFKKYL

SEQ ID NO: 11107 - protein, 87 aa, Enterobacter cloacae
LPAGAALMSMTSEQTNAFKAGSGSLDVNILHLLCIGALLAFLFLWAAWALSDVWTGWSNTKVRDAALGRFAVRTVLLLLVCIWMFAS

SEQ ID NO: 11108 - protein, 325 aa, Enterobacter cloacae
TGEVRSVSVMSKNPHYRAGLMALSFALLPLATLVSRPAGADELMKWERIPLQIPLKVGQERVVFVDKNVRVGFPPTLNGKLRVQSTGGTVYLKADSAFPQTRVQLQDVESGEVLLFDIAAGEKGPTEPVRLVYSGDVSTLSHAGDAAGQPGGADRAASGSGSSAPTGSDDGTQARRKKIRYSAPIPVLLTRYAAQSLYAPARTVEAVPGIHPVNPHLPRRVSTLYPSEPLTVTPLAGWGVANRSVVALRLTNTGSRKVVLDPRALQGQFVSATFQHRWVGPAGTPEDTTTVYVVTAGRPESAFIAEPSALRKATRTVKQEARHAD

SEQ ID NO: 11109 - protein, 981 aa, Enterobacter cloacae
HACAGLQHRVPVLQPDAVCHAWRAYGGPVMLSLFTRSKSTDRQTPPDDGQSVQADETLTAVVKGRQPLKRPGKMTRQDEEKVYHASPSIIDFLPWAEFLDEEQCLLLDDGVSVGAVYDVTPVATEGRTEERLEQIRDSVEDALQDSFDEHDVNPWIVQFFCQDEDDTDAYLDRLRGYVKPHAQRTAFTDAWLGEMERHIRSISRPEGLFTDSLITGQPWRGQQRRTRMVVYRWLGKSRDPMPPVAMLNQVCDRVVNALGGAGIRCTRQNGLQVHGWLLRLFNPSPDWVEKTTLYRQAAYADPRETPEGTVPVSNDFAETLWFTPPVSDPENGVWWIDNKPHCAVAVEKLRTPPEPGTLTGEKSRGEKKINALMDMFPEGTMVCMTVVVQPQDRLEEQFNRLSKNAVGENTESGRVRQDVKTVKEYLGNRHKLYRAGITFLLRGDDMTSLKRKRLELSTVLLGAGLQPVRPEFEEGPLNSWLRALPMCFNPDSDKKHWYTRLTWVQHLAGLLPVTGRETGTGHPGFSFFNRGGDTLTFDPLNKLDRTQNAHLLLFGPTGAGKSATLCAALSQLMAVHRPRLFIAEAGNSFGLLADFFDSLGLTVNKISVKPGSGVSLPPFADAHKLVEEGLAAQAVDESDLPDIDTDDDGEDDKRDVLGEMEISARMMITGGDPKEEADLKRADRAMIREALLMAAHATYKEGRQMLPSDLQKALYDIASDNDEGVINVRNAQRKAKAAEMAESLGMFTQAGSFEAELFNREGELWPEADVTLVDLGHLAREGYEAQMALTMVSMTNMINNIAERDQFLGRDIVFTVDEAHIVTVNPLLSPYMTKVVKMWRKLGAWLWLATQNLKDYPDIAEKMLNMAEWWICLTMPPEEVKDISRFRALTPEQESVLLSASKLSGCYTEGVVLAKRIEALFRAVPPSLFLALGMTEKEEKAERRALMNEFHCSELEAAKRVAQNLDRLRGLTEKQQEPATV

SEQ ID NO: 11110 - protein, 210 aa, Enterobacter cloacae
TALSMKRLSSCAKCLLRVQHELRMTGSTVGIEKRYITKAEFSEDFVKASEDFKYGYDVISKVNVKTGQSILRYAVRLQQKWNDENCILIYDHDDDKLWGRVKASDSKDDAGISWYLGFFHGRVEAWKNDPLIVISFRDEIIPAPQGFDKGFELAVIHAISDHPTLFGENWEKKLPEHMREKRKQNAHTLNYFVDVNSSDSDGSPDESSPT

SEQ ID NO: 11111 - protein, 518 aa, Enterobacter cloacae
VRDVYRSGSLKMTTNSYLEYFLTLLGWVINNGLWNVLLSTGLFVLPLAFKVVGIWLRVREEGEDEGNKGMLSLPRIENALYAGFLVMIACCVPLINVSLSTMQYDTTRAKSCGVWTPKAPDESGYAGVVTSLNDQTAAAPVWWVLIHKLSKGVTQAAVATIPCRPDMRQIRFEVQHTRIDNKALAQELQDFTNDCYSVALYLWKQQDQGQTKDKTTLRDIEWIGSSTFLSRYYPSLQSKLPRAAFPWTDSRDSGRPNTGRGGYPTCSEWWSSSDTGLKARVKDQADPDMWLRISAAMKMSGFNDSDYQEAVIRRLVSPESLTVSQNGHVYAGYGGNADFTLDNAAARVAAIGGTSLGSLAAFPAFDAMRQALPMVQAILLMAIYVMLPLILAFAAYEFKTVITLTFVIFALNFLTFWWELARWLDSWLLTALYSSDTHSRFNMAGLQNSSDDLIMNLVMGAMFIVLPAVWLGALSWAGASVGVAVSAAFQKGTETAQNTGGKLGEAAGNAIGSKATKG

SEQ ID NO: 11112 - protein, 261 aa, Enterobacter cloacae
TCQRRVSEKMSEQQPFHTDPAPARKRFSWRPRRRLIWGAAGGVALAGILALGYTAFSLGISDLDERLTRLESQGSTAATVETVAALQSDVTTLRAGLQDSQKKLGEMQQELSAAAKQAGSDDAVRQSLRTLQDAQQGLETRLSALTEQLTALKSQPAPAPAAPVAAPVKKNAPAAKKPRPADTRRAAPSLRMARNAPFVLTGVEKRGAESWAAIAPRGYSSLSQVALVGEGETVAGWTLVSAGYGEATFRVNGRLTVLRAE

SEQ ID NO: 11113 - protein, 179 aa, Enterobacter cloacae
TREITLMKTLSLLLFTLLPLTGHAELNVIADLGGEDAAPYFEAVNKQPGMSTGNDTTSSPPSPVLQGEAAMLPVFTPELRPGSIADRPLQLPGIGALFLVGDDALSREWLKANAGELAEQHAAGMIVNVTDMATVRELRELAPGVSLAPASGSELARRLQIAHYPVLITDTGLTQQVKP

SEQ ID NO: 11114 - protein, 178 aa, Enterobacter cloacae
PFSPGRTSGSISEESFMHIILNSLRCALWLVFCLFRHAVFVPAAFGGVCLLAWFVFGHPVSDLNDQLQKEAKAWRTAPPGHYMWEGCPVPDNAAPPDAKPAACTVTAVSTETAANNYLLSLRAVWIIFFILSNVLYVLWRLLADALRFHSQPCREAGSAKGTYTRRADGKIIKEADDE

SEQ ID NO: 11115 - protein, 134 aa, Enterobacter cloacae
PDASSSASCPHPLILLEVRMNSHRPAMRRNRRVPGITGLVLLTFLASAVAQASEKDELASVQRQLDQVQASLERARVAAAQADPADRGRFFFDYRQATSDLNTIRSGIDRYLEPSRAQPRDPSYVAGNYRRERP

SEQ ID NO: 11116 - protein, 223 aa, Enterobacter cloacae
QESFMSRFRHAVKDRDQHIQTLRIACAVLAFFLLFTCAGWMLAPSKLTVHNPPDLRTGSTRPWWEVPPPTVYSFAFYIFQQLNAWPKNGEVDYSAKINALSPYLTPSCQDFLKADAKKRGDAGELTDRVRVVYEVPGRGYQSQSVTVQDRDHWIARLDVVADEYFHAEPVKRALVRYPLKVVRWEGDAERNPFGLALDCYAGVPQRLEAAPPAPKPEKSGVFQ

SEQ ID NO: 11117 - protein, 233 aa, Enterobacter cloacae
RDPCVFCGSVAATRSAVACRRTFTALARWPAFTGYWQVLPAAQCPGVCRFVAQPENPAPALLPAYDITGAGAPAECQCVRFYLRRLRSGRLTKEIPVMYRTVFILALSCVMLSGCSTSKEEMLPAGDNTMLELWNGADGGGSTSRQSAAARDTLRRPLTGSETQADAQGDRSYSRTQESEITQQFPRLPNPDMVMYLYPHLADGNTPVPGYSTVFPFYSQTQYAMPGERTEAL

SEQ ID NO: 11118 - protein, 335 aa, Enterobacter cloacae
PGRWSVMTTPSRIRTTVCSLAVATLLGTATAPAAVAALNTAQIIASAVSQNCISWRVSGICYWLFCTPFGCKVRTSVKVTHFIPQTVVSTYVAPGGNPWQEMAFVSQTAGGLESAVTSGLSGVSAGGANPADMKNPGQRKSAVRFKYADAIGHPATSLIGGSIPGYSCDTAATPLMPYFLSTLDSAAWRTGVPESLYPEALVPGQREIGSQAAANMWGNVYPRSGFVSQTDDDKASAVVAQRVADIITRVGQPHVYQVLKGNRHDGYWPPGEVTENTGTRNHKWQRLAPHMTQSCAVFPDGSHTAASDNNEAFALWQPYSCCKKRGQKFLGSTDI

SEQ ID NO: 11119 - protein, 76 aa, Enterobacter cloacae
KLFSSFFSLKLFIEASLELDPICVMAAIKVHNKTALQLIKKPPAISATNEQRTAKSSGMWPNHFGSLYCLASMTQR

SEQ ID NO: 11120 - protein, 67 aa, Enterobacter cloacae
RDYSGFFEQLLITASVLRVTNKFSNIIGLIFFNALRLVIIKKASLYCAYMGLPRSWWETHNPMFNLP

SEQ ID NO: 11121 - protein, 61 aa, Enterobacter cloacae
HKYILIFKNQISMHNYSIYFPCVTASLLSQQLKLTFLQLAYKKYRGIVYAMDNKSNSDPSF

SEQ ID NO: 11122 - protein, 60 aa, Enterobacter cloacae
CFISIFSTEKDFKKNFINSWLCPLIQITPSQNYLLQGMSLDWPYKHQRLPLGAVFLTTTA

SEQ ID NO: 11123 - protein, 149 aa, Enterobacter cloacae
RSSATFLMKRPGCSPFTSKSRKTTFKEQHMEQITVVIGDRLGKGQKVAAGVEKAGGRAVVVPGMAADMKLGDVMKAENATFGISFCGSGGAGAITAQTKYGYKAKYGMRSVDEGVTAINEGCNVLGFGFMDKEELGERLVQAWQKKYGA

SEQ ID NO: 11124 - protein, 262 aa, Enterobacter cloacae
KGRLMFLIILIKSLIIGGLVGVGVGAGAARMFHAPTTQGMGAFRTLGELNSCEGDPASHFSFGLGFFFNAWASSVAAGAFTQDVDHRIIPNWGAAALMIKNRNVGETLHDPRKMAIACGIIGMIVVTFLNLTASSVPAALQVTAVKVLVPAANLLVNTVMPVIFWLAAIDAGKKSGFWATIFGGAAQLIMGNAVPGLVLGILIGKGVEESGWNHVTKVMMAAIVLLFVLSGFFRGFDMKMIESFHLTVPNWLDMIHNSLSGK

SEQ ID NO: 11125 - protein, 213 aa, Enterobacter cloacae
MEQNKGFWYADWSFPIFVGLLSSGVFAGTHMYYLYGIGAFNEVAFVAMLKAGIDTGVYGAVAAFGASFLFARIIEGSLVGILDIGGAIQTGVGLGVPALLLGAGIMFPVTNFIASLITGLVIGLAIGYVIILARKFTINQSNSTYGADVMMGAGNASGRFLGPLIILSAMTASIPIGVGSLVGALLFYIWQKPITGGAILGAMILGWLFPVAL

SEQ ID NO: 11126 - protein, 255 aa, Enterobacter cloacae
RSIRTGEKRMKLTPNFYRDRVCLNVLAGSKANASAIYEAAEGHVLVGVLSKNYPDVASAVADMREYAKLIDNALSVGLGAGDPNQSAMVSEISRQVQPQHVNQVFTGVATSRALLGQNDSVVNGLVSPTGTVGMVKISTGPLSSNAPDGIVPVETAIALLKDFGGSSIKYFPMGGLKCRDEYQAVAEACARHDFWLEPTGGIDLENFEAILQIALDAGVSKIIPHIYSSIIDKASGDTRPEDVRTLLAMTKKLVK

SEQ ID NO: 11127 - protein, 74 aa, Enterobacter cloacae
INLCTLGKYEVLVYSHWASKFALRTVGPIVAPQERMIRRRYKNENFPTLQPASGGEVREDPVPWTVVHQGCWRF

SEQ ID NO: 11128 - protein, 152 aa, Enterobacter cloacae
LLAEKGSRYAWKINGIIMHRDLVFKNKNIFVLFMLATIGYGIWRMLGDFFYLEQTIVYRHAVADKSMLYITESSAGATTSFVYKYYLYTAQKTDEVFLEDIKNGYEPFLVTTDPGVKVSIEDRTIFLKVSGDIFKFNNIVGSAFIYLNSSPF

SEQ ID NO: 11129 - protein, 123 aa, Enterobacter cloacae
FYSRAINGVRRVINGAVMNDVGEQAVQTEQLAKTMLQQVYALLARHNIIPNAVQEQMLTSHVRAMAHRSVTGEPLPEVEAELFDEISPDSMQLAREVVAQFGNLPDEEAWLLSVHFEVAKDNL

SEQ ID NO: 11130 - protein, 118 aa, Enterobacter cloacae
RRAGRASGTGVAEEIRRVSMKEQFTTTVRVKGKGDAKARAFADALNHVQAAVMKASPHILLRIEPQDVQVVQAQEAVRKEAFLFFFLRRERRTYSVELDVTVNVTAINLDQVDFVTQR

SEQ ID NO: 11131 - protein, 79 aa, Enterobacter cloacae
PLVLISPGDAPGGGNSREKISQRTGIRGDCCQTQTQRVRQRQQGIDLSVLRCGNLKSVAERILRVVKAERIGGHLQLTR

SEQ ID NO: 11132 - protein, 66 aa, Enterobacter cloacae
SRRSSIKRWPTIPLPMIAESDFDHYCLDFFSIIAYVNDSAGALIDANQIRLHIPLRGYIYDLSGLL

SEQ ID NO: 11133 - protein, 92 aa, Enterobacter cloacae
EKKLIHVSLMRLLLVMSGLLKVKKNAMTAFERADFSRESDLIKSFQKILSTIAGFNVMQITLYCGVNNRLRGNNCFNLVKLGKRLVWVHTAL

SEQ ID NO: 11134 - protein, 60 aa, Enterobacter cloacae
LASEQFVRLAVINDLCTHLMHRLRGWLRTLDEILGTAITAIRELSSAAVNIDRDNARRRR

SEQ ID NO: 11135 - protein, 132 aa, Enterobacter cloacae
ERYIHRLFIFLTVSANAMGKFIIYMLNILFCGYVLATCLISLVSFDNWEDRTIAITIILGSAQLIATLLNRALPHKLHILGGIAELIEGPLLVIGAIVCLDVFEPWPMKIIGMFAWVIFMMFRPSFTKRNKE

SEQ ID NO: 11136 - protein, 70 aa, Enterobacter cloacae
LIATNEEVFMTIRNNRTEISLALGEAVLDIVQKGHEVSRENLAQAMKIKAEKERDDERLLNYWKACNMLV

SEQ ID NO: 11137 - protein, 149 aa, Enterobacter cloacae
RFLGGAGLQLLCILMKNTTMPPRIDLGLFFLRLTGSLLLLYVHGLPKVLHFSEELTRIEDPFGFGPYASLIPAIVAEVICPLFIIAGVYTRLACLPIIAVLLVAMLAVHPNWSIAEGQFGWLLLIIFTTLALTGPGQWRLQRKAAERFA

SEQ ID NO: 11138 - protein, 100 aa, Enterobacter cloacae
HVGGRAARRGKPGLGEGVGGAAGKTEAAQTAGGVVMNEDRPGFDIAVDQVVLMHLAQGTADADRHLDKAGDPGNRLTCPARQQFKAEWRVDQRKTSAVLG

SEQ ID NO: 11139 - protein, 100 aa, Enterobacter cloacae
RRFRLANSRRRAGPSSGSPLPLSLEFTMSTGLISLAAGVLIGLMYAVLKVRSPAPPALALIGLLGMLAGEQAMRHLLSRDNPAAVQVTVPHVQHPTGASS

SEQ ID NO: 11140 - protein, 119 aa, Enterobacter cloacae
SNCAGQRQTMVENIEQRIYALVRRYNGVYLMNNEEKQKLLNAKTDLDTDMQLDVTEAEDLMDEFFKEFNVDRGNFNINTYYPDEPFSWNPFKKFPVVMVPDFTIGMLIESAKAGKWLYD

SEQ ID NO: 11141 - protein, 153 aa, Enterobacter cloacae
TMDTTEELNETYFYAGRTNLTAAGLFFMIYCESIADHFGIDDVAGIAALYSGANNQTTRKKPAGATEGTSRASKAMRNYFKQAKFPYGIKLPTWVGGYTPWTVKCRMVSKVSAFVGRTIPLIGIVILVADVSLITYAAIRDYNRIARGSDKLW

SEQ ID NO: 11142 - protein, 105 aa, Enterobacter cloacae
SGCRAGDGSPRSTPDRSVIMKAWIISLVCGAAAGVLYALLDVHSPAPPVVALLGLFGMLVGEQLIPIGRRLVSREPLTLAWFRHECVPKISGTAPPAPAKESRDA

SEQ ID NO: 11143 - protein, 108 aa, Enterobacter cloacae
CFKMLIERLSLNLCATVNFVQQANNRNRRIIMVDKSAIKDHTQVVASCGTHVGVVDHLDGERIKLAKSDPESGGKHHFIPLGWVDKVEDNKVVLTKNHKEVFAEWQEA

SEQ ID NO: 11144 - protein, 214 aa, Enterobacter cloacae
FSLFHLQEIIDPSMMKYIRDSLALSALVKSKMATDDLNQLETLKEQLKDRFGVPVGVHMTGIPLAVSTLLAIFCYAMLQVSLWLLLFRWLGLPEFKVMMGVFIAAIVYCLVVMSTMFLTTRGSLPGYKLHIFVITLTGIMSIIYFIWTGISLLFGPVENYTPQITSLLGLGFFFLNIMWMNSSIFYRSIALTLHNRVWRKQLKIEARPMSHLKR

SEQ ID NO: 11145 - protein, 60 aa, Enterobacter cloacae
QQGVLTFDAGRIVAANLIAGKETTVLIFVFKINIKSKVLRFSDFLYIDKIDHRTIYCDIS

SEQ ID NO: 11146 - protein, 352 aa, Enterobacter cloacae
TLFGTFLILSVNRTFTLVLLTINISHGRRDEVTFTGQFSKDLPDYALARSLGLASGGDINFTALAGQLDCSRNFSQAGIIYSDGTRQWLVRPSRRIATPNESSVSHVVITKVNAALVNPVQATTATINSPSLATEIGSTAISCGAAILTVVLAAGAGMAIPLTAGSSGAIAAVILAGGVATGIQCANGLGRLSLIAMNHDDYVAWMDSQEWYTATNTALDAISLAGAAAGLKSAALTYRLLNRSSSESLLSLLQKMSRADRTRLTEEIIRIRNPGISNSGVKAAMKAGVYPKRYPSEALQLLLQRELLNTISNSSAFVGSAISGNIRNPQNVAQTGKYIFGLIQSFSFTGNY

SEQ ID NO: 11147 - protein, 75 aa, Enterobacter cloacae
LYLKTMKNFDNEMRIFSLIFSVFIIELVSFYFNISGGPTAVMSAIVVSQSFVGAQYLKARNRTIGSLHQRPEGQI

SEQ ID NO: 11148 - protein, 61 aa, Enterobacter cloacae
PLRIHPKRSRAFSVKLIYRRWGISPRPENKRDNYNAIDYPGQCISFKQFCLTRGMTRYNRH

SEQ ID NO: 11149 - protein, 90 aa, Enterobacter cloacae
LHPRVDEIDDVGSGKQVIDENAWDSSGHMPQKFKRLINENKPRIPSGSTALRLQLCLSIEGCGPQQISTDEYGVRFREPVSSRDVSQRKL

SEQ ID NO: 11150 - protein, 120 aa, Enterobacter cloacae
MKKIIVLSLLGVVVAVGAAASIYSNEEPEYIQSAKSRVGSYLTSDYGRVECNSTQVSEDRWELGCTNKARGKTFQFAVYPPEQAPYGVSRAFYLEAINDDARQSADQGLMRYLQINTKAG

SEQ ID NO: 11151 - protein, 103 aa, Enterobacter cloacae
PIFSTLISYTRVRYMVIKGSVAPRPIVNNNDDASSAAVERLIDGFIFLPDKCLCFFVVLLQDYHGIGSLYSTQFIRKCFSSVPELMIFSRGYFFCYLEVFTKF

SEQ ID NO: 11152 - protein, 219 aa, Enterobacter cloacae
KGEGIHYRYYPVTGGFLMKILHLLTGHVSYELLQHGKRIEDAIGRHDNDLLNHSTPELERYFSRPLSELPRKNAYPVAILLPLFLVIFAFNLLPFLQTISSMSPTLHTLSFFVPSLAILIFLMLASAFLARGYTSGLSGFLALFIILLTLTVLQWLHYLTISDGSSWQLIIATIALVISRMVLNSRGFVLFTLYCRSKRLATLARIMRLKSGKDNVRNT

SEQ ID NO: 11153 - protein, 77 aa, Enterobacter cloacae
HDYFFHLFDPILSQKNLIVNDFPINLVALCIPEMGVYNVDIAFKNSLKRVLLRPQFLTLYFLKFKESNNYSMKLSLR

SEQ ID NO: 11154 - protein, 76 aa, Enterobacter cloacae
KVKIECRVALRLPDLENPNPRPGKAKPSPGKTNTLVVQHLLHHLLLVHLIRVVGRPVIHLFQQRLVGGVAHKDMEV

SEQ ID NO: 11155 - protein, 62 aa, Enterobacter cloacae
PVKEVKVPPGAAEFTVRYHMQTAGALLFDNMANGLVLNRAKLTGIDLTAGKLQTGLFNRVRA

SEQ ID NO: 11156 - protein, 73 aa, Enterobacter cloacae
KTADYIGAVRGVVSLHGNLLCLSALIAHSDNSFLEHLDFWMSKRPKKMSYRLAADKRENFICVEINSCSQGGR

SEQ ID NO: 11157 - protein, 112 aa, Enterobacter cloacae
MQRAGQMPPGKMFRLPDNVQQNKVLLTAGYRVMDIGAVRLDAQTTQKMPHGFLRLSSRKFSNIAHESSSFVVFVLTLLYPLIQNMNASAYARKQQKDDKLKTSLAARGRAGI

SEQ ID NO: 11158 - protein, 82 aa, Enterobacter cloacae
HQKRIDAENTPSHDQYFTVVMLFIIGTSDFNYLRLRGLPSFYIADVYLLRSTKAHSLYSDYLHHYAKFKIIVFWVRLPRTHQ

SEQ ID NO: 11159 - protein, 70 aa, Enterobacter cloacae
TTIVSPSARVSSAACALWYSVEKMASVSVAGANLIMLFINSFPFVKNAMTNINDSHSHYNKVTAISIKSS

SEQ ID NO: 11160 - protein, 83 aa, Enterobacter cloacae
SLAGGLSWLCPVLDGGCSSCLELLGLIMVMTVRTEARKEMCQLRDNAHKARKAPATSVPASWKLTPQQQAFIDVFAEDEPKKQ

SEQ ID NO: 11161 - protein, 98 aa, Enterobacter cloacae
LLIHDIASVIIVVTKEAYPQPIRLTTSKTRFGHPLFNTLFRQTLKIIPNTEAPVATIYFCVVSTLVIIHATFTLGLLAKRTPNIQIYFSLTSGFTVRF

SEQ ID NO: 11162 - protein, 141 aa, Enterobacter cloacae
VQLFPRSDSMKSLPFFFAVLTLSTLTACSSPQPDNVEKINHLQIPLVLPGEKSPQVQISHIASLYQENKQQIETLTRSVKSQYLQDTTAKEIFVADSAVQRVYASLTKLEQLDMVNQQYLKDNNVTGLQNIHIVLEPLFTS

SEQ ID NO: 11163 - protein, 280 aa, Enterobacter cloacae
NDQTHFGKESLMDIALLNRGWNRTWSDTMVNLEARKLVETANRLSAFYLQDGLTRIKFVEEIKQVADKEFETARRAKTDEECIACIKNLRAETDNLHEQERLLRTRAAQLYAKVEFVKENNKIVGYVISAVNVVLSGVVLFGGFMMLSTMGPIGMLAGAVLIADGMNGLTKEVLNFDQPEGHKPSQGIIADSAMHTAQFMGFNPNTGLALYNGVTLGASVYSIVGLARKTGAWRLFRWLPHDYYRKVSTMSTPKLTMKIVGYGVKAKVIFDLLTTENGTS

SEQ ID NO: 11164 - protein, 123 aa, Enterobacter cloacae
LLAQSAIGKTLLGDKGRDDMKVTDEALLRSGFTQPELQKIKSNIEKYGGTLGEAINDLARRFVTLAGVVAVCALILLLLIVFSSPDRAVAWGLAMIFGVAIMSFAQPPVISYKSWRYRKTIKD

SEQ ID NO: 11165 - protein, 67 aa, Enterobacter cloacae
VAHFLYPGYPEINPNNSRVSMATGKRKNQKESPEEELDRLLDELELTEEQREFIESMREDKGDPSSE

SEQ ID NO: 11166 - protein, 72 aa, Enterobacter cloacae
SVKETMVSFGDAAPVRGLLGSLNNSFASWSLEASSDGAAKPNVDNDSRSKAIKALMLFSFCIGQGAQHRFAA

SEQ ID NO: 11167 - protein, 189 aa, Enterobacter cloacae
VLKAFSQRNQKFRQLSETVTTAMEPKNEKVPGIKESYRLLTFEYAFRQVGFIVLLAIIVAAIAGLFSSGVVSDVEKTNDAKSLALSYERFGRRQTESRMALTFPVTSEGKYTLSLTSESSDAYEPGSVWPQPDSMYSRGNTLFLVYDRLQQTDKFTVLLFITPSKAGKWTNSIRVNNEPDIRFWQFIYP

SEQ ID NO: 11168 - protein, 121 aa, Enterobacter cloacae
KLPPETPTSGGRLNRFGVPTIWKIGASKEAPVQSTIIEDTDYTAAKKRVNETNDVALATSFHMCVIRTPIPTPDFAGAPPFYYCEFIQQLTSKESGKRLAKFLCGLLPSPQPSPTGRGRKH

SEQ ID NO: 11169 - protein, 210 aa, Enterobacter cloacae
  UNSURE (27)
CRPSALRLSAAIQPGNRSGFRTASPAXKNVFGKTALWLVGLCAMLVVGLYMHVYWNLRHPAPEPINASVAKPETQLSEMHYVYVSKPFPHPQPKVAPVHVDVPPMQDLPISSDDADWQQAPEGAVPHDTSRDTLPGTEAHEHDIAPASTSSEESSLTELFKQALKEQEQDYSQGKIPAPPVDETQDNSQASVKNSGNSRSPLSEKGERRE

SEQ ID NO: 11170 - protein, 61 aa, Enterobacter cloacae
RPDVYPVVSPLRMRFPFGCTVTLGQYAETVLLRFKRAILYLIEEFRHYLAGSKLGSDTPED

SEQ ID NO: 11171 - protein, 158 aa, Enterobacter cloacae
FSAFNMEIMNMENQSISQLYSELSLNPDLPTLAERCKLLTEILLDCKSLPQTQPVCRCFGAYMEEVKSGLTESMRDFQVVEFEDDAEQPRQKEWLLEDTETKCDYCRALNHVLLVSHVDRDMLPHLTGLLHDITHAMAEDLIVPMNPCMTIHLPTQPH

SEQ ID NO: 11172 - protein, 60 aa, Enterobacter cloacae
ERCSFFRLVSILNLYAIEMIKYYFNHKKKRITHQVTRSMNTVLCICVVNSCAQTLTPYAR

SEQ ID NO: 11173 - protein, 63 aa, Enterobacter cloacae
SHLLKLYFRYMFKVMPVPQQRKVLSYTKWRVIDLAQFWRQVHYRQSSIRLRRTPSEWVPAGSE

SEQ ID NO: 11174 - protein, 774 aa, Enterobacter cloacae
LMQNASALPHRNALRPALLWAAVCLILLGVLLSLLPGARLNSSVLAMLPKQTLGAIPPALNDGFMQRLDRQLIWLVSPGKQPDPRVAQQWLTLLQRSQALSVVKGPLDAAGQQAWGDFFWQHRNGLVDPATRARLQNGGEAQAQWILSQLYSAFSGVSGKELQNDPLMLMRGAQLALAKNSQKMQLMDDWLVTKDAAGNYWYLLHGELAGSSFDMQQTHQLVTTLNALQQTLKSQYPQAQLLSRGTVFYSDYASQQAKNDISTLGVATVLGVILLIVSVFRSVRPLLLSLLSIAIGALAGTVVTLLLFGELHLMTLVMSMSIIGISADYTIYYLTERMVHGAEHSPWQSLAKVRNALLLALLTTVVAYLFMMLAPFPGIRQMAVFAAAGLSASCLTVMFWHPWLCRGMPVRPVPLRRIMQRWLDAWRDGKALSVGLPVALALLSAIGIASLRVDDDIARLQALPQDILAQEKTITALTGQNVDQKWFVVYGASAQQTLERLEAFTPALAQAQKAGELTRWRTLPLNSLARQNSDLHLLRNAAPTVVKMLQSTGLNAVPPNLNAMPVSVEAWLASPASEGWRLLWLTLPDGKSGVLVPVDGVRNSAALGELATRHPGVVWVDRKASFDSLFALYRSLLSGLLGVALAVIACGAMLRLGWRKGLVALVPSVLSLGGGLAALAVTGHPVNLFSLLALVLVLGIGINYTLFFSNPRGTPLTSMLAITLAMMTTLLTLGMLVFSTTQAISSFGIVLVSGIFTAFLLAPLAMPSNKENLP

SEQ ID NO: 11175 - protein, 103 aa, Enterobacter cloacae
PGHRRRSAAFRHSACYGRFYAPSLPAPGNGGPEHQACGLGWKTGRSFSSRSGKNGCSLRPAIANANQVNDCVKISHCKVSSKQYHAAALLGSLTPNINQKGTI

SEQ ID NO: 11176 - protein, 124 aa, Enterobacter cloacae
LRSYRSCFMKIPEIGRLQPDPQHLEITFYLDPDLLWFKGHFAVQPLLPGVAQLDWVMHYAAALAPGYRFHSIQNVKFAAPLLPENTVTLLLAWQPEREMLTFSYQRHAGNERHTASSGKIRLCQ

SEQ ID NO: 11177 - protein, 60 aa, Enterobacter cloacae
SCKVLKKHIQNMMLSVYHTLFQHYTLMFLQELQFTGGKRCFCSYLALRDSVGQILPPLQS

SEQ ID NO: 11178 - protein, 240 aa, Enterobacter cloacae
MKFTLTLIDWQARAPGLSDADEWQAWSRRSDAIDPAAPLAKLTDLPMMTARRLNSGSRLAVDLGLMMLRKHRIDAVVYSSRHGELERNFRILQALAAEQPVSPTDFAMSVHNSAVGNLTIAARQPVVSSSVSAGMDTFQQSLCDVLSLLHAGYSRVLLVDFDGLLPDFYHAGLPPQMPVWPYALALVIEAGNTLSCETHVNRTPEEPALPQSLQFLRHYLRDERQFTLPGERLLWQWTRQ

SEQ ID NO: 11179 - protein, 272 aa, Enterobacter cloacae
QNNKRFIRKSLRFLLRCLKSPRRILPLRHVFTRIWTSTALMPSIWWCTCKRKRAIKSSLKPSKRCARCRTSWTLWNSFSATRNVRSIRVLPALTGLMLLAWPFLIGFGLANNSLHGILPVMALVLLMRVCQARRQGGPLRYLFVSVALAGIALCAASYVLHAHQWVLLYPVVVNLVMLVVFGGSLWTAMPVVERLARLREPDLSPVGVRYTRRVTQVWCGFFIINGAIALFTVLHADIRLWTLWNGMIAYLLMGTLMAGEWLVRQRVKKNDA

SEQ ID NO: 11180 - protein, 252 aa, Enterobacter cloacae
KPSAHRLSNLRRANRETHHHRLHHSGGGGRSKPGDVLCQPGHSVRTHGDRAMKWITLLALLVSPLVNAVTLDELQQRFAEQPVVRAHFEQIRTIKDMPQPLRSQGEMLIARDNGLLWDQKAPFPMTLLLDDKRMVQIVNGQSPQTITADTNPQMFQFNHLLRALFQADRKVLEENFRIDFKDLGEGRWSLVLTPVTTPLDKIFSTLDLKGAIYLESIRLNDKQGDTTDIALSRHQLTPARLTDAERQRFAAP

SEQ ID NO: 11181 - protein, 197 aa, Enterobacter cloacae
QRELTMTRFIRLAAVMMALLLAGCSHTTNRDDARPQAWLQPGTRVTLPPPGITPAIRAQQLLTGSFKGQTQSLLVMLNADGNKVTLAGLSYVGIRLFLATYDDTGIHIEQSVVMPQLPPASQVLADVMLSHWPLSAWQPQLPKGWTLNDTDTRRELRNPDGKLVTEIVYLNRNGRREPISIVQHAFHYHITIQYLGD

SEQ ID NO: 11182 - protein, 223 aa, Enterobacter cloacae
DVFMTNMIADEAVAKSSVLSVFDFDGTLTHHDSFIPFLRFAFGKRYFAGRLVRMALPTLHCVRRKLTRDELKEVLIKTFLTGVDEHWLRQQAEAFCEKYWNKLMRPEGVLAVANEVNSGAEVTICSASPALVLQPWADKLGIKLIGTQLEVKDGKLTGRITGHNCRCAQKVARLEKVYGDLNAYHLRAWGDTRGDHELLAAAQDPHWRHFHHPSKRRNSPIKG

SEQ ID NO: 11183 - protein, 238 aa, Enterobacter cloacae
  UNSURE (174)
NKRIAIMYGNNEIVSYLQANKILALKLDHAVTAVGQNVKTQVNMIGKGATRLLYYASCFTDEYNDVCLRQKSEDLRFRDAVYKLVSGVDVVYEMLRLYFEEVFKYKNPKQLEYIKQRLMAVNVHIAAVSLTGAGFTLAVAACVRLGLNISLELSAITGRWASRGIAFIGLYGVXQQAADSAHRLYVEFPAWYSALYAQGLEMLYFLIEPVFRWTDATRALWASDDDIADIITRLIRLQ

SEQ ID NO: 11184 - protein, 243 aa, Enterobacter cloacae
GCEMNKTWTRIVIVVIAAAAVAFWVFFDRQRAPERQMDNALNAMPAWQVIKEQEPALHQRILDQMAALQKAGEPEQQIIDTIQPQILHLQMSRLQNAPDANVVNYMTINMEQTAAIQKVSDDACFRFLYPMVKGGINPMRMLDKDLMTRRMQADADMMRAAYGKNRHTVTPAEREAAVEDVRPIMKQLADKYGEDIQLLQMPEKAVGKEKLSCDMVQEMWAKVLALPEQKAARVIRLAVSELD

SEQ ID NO: 11185 - protein, 78 aa, Enterobacter cloacae
ARLAGDSIYPCASAEDATVNVVTASAILESFIHHPLIRIEQGSVSLLMEWRMRHFPERVKMVEIKKGSQSCLLFLEIN

SEQ ID NO: 11186 - protein, 372 aa, Enterobacter cloacae
TKERTMPVHHAIWRIGEHPQPLTISKLASEQLLEKMILNDPTILSDQWMIIGHQENTLDKGRIDLLAIAPDASLILIELKRDRTPREVVAQALDYASWVDDLTADRLSQIYEKFSGGGNLGSAFKQRFNTELEEESLNQSHQIIIVAAELDPSTERIVDYLSKNGISINVLFFKVFQHGDEQFLSRAWLIDPSETQTNAAQATAGTSANAKEPWNGEFYVSFGDPQSRVWEEARRYGFISAGGGSWYSQTLKQLQPGDRVWVKIPATGYVGVGIVQSAVEPASSFTIKTEHGEMPAIDVLKYSDLYRQNADDPDKSEYFVPVKWLETRSELEAVNEVGFFGNQNTVCKPTTPKWRFTVEKLKRYFTQWDTEK

SEQ ID NO: 11187 - protein, 93 aa, Enterobacter cloacae
VDLMTLTNRTKTILRWGGICIVSVGYFLGLFVASQAFAVFSENQTLVSNPVPLREYYQAVDSLGQATSGVFDAAIYGFVISVPLILLIFKKVR

SEQ ID NO: 11188 - protein, 69 aa, Enterobacter cloacae
FRVCHGSILFKVRQILLFSHTDGFASTFVGKICETGLQMNNYTYKVNFNSISGIRHVRIKCLICTRNTF

SEQ ID NO: 11189 - protein, 151 aa, Enterobacter cloacae
PYTGIIKMNKLIFLVLFSTAALGAEDFQIPMQRALEFNRWYVKQVNNDRYPIQQGNEIDEFVTASTMKKLRHADDPRYADAEFYEADFFMKSQYIGEDWAENVAIDSYDSDPVCVNVNITFGKKTQHTVIDCMFKEDGVWKIQSVAARDNN

SEQ ID NO: 11190 - protein, 85 aa, Enterobacter cloacae
SAPRWCISKLIIYSERINIHKEPFALSKACIKSLDPKSELRIMPDNLPGGSMVKRVRHNVLPRLKSDAGLPFFFPLLNLFPEPLI

SEQ ID NO: 11191 - protein, 165 aa, Enterobacter cloacae
PHQLFLKQVEGPMKQYTNKLTPEMLAAFDESPFTAEQLAGMNDEASSLIEKQNAYNLAHPVTAAYLIATEGSLTRNGGKVFSEYNGRQIKLDDGTMLNVSRVGDEVRYPDGTSAKITTGAGNTPGESIALVGSSLDNGDEIISCPQNAGRRVVRAGESLPENFLK

SEQ ID NO: 11192 - protein, 72 aa, Enterobacter cloacae
VVGRSTFAGQGIKGRSPAGAAKAEAPSISPAVKRLYRNMNVPYLTGQIQAKHSVNMRSNCRQANAPTEITGC

SEQ ID NO: 11193 - protein, 118 aa, Enterobacter cloacae
PTNREYYLSNYKGEYMRDKFIDAIHSRSKIMLTFYSKEDNATITRLTAPMDFGPSRRAHDKSDRFHFWDYESDKKNHVLSLRPEAIKSLVVIAQNFHPQEFVNWTPNWFIPRDWDQYS

SEQ ID NO: 11194 - protein, 383 aa, Enterobacter cloacae
NKAVTMASVNRGCTVHGKNVGLHGDKTSTGAQCIAARPGMSVMGLWKLYIGDKTTPCPKCGKVGVIVSGDPRCSNSVAVAVDGAEILCGCPQGTNFLIAPGTVEVNTPSWTIAPGEPVQHAQAAKKQNSFTDTCKPEDNPLLNGVYIWTETTDAGHAFVSVHQDNSIYLYTYGRYGRTGPGNLTGDGILNFLQGEDARVYYRAELYRMGARAFRIDDADPTKTRQFFEDLWNKGEPAIRTSEMKETTQRRGRTIDEYDVTGNNCTTHSVEGIKFAGSRVFEHNYTSTTTQIPIESAEDFTIPVSLQRYLESKSSDFSSMTVVEMTGEFKKMYPNKDNLPRYQESPKGKVQHIAAEAAATGDSLSQYSSGTFGGVLGGSYDVDE

SEQ ID NO: 11195 - protein, 153 aa, Enterobacter cloacae
GRGKLLGDKMWTEPKRPAQPVQQAQTLIKGGTLNSVAAIMVRDDIKPMIALDFIARLGYILPCHDVVHAVGSDYALCGDGSIGQVKHQKHLAAALRTGKHRWNFKRRHHLSGIQCECLIRIAKGWALKSAPAGLSLRIAGEHHRIFDVRNRCK

SEQ ID NO: 11196 - protein, 114 aa, Enterobacter cloacae
HELINNLTRQECDPDLHLRHRRKTCLRHIALNKYENKIMKKIKTATAAMVLSALSFGVFAADNTQPANDVNSPIGIAKASDVEAGSNIAPGTQSTGQSMNDAFDVHKLVAGEWS

SEQ ID NO: 11197 - protein, 96 aa, Enterobacter cloacae
NIFRGFLYRIARLTIFRQQDALAKRRKVQRMGCHMKLESLALTRDLLHDPIAHDGFPGGFRRNPGEQRPERLMRRGKTRQVVLPERQRFSQLQGTG

SEQ ID NO: 11198 - protein, 61 aa, Enterobacter cloacae
IVNIFTTSGALPHENKKEYAEAKYNSGIVIAREIYRSFTPCSRAKRAEMVQILHRWHYLSQ

SEQ ID NO: 11199 - protein, 63 aa, Enterobacter cloacae
DLSLRFIACYYSESILTLKSAIIISNGHFFVLFCYKQVPADEYSAIFYSPLQTSTHTNESIWL

SEQ ID NO: 11200 - protein, 69 aa, Enterobacter cloacae
RGAVARPSQVRLEPESPNVFQDSIKQLQYSNNEFEDKYDHIHDAHTRLLLVKRSTMLAYLSAACGQHLD

SEQ ID NO: 11201 - protein, 152 aa, Enterobacter cloacae
RGNAMSRLLIEPVTPDEPGYIALKAESIALNFNMLRRLEENWQRGENRFNAPGEKLLGAFLNGRLVGVCGLNRDPFSQQPRAGRIRHLYVSEKCRGQGIGKQLLTVVMADASIWFDFLNTHAPETAYGFYHRAGFRLVSDEPRVTHRLFCAV

SEQ ID NO: 11202 - protein, 95 aa, Enterobacter cloacae
LPSKMPSTRASRICQARLTFKFFIETDFLNEISAPSKLHEYGDILKGYELCCVGLWDFLTRRMSIICTACCASLKEQGISLQKVSLSVIYSNSHK

SEQ ID NO: 11203 - protein, 74 aa, Enterobacter cloacae
RPAAIAPCRDTRSAHCVATRFRPGIGCSRLICHKKGDSDANHRKFKMFFHSVLVNSLLLVNPVCYHPNRNELLL

SEQ ID NO: 11204 - protein, 85 aa, Enterobacter cloacae
LECLNAWLFVQPTTCSAILTEQMATLWRQTDSECGTLFYQHHVILAVDQVLTDGGDLDMNLCFVTKLFDDLNFTFQRHIRNVAWQ

SEQ ID NO: 11205 - protein, 69 aa, Enterobacter cloacae
LEELYSPAEKMTNQPGQMSPQRGNLMSHQQIIQTLIEWIDEHIDQPLNIDVVAKKSGYSKGIYRECSAP

SEQ ID NO: 11206 - protein, 79 aa, Enterobacter cloacae
SGVGAEARATTVLLSENNKQAALSASVILRIFSPEYSVCYLFILSGWSKNYPTITPAGGEGKEFLLIKRNKKKTITKCG

SEQ ID NO: 11207 - protein, 142 aa, Enterobacter cloacae
GVKTLTLSCSAKNTEIRQAVLYLTHRKSGDRKMKRPDCIRHWRDVEGADDATYPDSNERFSIGAPLARKLGLGRIGIHHERLPPGRRTSYPHAESDEEEFVYVLEGYPEAWINGYFMEARTRRQRGISSRDGRVSHLYQQYR

SEQ ID NO: 11208 - protein, 84 aa, Enterobacter cloacae
REIVMKKVLYGIFAISALAATSVYAAPVQVGEAAGAAATSASAGSSTAASTSAVSSAVGVALAATGGGDGSNTGTTTTTTTSTQ

SEQ ID NO: 11209 - protein, 161 aa, Enterobacter cloacae
KDLTVFGTGGTWKALMTQRILTATNVFLLARRWPANWVSAALVFTMNGCRPDAAHLIRMRKATKRSLFTFWRVTLRPGSMGILWKLEPGDSVGFPAGTGVCHTFINNTDEEVRLLVVGEANKKHNRIYYPLNPVYAATREDRWVDHPPQFFGPHDGKPGRK

SEQ ID NO: 11210 - protein, 443 aa, Enterobacter cloacae
QTIYEHTVKKHFKFSMVSIAVSFFMANQAGAANTWTEARSDAMGGTGVAAGSYGSGALINPALLAKSKPEDDVTVILPSVGVQVTDEDNLQDEIDTINDKINHYKDVVDSLTPIEVITNPLGSINQFQGAAKDLADELDYLKGKTAHATAGAGIAVSIPNDVLSVAFMAKGYAHGRVSSSIDQQDIDYLRGIQRSDAVAAGVALDAALNGTDQITKNLNSTASGRAAIVSDYGIAVARQFDLGGVPVSVGVTPKLQKTWLYNYTTSIYDYDSNKWNDSRYRTDDTGFNVDAGIAADFGENWTVGVSGQNLMSRDIDTKDIRIRNGRTGEVVSYKDTYQIRPLVTVGAAWHNDLVTLTADGDLTETKGFKSEDTSQYVGVGAEVTPLSWLAVRAGYRADMKGNDSNVFTGGVGFAPFNAVHVDLMGLYGEDETWGAGAQLSMTF

SEQ ID NO: 11211 - protein, 63 aa, Enterobacter cloacae
RLQQYVYGLCLCGTINVPAEIIHRIELIAFFGFYILCFTLSMLFDFVVLFFYSDMSYCGCSLD

SEQ ID NO: 11212 - protein, 132 aa, Enterobacter cloacae
LFSSSRMKNEKKYVVIPYGEYFRMRLAMLEYDDDDENDWEDIPYESDIYDNVGLPGEVCDIMHNENVSLQAAWRILRGMSQQEVAEKLGISQSAVSQLEALDSRPQKRTREKLAALYGCKQEQISLYLPKEG

SEQ ID NO: 11213 - protein, 160 aa, Enterobacter cloacae
EDNIVTLDPETDLKLERVVDAPRDLLWLCWTTPEHIKNFFIPAPHKVTECDLDLRVGGRFNTVFEVDGQRMDNRGVFLEIDPGKKLVFTDGYTEGWKPAEKPFMTAILLLEDAGEGKTRYTAIARHPTKEIREQHEQMGFHEGWGIVLDQLVGYVKGLNA

SEQ ID NO: 11214 - protein, 76 aa, Enterobacter cloacae
IEKTQSASATAPDGITISFLNICFPDWLGAINFWGLLKHKKRPQALFGYQEFRLGSAGNQHFGGDNNDNQANQHRH

SEQ ID NO: 11215 - protein, 159 aa, Enterobacter cloacae
ISLKPLLFHSFACLYSVHFLLSDDLNMYASWTYRLRFIKKHLLMFLLAFGWLLIQTQVAVASHQCSMDLRGEVATIQHMEMMAQPGPHYAAGASPLCEKHCVPDQVQKDPAQPHLVALPAAMTLTLTPPECSSASHSAWSVTPPAVGPPATIRYCRFRE

SEQ ID NO: 11216 - protein, 413 aa, Enterobacter cloacae
MSMLPTPEYSRNMRLIGHSDQGGRPDGVQLMVHRGFAYIGHMVSQGFSIVDVRDPKNPKPAGYVPAPPGTWNVHLQAHDDLLLVINARDLFADARFADEKVYYTRQVGETVSDVQDRGWSAGLRVFDISTPDRPREIGFLSLSGIGIHRIWYVGGRWAYVSALIDGFTDYIFLTIDLADPRKPEVAGRWWLPGMNQSAGEQPDWPEGKRYALHHAIIAGDTAYGSWRDGGLTLLDVKDRTQPKLISHRNWSPPFGGGTHTALPLPDRDLLVVLDEAVLDNQEDGEKLIWLFDIREPSNPVSISTFPHPDEIDYVAKGAHFGPHNLHENRPGSFVSSTLIFATYQNAGVRAYDISNPYRPVETGALVPAAPERMMDTRPNRPQVIQSCDVFVDAQGIIYSTDYNDGLSVIEYLG

SEQ ID NO: 11217 - protein, 292 aa, Enterobacter cloacae
TVSSVPASASSCPNTIPNTMNSTVVKGAAMNMKPIGGMLLLMVSTFAFAQQSFSTPEQAANALTKAISEQNESAMADLLGDNWRDYLPPEGVDPEAVARFLRDWKINHRTEISGDIAHLSVGDNGWQLPIPVVKKKEGWQFDMQKAADEILTREIGRNELAAIEALHAYVDAQRSYYAMNHRYAQKIVSTPGLKDGLYWPISPGEAPSPLGPAFSPPEPGMGYHGYRFRILSDKNGFAMVAWPVSYGQTGVMSFVVNQEDKVYQANLGNDSAQKAQALAAYHPDKTWQPVTP

SEQ ID NO: 11218 - protein, 66 aa, Enterobacter cloacae
RDDPQHIGRTGCGNLTLSFLVDNGVEQGIKPGFFRWIGKYVLTQLPTIQGAVSLYHTATKMRFDGV

SEQ ID NO: 11219 - protein, 64 aa, Enterobacter cloacae
CRKISSGKCARHIPANGQPVGLLSEAPAGFKGYCWFSLQSSLSERSPSLGMRFSSAAHSPRSIS

SEQ ID NO: 11220 - protein, 103 aa, Enterobacter cloacae
AGDGNSEGRSCERPAARCRRGDDRLTELLPGPVTGCYIMLNDSANFLMLLFCKQINTVQKSCYAARRGIGHLPYKLLSHRSVKRTPAAYDNESEENRRARRIP

SEQ ID NO: 11221 - protein, 62 aa, Enterobacter cloacae
QPQLNTAFSNKMTVIYQVACQLFKLLKIMDLYFDAPKWVVILTILKIVNMTLCIVKMTVRQR

SEQ ID NO: 11222 - protein, 93 aa, Enterobacter cloacae
RQPGNVSVTYPGKRGRCGIESASHRRKGDAGNKHVYQIKEKAEQKDDGDFAAIRHGSSSGEVAYRIGPHVTDKRDKARYTVNIILTVNQASDA

SEQ ID NO: 11223 - protein, 171 aa, Enterobacter cloacae
AGRRTDQKTGTGLMTTAVLQMRQGVLLTTSCLLAFVLLFLVIALGVSIGELSIPLNNVFYAISNKLGLTDVPLNRIYESVIWDFRLSRALVAACCGAGLAICGAVLQSLLKNALAEPYVLGVSAGASTGAVSVVVLGLGTGRSVAFCGRVCRSLRRLCLCRLPDQRRARRQ

SEQ ID NO: 11224 - protein, 120 aa, Enterobacter cloacae
TLVNDPVRFRQLFQRVNRMVCQPAWRCHGQDGEGGHQRGVVARICKRAEPDSDIEALGDKIGMQRGRDMPHAKVRVQLAKFSQQRHHHLRAIFGRGGDPQFSRQPGVVGANVILQSLCIP

SEQ ID NO: 11225 - protein, 138 aa, Enterobacter cloacae
QHAVTCATATGATMTHFEQEILDIHVALENWLGAGEGNRDALLARFRPDFLMVPPSGNPLDHHALAQFLYAQRGTRPGLRIGIDALTTLQTWDNGAVLHYRETQTRPGQPVNVRWSTAVLNQEGDNITWRLLHETAQP

SEQ ID NO: 11226 - protein, 79 aa, Enterobacter cloacae
VNVCLVEYREYVKGGKRKMLDFTCCVMFFNYWLTKAPGSATLTRPALHFPLSLWERVGVRASARTERCTKPAASYRAGG

SEQ ID NO: 11227 - protein, 83 aa, Enterobacter cloacae
AQRAFSSWVKSSIQCSWKSVNVTPVIREIQHGDIVMISLWSLADTLMCGQHCSLLIGWLASTNLQNNEVNPIVTKPDVLRHRI

SEQ ID NO: 11228 - protein, 82 aa, Enterobacter cloacae
IWCAARAALNLFGKMSLLITYTFFNSAVLASSFSYLFRLSVSVIFIFLTEFWRYKIVIQYNRHHPAAHCLNAQLSNGSNTLF

SEQ ID NO: 11229 - protein, 76 aa, Enterobacter cloacae
NSRLLTMLKYAEHPSDVLRLVLEHGLRRNTMEGFYNEIPHHPGSGPFFFKHSFLRYVSLSGERTGYPTRNQLCRKA

SEQ ID NO: 11230 - protein, 160 aa, Enterobacter cloacae
LPRTGESLWSGEITGGAMSDRIFAGIWLLLCIGGMFVAWQIHSEYSYEPVGPRPFPVGIVGLMLLCSVALLLRHPDTVEWPPRRTLQRLLVMVIVLLMYAWGFEWLGFPIATALLTMVIGILFNASLPAAGISGVVLGILLWYAFDRLLDVTLPLGAWFN

SEQ ID NO: 11231 - protein, 68 aa, Enterobacter cloacae
KQCSIRAVLSGMAASLIHIPQCLLLTHSGRIFHTFLYNLVSKTISAALLLSKQFLNTLRNLNKYFRPR

SEQ ID NO: 11232 - protein, 147 aa, Enterobacter cloacae
GSAMKYPIVLVLCALTVPAIAASTDWPSALHGIASGDTHWIEQAPTLAATADARQAQLLEDALAAALTTNTSATLKALQTIDAGKWPHMVGSDIVCTPPLEKSPAEVDAFYQRTRRALLDTVEGAQCLWILEATMEELNAEKARQGK

SEQ ID NO: 11233 - protein, 64 aa, Enterobacter cloacae
RGRHKVCGVVRKRYGVLLRDWPDGDGDGELQLVSMVRSDPLTLTLSPKGRGDDYALAPLGRGPG

SEQ ID NO: 11234 - protein, 69 aa, Enterobacter cloacae
HFMLVVASLTPGQRMRPADKRHDPMIPPSALVITTVDDRGRPFGLASGQLETARGLAGSVISSPPSPGC

SEQ ID NO: 11235 - protein, 64 aa, Enterobacter cloacae
MATTPGFSYVHAEESAVHHLLHLQLPDSADLFELAGTCAAYVSVLVEMDDAVTFSTLCKQLLGC

SEQ ID NO: 11236 - protein, 150 aa, Enterobacter cloacae
SCSMKKLPGATWTVTSCIQIAGMTVRRHKENVMGWKYEQSTGKMYKDGKLIETGYSGALTNKNNPDRQHVKGLGPLPRGTYKIAGHSNSKGPITIILEQTSGESFGRSEFRIHGDHKYGPAGFASEGCIILSLSTRRKILRDGGELEVVR

SEQ ID NO: 11237 - protein, 67 aa, Enterobacter cloacae
PLMQIALHANIIRDEIQCSDLSFMRQSGRRSSHCLRMFIKKTQKTPSAELRLALKRQQEMLDEQKDY

SEQ ID NO: 11238 - protein, 77 aa, Enterobacter cloacae
TFLLNVLGCYRHKITGKSPLMILQIITICISVVNKFRWGTSGNEEGMEWVAVGDRRAARRGGNVRADVPAGRYSGKV

SEQ ID NO: 11239 - protein, 85 aa, Enterobacter cloacae
NGMRRELLFFTHHLKIVIHRIAGYAQGLRRVLDATPHFENAFSVHFSDYFKPLRFLYLFARNRMFIDDFLDRLLNDAAQVHILRV

SEQ ID NO: 11240 - protein, 123 aa, Enterobacter cloacae
YLRIKMKFLTLIVAITLLTACQLVRPFGEATTYKPFTVSAHPGLEGRYHCMRSALDAEGYEVEHIFPERDTPNFFDISRGSRLIAQVDMSHTTGANFLDITLISGSKQTNEDLARVIAHCVSR

SEQ ID NO: 11241 - protein, 307 aa, Enterobacter cloacae
TGTSSCLYWYWHYHAGDVMALMSEPVTSLQDDTRKQLGAFLRARRESLDPQRLGLPRSGRRRTPGLRREEVAMLADVGVTWYTWLEQGREVNPSSAVMAAIAKALQCTPTEARHLFVLAGLPPGEAPQAVCCEGISEGTRRLLDTLMPKPASIQKPNFDIVAWNDSFGHLMGVDFNAIPPEDRNCIYLFLTHPAWRARLGKRDDVLPIFVSYFRAAMAEHRGDPLWEAKLARFFAVSEEFKTLWHQRNDVRGVENQLKLFTHPELGDFHLQQMYWYSAPRNGSRLLVYLPVDEAGERAMAWLAEQGI

SEQ ID NO: 11242 - protein, 75 aa, Enterobacter cloacae
RRNHPIYNECLLTHNAKAVVPGHNGRFVLAKHTWNDPLIQLAKASKDKNYRLLTPELGEPVRVSDTTQQFREWWE

SEQ ID NO: 11243 - protein, 63 aa, Enterobacter cloacae
KQALTPVSSQPDFLHETPIAKVALTHIFHSTIDCYNSIFLTLWQFYYSSTMLISPHSHSWGFL

SEQ ID NO: 11244 - protein, 61 aa, Enterobacter cloacae
SVARVLPRQNSADNEVPYQKRLKPAWILYWNSLLNRVNIYLTFINKVEEDGHDDAFICMRL

SEQ ID NO: 11245 - protein, 75 aa, Enterobacter cloacae
LTANAFAVTFKNMHIVIHAVEPSRAQVGAVTTMQTAVGMEKNIPFGSLSFRICAPGTTHLAAFKKDDAADTRPVM

SEQ ID NO: 11246 - protein, 72 aa, Enterobacter cloacae
TPISLPSTLPLKGKSSCTCSASHTPIQLITILQAFVSYMKLCFLFNTVNIKAMNVSSSDNVTNLLIDQQLIN

SEQ ID NO: 11247 - protein, 85 aa, Enterobacter cloacae
AENDGSLSGITSTAASAETDHKPKLKVHCLTRLEVATRCVHRALILYEPRAAFYTEKVAKKQNKNAQVASVVRKNFQQRFQRNER

SEQ ID NO: 11248 - protein, 66 aa, Enterobacter cloacae
KSCLLVRMFGKRALSKVKASMQAWERSGLQQIDAVLQSASLIKRIDDHASLSIFSPGAGLVRQIRA

SEQ ID NO: 11249 - protein, 67 aa, Enterobacter cloacae
AVHSVKKVRICGPFFMLFQYPAIPDFVICLAKPVLFVYPLLTCLSPWGMDFVFWFNKRKNKWNNLML

SEQ ID NO: 11250 - protein, 106 aa, Enterobacter cloacae
GDRGMSDTLNYNPALPESRQFTPPAEGGNGAIHKPGDYTNLIWQTRSREPESWEVKLIATLEDLFEQGVETLPELVSGLNAVRMHDQQGEPWSDASFRAFLQVNGY

SEQ ID NO: 11251 - protein, 313 aa, Enterobacter cloacae
IQECEMTNTGFIIGAYPCAPSFHQKGEQEEYTFWRELSDTPNIRGLEQPCLENLHPFGDEWLFRHTPGNWQIVVTAVMETMRRRGSNGAFGLASADEEQRKACIEYYRHLHQKIDAVNTRFPGKVVALEMQAAPQAGNESVEQATEAFSRSVREIASWDWGCDLVLEHCDAMNGPAPRKGFLPLEQVLEVVKETDISVCINWARSAIEGRNTALPLEHVQAALAAGKLGALMFSGTTPHGEYGEWQDLHAPFSSFCADSLMSIEHVKALFTAASAATLKFSGIKLLEINANADVSHRIAILRDGISAMNKASQ

SEQ ID NO: 11252 - protein, 110 aa, Enterobacter cloacae
QPLTRAVIKMMMKRGVSLFLLLLLTGCSASEEIPVQKAQQGKMSPERSLNMEQLCRDQAAHRYNSEAQKIHINGFERFQGSYELKGYTARKEGFVCSFDADGQFLHLSMR

SEQ ID NO: 11253 - protein, 74 aa, Enterobacter cloacae
RKQRIGPMPAIPGQTKRNKNSPIHHNIRLIMKHIGPYSLALCFAYNPALESYKNKCAYKCNYRYDHANARIVHR

SEQ ID NO: 11254 - protein, 158 aa, Enterobacter cloacae
APVRFASGIMKTGDIARPVDIQFKSVGAIDDVLQHQIVNRGVGVFVFSADVEQVSARDAVGTVVEDVQAIAPPHQHQLAKLVGVLGEDVLRVAVGHRDGLTRGGKKIIFAKNELSSHTTTSTANNRTLLAFLQQKNGDCPRVTEATRLSPDEYRAATS

SEQ ID NO: 11255 - protein, 138 aa, Enterobacter cloacae
RRSVVAGRRTVCAGGSAGTALFARPCREEKIMENMTVFILGIAILSAGTYLMRLGGAKLGNRLALSERSQALLSDAATVLLFSVALATTFYEGDHFAGMARVLGVGFAVFLAWRKMPLIVVIVAAAVVTALLRLAGIN

SEQ ID NO: 11256 - protein, 71 aa, Enterobacter cloacae
RNDSTHNHYLMQKRALWRENAHFIDTDHTFRFRYFSFVLVNDKLTLCLQGIVTVTGGHANNKHYSFAGFRL

SEQ ID NO: 11257 - protein, 67 aa, Enterobacter cloacae
PYKNYGIDNHFQYHLINYNEPTAYAALTAVPPDNNGEDYELYTAIPAVCLRRTGTAFRQADDGNPSH

SEQ ID NO: 11258 - protein, 112 aa, Enterobacter cloacae
RSVSPSAVSGGIIHQLDQNDAEAADKRQDREQFAEIMGEIVPAESRPGKAKPPPGTYGYERLYSGSHSVNLSPPSGLSSAFTQPRCCCMAVSTIASPSPVPPDSRSRASSVR

SEQ ID NO: 11259 - protein, 66 aa, Enterobacter cloacae
PMNPHNVHLRCSASVAVLRDEENPIHQGFAKPDSETKRKVFFVTVRYNSPSHSRHSIQGRVVCSKC

SEQ ID NO: 11260 - protein, 68 aa, Enterobacter cloacae
PDSLSFPEYTLLGDTAIKAQPQVWVNSAKCKIPSMLTLIYVIKNNAFIYRIDNYRKNIQKKRKKGLFR

SEQ ID NO: 11261 - protein, 69 aa, Enterobacter cloacae
IRLVLIMASISTICPTVPEKYDSYFFIGEFRGLGEGMSGGAALTTTYGTVGPCKRSAAGQFKQTTPSAA

SEQ ID NO: 11262 - protein, 72 aa, Enterobacter cloacae
LVRKIGAILTVQANVCEPILGVGIFFSVRPVQGNKLDSVHENETGFGDLLATAIPFAHHQTETGFCNCFCRK

SEQ ID NO: 11263 - protein, 97 aa, Enterobacter cloacae
GKDRNAGMKMALAQRVLLPVVRHHTGNFAGATTDTLLSVGHNKTIHNNTCFWFNNLILSIVIVFTHSSMATQCSNAQEGELFPVNLWQINLIQEADE

SEQ ID NO: 11264 - protein, 71 aa, Enterobacter cloacae
RLTGSSGFDSTPRTFDQPRLKKLLQLAYLQADGGLGNTHYICCRRKAAALNDQTKSGEVSQIERRHAKFLL

SEQ ID NO: 11265 - protein, 159 aa, Enterobacter cloacae
GETQMIRRYFLLPVFALTSFAGALAAPLDGLSAADVNGPAAVAPQEKPQPPAKLIVDPPLAGPLSKGAVFIQYRVENLRIEPVFGPDALKVTPRIGHIHVVVDDAPWHWADTSGEPVILVGLPAGKHKVTIIVADPTHKPIDHKTVEFTVPPHAAVHHF

SEQ ID NO: 11266 - protein, 65 aa, Enterobacter cloacae
VYWQFKQGGQLCLKDERLFSLQLFVELWRIVNPEKFRMCYIPLKDISSKILNIKSTKEQKDSLWL

SEQ ID NO: 11267 - protein, 282 aa, Enterobacter cloacae
PSSLLTRRISPSTIKPLSSPCRHTPRFITFKEPVMKALSVLTAALLAVSTSALAETKASVVLVHGAFADGSSWNKVITRLQKHHNEVIAVQLPLTSLKDDVAATQRAIARAHGDVVLVGHSWGGSVISEAGNNARVKSLVYVAAFAPDSGQSTADLADSYPAPPGSASLAKTSEGYLYLPTKAVSENFAPDVKDVERSVIAATQSPIKADAFGEKVAHAAWHDKPSWYVISKNDRMINPELERAMAKKINANTTEVAASHVSMVSQPDVVTRTIEQALSGQQ

SEQ ID NO: 11268 - protein, 410 aa, Enterobacter cloacae
SHCPRPRQRHPYHRCIRLLKGEMMKTIHLTQGQARTRLIAPDDMVSCNLAFIDCKLPGSHLKQNYSFIGPGVTQSSEQVVNIPEPHGFNIGAAAMPKGVTNNLHLHFTAEVFLIHEGTWRFRWGANGEHEAEFSAPTILSIPTWIFRGFTNVSKEDTCGMVFTVLGGDNTGGIIWHPSVLATASEYGMYLSKDNMLIAQEPGEPTPDPAALLTPLSEQYIASLRDYSVEEMRQRAVTGDDRRWSAQGLLDSVLPGHGGEIAPVIGFGISQDRDSAPAILSPHGFSVEWLRLADDHIVGRHLCPDIQVIMVFKGQLEVTWNEAGEEVSIIAPERSVISIPANSWRRYRAVDGNVEFILTTRGDQRKRLYWDEAILHEAREHNRCIDPDGYVADADILPATACRAGAILEKW

SEQ ID NO: 11269 - protein, 200 aa, Enterobacter cloacae
RRGERMRKRDALLSARSYLTILLGFLLGFAIVVWVEKQMPTRVESSAGISLSNDFPPLPAPRELTFEEAIWARVAWQYYVNNTQPNGLANAHDGEPWLSLWSTGSYLFAVAAARQLNVLTSEEFDERIAAALAALASLPLNPQGLPPPITMPTHLRPWAYRTPRLSAWAACLTPCKRCCGAILSTLAPYAICSIAGRWAP

SEQ ID NO: 11270 - protein, 477 aa, Enterobacter cloacae
YGRACETAAGDRTMLKTLARWLAAAVLILIIAFALFSCESAGWRWLTKGGWHTTARISSLTPQEREWAGIAWRYFENNTQPQTGLVNGSDKQPRVTLWQMGDTLIALLAARELGLIQAAEFDARLTRLLGTLNRLTLTETRTPGRLYSSRTATPIDFTGKPAQRGWSAKDMARLMLALRLTAERAPEYREYLEKIILRWNFCPVMDKDGELWSASEQNEQLLVRDELRLGESEYAASAFRLWGFPAGKAFSPPSQNVIMYQRSLAVDARDPRTTWQPSLLSTLPAMLPGLEFGWQPPGVASDIHKTLRARAEAVWLSQKTRWERERALTARADFYLSQAPWHVEDTVWGNGYAWNTLGDDGKSYPRLAQVTTKAVFMLWTLWENEYTDALMAITRHLNNPQQGWFEGRVEATGDINPTLTLSTNAMVLEALLYKHNAGPLFENGLVKNDGYFARRTSDPFNPPGLCLPGERALRAAP

SEQ ID NO: 11271 - protein, 62 aa, Enterobacter cloacae
GGAMFSVGDYVQPRQGGPKLKVLEVNGENIVAVQASDEQSEKYHLKAADVVLYSEEGDFGVC

SEQ ID NO: 11272 - protein, 554 aa, Enterobacter cloacae
CRYQCGRPRKPGVHCPRSDALSGLPWPRHSPNLFSRSEAMKLKSILFFPLLAGLVACWLSLSAAQAAAGLPASDYPPRSGELTPREMTIAKNAWQYFVANYQPTTGLVNAVNKYPSTTMWDSASYMAAMTAARELGIIDKAEFDRRMLKLLATLNKLDLFRNELPNKAYNTITGQKVNYQNKPGEIGFSALDIGRMLIWLKVIKERYPEYSNSIDNVLLGWNFTNVINPCGMMYGAYLENGQPKYVQEGRLGYEEYGAAGFALWGFGTCQASQPQPYELAEIYCVMVPYDSRDPRLTSQHNYVVTESYVLYGLEFGFDKPTDRENSPRDYTHPWMKNFADRVYQAQENRYAITGILSARSEHQLDQSPYFVYDTVFSDGFNWNTITDKGVYVPNTAAVSLKAALGMWVLWNSPYTDRLLDAIENANEAGKGYYEGLYENGDGPIKEFTANNNGIMLEALLFKKEGKLMQFNSDNPKDPHFAPSLWEKKLVDLFEPNNASRNRPFLNSTPAVKTWCEQTGTTLRTKPACQACQCATCNTDEPVKLPPVTAQCLRP

SEQ ID NO: 11273 - protein, 74 aa, Enterobacter cloacae
ATCWDVTAAKVLRFITPDSLSTSCPFARASNASASGCFLYLHHLCMRMQHKKLKFSQQDRDHFTNMKPFRNFKY

SEQ ID NO: 11274 - protein, 322 aa, Enterobacter cloacae
THRGRTGGPRKPSTQSSGAAAAYYHADTLETLGIPDASAIGMGRLLNALQTLLWRYPQHAGAVRNLLDRWKMGALIANNTTSQAAVPLHHWALATDEPRNSFGYRLYASHTLRLIDSAAGLAVTNPPEGQQMIDIDGIMVPDEGLRTPWGRQPSLISLPYLLTGLELGFDAQSAEITWRIMQIQQRRHSLRVRKPPISTDYAEPAPDYVNDLPNRQPLQNSALLDATPEQTAMTSTRTAFAWYALFRNGWSEALRQQVQKLQVPGKGWQRGLNLNSSVNEIVDADTNAVVLESLAYIAHGQMLCLACPGPATPQTSSAGAKP

SEQ ID NO: 11275 - protein, 172 aa, Enterobacter cloacae
WLFCPPHVGSFQSARPLSARRTCLEGRTMKFYRDLFDASLNRVLPENDKRHFFETFWETFVHMSPETEQHFARDQGGDGQQTIFKSFFAMLAVDGALFVPDFLERLAREQSDEGLGLPPRFFGLWREAMLRTVRACDPLCDEEILTAWAMAIAPGLEYLRRQAELHYKARGE

SEQ ID NO: 11276 - protein, 82 aa, Enterobacter cloacae
NKAIVSEETNALPAKILFNKQDLPLLSLARPMPARIKSGNLRAKLIIYTGNSCLFICLRFISLIICAGIDLFRYENDIAINV

SEQ ID NO: 11277 - protein, 66 aa, Enterobacter cloacae
CSSKGRSRLRKICIQGWNHSTLCGLRGGELSPLADVLDQGSELGGHIVALGKIEIKTRKRWKKRIQ

SEQ ID NO: 11278 - protein, 316 aa, Enterobacter cloacae
WRNITSPRAGYLTKEGLMRDKFLLTCALLCVATGAESAPKDDADSLRDKNGEPVQAGVFTSRWGRLFSGNEDVFSGALSFSSGLKEQWMTIPNSSDTAEQKRKYNQTLNLSLQYSPYSYWFANVTSRLPVTDTSRYTADFRYSFGYDDWHANTFSLVYSNYGDNRFWTSGNRRHTYFEQGAVTLAYKFSLPKPIENTLLINKGDSIICQMGYSWVPRYYDLDSNDIRKNKNVVLGGCGYTFKQHFFVRATAFWFPDSSQQQPWNGDYSYSFGYAGYTPGSFSVQYANYSGTRYPGHQSGSGKFREGTVSVIWFLPL

SEQ ID NO: 11279 - protein, 326 aa, Enterobacter cloacae
GAHMTRLRGFSPQFDSIQQFILTLTHVVWEQKDIGQLADFYATPVVFTTPEKQLHELSQFMRLTLEAMHSFPQRAVLTEDILCSQNPGDEYYAAQRTVARIQHQGEGFFGPPTGKNVWVRTWADRICVDGAVRQEWLLQDRAAIVAQLGLDVRDFAFNLATMRQQLGLESVSAETLDARWAGGPEGDDVEGALAGVVERYLTMWAGGNSGVVPGLYHPAATLYAPGHCLCTGEQEIGAQLSGYRASFADSETQLHHLIVRKDPNEPIRLSLRWSLLTWHDGYGKFGAPTRKPISITGISQLELRDGLIFREYLGIDELAIWSQIFN

SEQ ID NO: 11280 - protein, 60 aa, Enterobacter cloacae
VTVDPGQHAFGAKLLFYPARDLTGRRMLRGEQHARILARIIDSPRYQQPILHRLTRHVFR

SEQ ID NO: 11281 - protein, 418 aa, Enterobacter cloacae
NTRNFLAWRTRRPMSQIAPVLINKDVEKPTTWRYIASDKRDLRIDFMRGIALVMMVVAHTEVMSIFNIFTWERFGLVTGAEGFVILSGFMLGMLNRVRLQKAVLLTISWGLYLRAWKIYRINIIIILSFLLLGYLPFINVFEVTHFTDRYSGTTWSLYPVTPQIKETWFNIVLYLQIGPHQTQILGLYIFLLLLSPLFLGMLQKGYVYWLLGLSLLVYGGWQMWPVRATPSQFEFAFPLLAWQFIFVLGMCSGWYKEDLISFARTPAGKVVLVALVIIALLLGFIAQNHTNPFMPPALLMHSLSPEDFNAFYHTWAAKNGLGPVRVLNDICLMVTVYLVLTWCWLPLYRLAGWFLIPLGQHSLYTFILHVYVVFLISQFVTFDLWRQDWIVNTFIHAAALGVLWLMAKYNVAARWIPN

SEQ ID NO: 11282 - protein, 126 aa, Enterobacter cloacae
RGIPGMLHSQSSRVGSMLLLLTAIIAFAVALYAWWTPLTGVTGTIGALGVVIASVVLAILTVMLRAASRRGARVFLIIVTLVVLAGIGFAAALLHQYIITAAMVVGLIGLIMLSSHSARYNHRVRS

SEQ ID NO: 11283 - protein, 62 aa, Enterobacter cloacae
IYKGRYTKLGFLAGAVLATWLSLTYPTQMRAVFEQLVTIVQQITQPSSESHSDMVTPEQSYP

SEQ ID NO: 11284 - protein, 187 aa, Enterobacter cloacae
TASAVNWRSTMKRFLFMALALTMLVAGCSTEVTEYRQQQPRLDIFTYFQGKTEAWGMVQDRSGKQIRRFHVEIAGDVIGDTLTLNEHFVYDDGEKQQRVWHIRRVGQNRYEGTAGDIEGVATGQAAGNALNWRYSMNVKADGKTWLLHFDDWMYLQDSTRLFNKTEMKKFGVTVATVTLFFTRKEGG

SEQ ID NO: 11285 - protein, 60 aa, Enterobacter cloacae
LTPSLLIIIFTRDYNRANDGGSVTYLEVLNINPRQIRGIEWENHCGSAGAFSCVPAPLTG

SEQ ID NO: 11286 - protein, 61 aa, Enterobacter cloacae
LLDTIMHHPSQRCSAVSQDSHLRIITRHYSKSSTGQGTDHSVSYVPAKEAATSNSLIHEKG

SEQ ID NO: 11287 - protein, 97 aa, Enterobacter cloacae
TSQPNERLILNRVERSRLVYQYPHTINTMNIAVPISGPLQRVDMAQKVLPHLVAFVVNRGVSILIDDDAVAILYGFDNFLVTHDLQQGFRAGKERHQ

SEQ ID NO: 11288 - protein, 180 aa, Enterobacter cloacae
PQLQVSGPIIAAMKSAQRGVQRSRVLPQRIMATHLKTAKNLRLFHRVARRGFAPGGIMLLDKPVFRINDRHFALDVLPGKQRRLQHIPQSRDAVGQVIGGNVEEKSAVASQRGGIDVAALALDPGHESIIALIALATAEQQVLKQMRETGESRWLVMASGTHARQRRRACRLRLMHQRCA

SEQ ID NO: 11289 - protein, 61 aa, Enterobacter cloacae
ILYLYTVLYIDSKDQGGTRSDVVRVQEEEGYIQNGGEANLAERVFNEMFKEYKCPYGRYGQ

SEQ ID NO: 11290 - protein, 145 aa, Enterobacter cloacae
PMSTLPSVISRFVDYYATLDTQPPSALAGIYRADATLIDPFGEHSGVFAIQRYFTHLLANVQHCRFTVDAPLQQGDRFVVTWMMHWSHPRIARGAVRQLPGCSVVDMRDDRIVRQRDYYDAGEMIYEHLPILGWAVRGVKRRVKS

SEQ ID NO: 11291 - protein, 175 aa, Enterobacter cloacae
CPHHQRGAADCGTRMKRYGQVFLLAIGFDLYWTLVVLFREQGLVIWIALAVLAWLLLPPSHRVYALVLAASGALLDALWALTGLIAFTGASLMPLWMVALWLMFATVWTHLTRTTTLPGWLLTVLATLGGPVAYLIGEHLGAITFQEPTFIVVSWMFPGWLVLMLFFHLLMGRQQ

SEQ ID NO: 11292 - protein, 155 aa, Enterobacter cloacae
SSPPGKRRKSVMHIILILLVIAGGMGLSVEAGLLGPLGAEVGDLWAAFSIFSVGTGLTFLLMLFFSPRNSPSFFAQPSWHLLGGVLGPVYVIILTIATPAIGIAMTMIGILAGQVFKSLIIDHYGLLGTPHRRIDTKRIIALGFIIAALILVAQG

SEQ ID NO: 11293 - protein, 92 aa, Enterobacter cloacae
NAPVDARSKYLHLSMKRGGGVAELERLRAFTQRQRATAQTVQQAEEQPSRDADVARDIGFKRKDGIGHERSLLLRGWLCSGTRFSHSLSACQ

SEQ ID NO: 11294 - protein, 254 aa, Enterobacter cloacae
RGPEMGTAIFMVLMVCGYWYTSRDLSTRFKIKRSFGWDVYFLVALYGCIFVLQGVIATGLLWLLLFALSAADNTFHFTSAKYADWQIDFMNWSFLGIQAPVVVMLTFAILFCLYRSNWAGSARLDGEGRKKLYKRLAQSSGIEQLLYQCMEEGELAHVTLKSRRIYIGMIHTATLEYEKTANIVLIPMLSGYRDGKNMQLCIEHNYSKWYAEHDITLDSEPKSAMDFRKVIMLDQIESISLFDPASASALAMRE

SEQ ID NO: 11295 - protein, 219 aa, Enterobacter cloacae
AFICPVAPEATETYLYHDHQENNMHTSKTLKRLLAVSAVAAMFSTVGVQAQTTSAAQTQTAGKAQPDARLSSGDEKALKDMAQANINEVAAARLALDKAQSSEVKTFAQKMVDDHGAALTKVQTVAQKKGVELPTEPDAAHKALNSRLENQRGDAFDKMYMEYAGVKDHEKVLSKLKSDASKIDDPDVKALANEHTPVVEQHLKSAEQMSTHSGASADK

SEQ ID NO: 11296 - protein, 85 aa, Enterobacter cloacae
RDSRAMARDDSPSPSLAGAFHGLTGTAAFFLCVVFSQKKAPYYDGARLLISLLFIQRVGNHVVTTIRRLACTAGRDQNVLFAGFR

SEQ ID NO: 11297 - protein, 190 aa, Enterobacter cloacae
LSTTMACWVRRTAGSIQNALLRWDLSSPRSFSWRRGNVMTVIMIILAVIGGATLSIQAAINGQLGSSVGVFKSAFLTFSVGALVTALLIFFFEPKQAVSLMDVPKWQLLGALCGVPYIVIMVLAVQRIGTAVATVAVILGQLAMSMLIDNFGWLNNEAIPFSVSRFGAVVCLSIALFFIYSSSKLQPEED

SEQ ID NO: 11298 - protein, 65 aa, Enterobacter cloacae
QQKNPGRQSRLIVRTTHHLSCRRGPETARGLIMHYVDLLENNAIEHFNLFWRKIWLQHFLSSDVC

SEQ ID NO: 11299 - protein, 376 aa, Enterobacter cloacae
IAQFMKNPHVAVKLSHFPCARGSGINYALITFRQHELRMHNQMSQAFTFTLKRSCFDENYNPSENTRTTTNFANLARGEKRQENLRNTLVMINNRFNALASWDNPKADRYAVELEIISVDMNIGGDFTFPAIEILQTTIVDKKTHERIEGIVGNNFSSYVRDYDFSVLLLEHNKDQPRFTLPENFGELHGNIFKSFVHSAEYQANFKKAPVICLSVSSKDTYRRTGNHHPVLGYEYQPDGESLTEQYFAKMGLKVRYFMPENSVAPFAFFFTGDLLRDYTNLELIGTISTMETFQKIYRPEIYNANSAAGQCYQPDLNQQDHSLTKIVYDREERSRLAIEQGKYTEERFIKPYKTLLEQWSHHFTLSFNTDKRFFS

SEQ ID NO: 11300 - protein, 69 aa, Enterobacter cloacae
GCHAMKHLLMTLFSSPESLLQVMSHQEIIEAVEDGDRIIIDQDGNASVNYKSHEVRQDFLRHVNALKRA

SEQ ID NO: 11301 - protein, 69 aa, Enterobacter cloacae
DEQHDGAVTFKHAFMLHYLNKLLLSQSLRAHKHKKSFDLNSPRIRGIFLAVCKQKTRQKRVFVVFEKII

SEQ ID NO: 11302 - protein, 109 aa, Enterobacter cloacae
KTKFEGMKMKKVLALVVAAAMGLSSAAFAAETTATAAPAASTAAPAKTVHHKKHHKAAKPAAEQKAQAAKKHHKKAAKPAVEQKAQAAKKHHKKAAKHEAAKPAAQPAA

SEQ ID NO: 11303 - protein, 73 aa, Enterobacter cloacae
HGDCLAPEALQGFLTEEALLSGQLSLMRYCCQSCGICPVAKRFTSKEEVTENALGIMRLIIELPCLNEKLQAT

SEQ ID NO: 11304 - protein, 76 aa, Enterobacter cloacae
IKPPLYSYIYDFLMFNLAKGLSYKQKLNGSFFLIIDKSHPDGCEGGCFLCYCVRIVLSAIKMGLFFYLRIFRGNKT

SEQ ID NO: 11305 - protein, 153 aa, Enterobacter cloacae
SLSQYQGGVGIEKNKELVASQAAYSGYIVEFNNGSRLWINRETLLVGWFDNPQVPQKGRMRFQKTKMNLFAYLLEHAVRKEVSRDELLHQVWEKYGLKSSSRQLWHAIGQLKLSLFTLGIPYEFIQSNKGKTYSLEKVKVFFITQSDINDDAY

SEQ ID NO: 11306 - protein, 85 aa, Enterobacter cloacae
YMNLAYFLFLSITVMLTSFIIKSLVVLVKFKLLRDERLEYTSNKNIDEMYDLMNAKEEILIRHHKQMLALHLSLLIFVLFIAYIY

SEQ ID NO: 11307 - protein, 99 aa, Enterobacter cloacae
  UNSURE (47)
  UNSURE (70)
  UNSURE (76)
LAALQPAGQDARWRSTAQRLPPHSVQWPSTHARPLAHKASSRATDRXLQPPPRQSPFPASRCYQRVSSSXTFVRPXCGDLSGPLIIIPQQIKVIPMGTV

SEQ ID NO: 11308 - protein, 112 aa, Enterobacter cloacae
YLSILISSANNGANEMNITSQPNPASKEFDIHAKLKAANSHWSYLRAAQPHQNDFDYEFNTTFIDGLEFAIYERVGNYFVLVDFFKSYEEACDDAKKIIDDHPDIKKMFSAI

SEQ ID NO: 11309 - protein, 113 aa, Enterobacter cloacae
IAGVFHSKKVELDGICYETSDICISELSHLEFSAFLSTDGAATIAIAKNGTNFTGLMQLNNDYSLLFYHDGKINMEGLIKEMELKGYMYQGAMGNDDVAAEFPGILLIAPEKL

SEQ ID NO: 11310 - protein, 121 aa, Enterobacter cloacae
LHQRSFNINPIGKSFPVGEGFPFFLEKPMTLNTSMLNKVSAKQISENFAKSYPDLLEGAVITKIEISGCQGSRRNDKIDLSYDGDDITDQKSVSKNQLRWIDIKALSFQSTITSRISTPLL

SEQ ID NO: 11311 - protein, 220 aa, Enterobacter cloacae
LKLTKDDFINPFRFNIAHFIPFTPISVEGDETQDYYQEQLITDLAEEAMRVYEKISKNNNLRSSTIDRLKQMQNKIISFMFIHKEAAVLAEAIKHIMNNLPKGAISEPRDVAVLQQWFYFMSDASMLKRIISGEQKVTDWLESITRSFNQSSQTEPNALQNTGIEAILDSTNVFQVEPVVENDIKNSTFSNTDSVAEPEKSVSQQEDNAENGFDIELKGW

SEQ ID NO: 11312 - protein, 211 aa, Enterobacter cloacae
VPLFIKRYSMKLDLKSSPRHIKRLQNIAKVISGLGDVRVVIDDNTKGPYFDPVNKVCVLPNGDYSDDDFVSLIEGFTCHEAGHGRYTVSEVYSDAFNSVLMSSEGFTRFDDGMNAEFESLAEKRKAYSRAKRLTGLINLFDDVQMEEKVGNDYPDAKRRLAATYALMVKAGRMTPDISSRPENPVLFIEWYLLNSSRVQCLNCGVQERTFF

SEQ ID NO: 11313 - protein, 78 aa, Enterobacter cloacae
TLTKLGFIYMKNIKSIAAASLLSAVSFSGLAQNISVTDTTLDGAEAQIAAKAKEAKTSYKIISAYTGNRVHMTAVLGE

SEQ ID NO: 11314 - protein, 120 aa, Enterobacter cloacae
RQEASTMRLASYAIALLFITSLTGCKPENGKAFVGNWVEETNSKIPAKISIADEKSGQRHFYAVKITDLIWDKETGVHYNTKKINAMLDKENFLWANNGDNFIIFDDHLMYNGDRYKRVE

SEQ ID NO: 11315 - protein, 64 aa, Enterobacter cloacae
VPQRAQPLSFVASGQAGNSEETASDKLEERGDDVKSSWPLRVGLHTCYNGAYKEKRPRESKRTS

SEQ ID NO: 11316 - protein, 202 aa, Enterobacter cloacae
PQMSKNKARSKALHQTFSEIIPEMDKALNKQLLEVLMKYTERDNELIVILNEDGPNIIELKSLKPVSLLAEKLSAYSSYYHVDVVELVVKKIDFEGAYKLLKASPDVPLFKSLTELDKYLVEEFEKYGLNSFLDVDNLDYSLEKASELKNEQLINWVSDIICKREKLTLRKRFDVAVKAHYENVENMYDSSPQRGRRTRAKR

SEQ ID NO: 11317 - protein, 74 aa, Enterobacter cloacae
  UNSURE (74)
TLGLREATLKEQFLVSAVSLYPITWFKQFPKWTYTSDQTNLPKLVFFPFPEARRITNGYEHGFPIKIFLLRNRX

SEQ ID NO: 11318 - protein, 285 aa, Enterobacter cloacae
FQITAINSATSLTVTPAASQALSGQKYGILVTDSLSVDGLAQSMSQLINEYDENIGAWETFATTSANQNITVTINGARVTIPAIGKLVQKGSNGAVGVSDGGTGATNAADARTNLGLGSSATKDVGTDSGNVMQVGAFGVGTYQAPRPNDANSSFISDADGNTSWAPANGCGYQSSYNTQRIAQMWVTTGGAGYCRFLLNTNPQTAKTDAPWTVFQSAGTSDINFKKVTGDLDLNESLSNIAAMDFKTFYYLADEDKVIRRGVIAQELEKIDPQVFTTRSKKVLC

SEQ ID NO: 11319 - protein, 63 aa, Enterobacter cloacae
EGALDHNNHTISLIYNKMLILFIQVNDRYEIHPYQRAGDKLTFIKNNLLNIFIFLHEAIRPEP

SEQ ID NO: 11320 - protein, 71 aa, Enterobacter cloacae
QTGSGSDCYLTASPATHNCDSMEQVADKFFDRLVSGQIKIKRGLSVNGHSSKEKYNLIAGGMVNVKSLVRG

SEQ ID NO: 11321 - protein, 98 aa, Enterobacter cloacae
PIYRLVDNYNQRAVGFPQQTMGIAAPGQRMGEQTGINGFFRKRQMHRIRFHLNRGAIKRYANLMRDSAAFGIDFCAQIANLKQVKTIHFREPGFKLKF

SEQ ID NO: 11322 - protein, 78 aa, Enterobacter cloacae
HVLLSGDRYTPVIETVAEPDSFPIRLVFPTLRLFILCDLSQGVASLSAARSAERIANGSSDVFRDSGNSFSFKGWQNF

SEQ ID NO: 11323 - protein, 69 aa, Enterobacter cloacae
KKAVNLGLLSIQQCQILRQSKHPRPMKMIQCQKKTRYQNDLKKRDAGRDYHSALWGYLLALIPHRLVVV

SEQ ID NO: 11324 - protein, 193 aa, Enterobacter cloacae
QPFFSDMNSRVTNPESYIFSAIIYIGKDNFTSNEVAKILIGRFSLPKNYLKAKAFAYNQIQGLVRKGLLNKVRKLGAYQYLYSATSEFNVAKENVELIEVSQKSPCQLISSATSYEHSNVNIQIRTLIEKYSSELEKVSGVKEIYEELIIAVPSRENEFRKLSLEQEKKQIKINEQIFFTTKLQGCPINSMVQ

SEQ ID NO: 11325 - DNA, 15 bp, Artificial Sequence
  Artificial sequence is a primer.
gtcttcaccacgggg

SEQ ID NO: 11326 - DNA, 11 bp, Artificial Sequence
  Artificial sequence is a primer.
gtggtgaagac
